United States Patent 10,113,201 (METHODS AND COMPOSITIONS FOR DIAGNOSIS OF GLIOBLASTOMA OR A SUBTYPE THEREOF) - sequence listing, part 7

SEQ ID NO: 73 - DNA, 456569 bp, Homo sapiens
gggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggtaggtgcggggagccggcagccgagacaggtgcgccgcggcgggagacccactcttctacccagcaaggggcgcttccgcggagttgggcacctctctgtttccacgcctctccttccccctttccccctctcctcccggggatgtctgtcttctccccatcctatcattccaggctggagggcagcaacgcctgctttcccctgtggcaggagagaagcactgggtccctaaggtcagagcaacagaaattttgtctgtgtgtgtgtgtgtgtgtgtgtgtgtgtgtgtgtgtgtgtgagagagagagagagagagagagagagaaagagagagagagaaagggttgcagactcagtgatgcttagttttcttaagagaagtcgtcaaagttgcccctaagcaggtgtcatcttcaaccacccttcccccaccttccagatttcgctggatgaacctttggcactaacttgacagctgagatcactccgacaggcagaaaagaatagcactacactgaagagaaatccttatggaagttggacctgcctcgaaatcccccatgaaggaagagtgggtttatgtctgtagatgcgccactggttatgggggctccatgcctgcgtgctccttgcctctctcctggctggaggagggtgtggggagcccgctggcaagctaggggtgaaggtgagagtggggaccatatttgcacctaaggatgagtgtatgtgtaagacaaggacagtgtgggatcaatggcctttaaattaggataaaagataaccccacattgtattagaatccaacaacgaggaattaggatttattaaggtctctctcacccctcccttccgcaggcaagaataaagacattgacaggtttggagagttgttgacactaaccctactgcttatcgatgttaaaggtcgaggtgatatgcaagcataggtttacaaagatgtacacttgctggagctcagagggtttctggaaaaggggtcagtgaaaacattcttgtaaccctactctttctgagttagtgttcccttcccaaaaaccatataaagtattaagcctgtcacaccatgtgctgttatgtaagcaaacgcagatgacagaggtgtgtgggtttgggagggtgtgttttatttatgggggcaggtgtgtgaataattgggatccccatagacatcgcctggcctggaggccacagtcactagggcatgtgctctgtgtctaagtgttgacttctgatgactcctaaaacgccttcctggtgaggttgttgcttctgcgttcctcccatgcattttgttcgctgtgcgctgagggagttccccacctgagttgttctcttagttactcacacagatcaggtccaaatggatctttctttttatactttggtttctaaaaatagacagatggtggggagggggtagctctagggaggtatgctaggacactggcagttctacttcctagttatgatggcccgtctggcccctgggggaacagggactacattcagcctaatttaggagctgtgagttggaagggggtggtgattacatgaagcacagtgtaggctgctcctggcttattggtattcatcagagtcctcactgggtaggaagacaaagccagagtttgcaagggaaatcatttcagcttgcctcttgtcaggggtcattctctgagcctccttttttaaaatgtatgttgtgtggggttttggctttctgagttgcatgctcacacatgcacgtgtaagtgtgtacacacacaagcatagacatggacacagacgcagcatgtttctatagaagaataataacattgcgtctgctttacaatccttacatagaggtggattctacttcgtgaacatcatttccttttaaataaagctttacagtctccaattcctgcatcagtgtcacctcaggtgtctggttaaaagtgctcaccaccctagacttgcagaatcaaactgtctgtgggtgagaatttttaacacgctcctcaggcgatgtttatgcagactaatatatggggattgccaccctattttgcccccaagactaaacaattgatctttgaactcataaaccctccccatccaaaccaggccagtcagtctcaaagtcagaggaaagatggtgaaaaggaggtgcttccatctggagcatgtttgtgcctgggtaacaggaaattgtctccattttgatcactgttacttatttgttttggagtaatggtgaatggcctgcccactcgtcatggcggccattggtgctggactcctgcagcagggctggctgttttactgtgggatggatgaagggtgtgtaaaaaaagagcaggtttgtcaggagctgagggtcggctccttggtggggaccacaccacctcccttctgggggcacctgaggacagtgtctggtgggagcttatggagaggaggcaggaagacctcacagaatggagtctgagtgaaaggactgagttagggtatggagcatggctgcttgcgtgagggggatcatttgaggtggaggagtggagatttgcaggtaggcaaaaaatatcttttgaagaacatgtgtatttttggaatgaaacttgacaggcaaaaagaagggggctttgggagagagggtgtgtgtgtgtgtgtgtgtgtgtgtgtgtgtgtgtgtgtaggggggtctcatctgctccttctgttgctaaggaacatataagctagggtttaaaaataaatgaggagtgggtgggcatatgcagtgactcctgtctttttaggaaccagagccctttacaaaaagcctttaaataaccatttctggaggcagattattcattttgcttgacttttactttgttaagtaaaataaactgctttctgtactcctagatttcccctcattatctattctgtgttggctttttttgagaaccatttttcccatgagaattttttcctttatttcagaatctgcacccctagagcaaatagtctctgtcgactgtaaagctgaaggtttgaaaaggcagtgcgagtgagctggtacttttcttttaaaattactacttcgtttttctttgcaaattatggtgctgcaacagatacatatgtgtaaatgactatatactgtgtaggaactgtttttttttttaaactgctgtaagaattcccatataagtcagtacaataaaaaaaaaaagacttcagaaacacataagggaggggaaggagaaggtagctgatgtttattgtcttctatgcaacaggcactgggctaagccttattgtatattctgtcttaattaatctttgtgacagtcctgtgatgtgactatgactatttccattttattgaaaatgaacttgaggcatagagcttgggcaggaggcagaatttaaaacacagatgactccaaaggactgtctctttagaccgcatcacgctgcttccctaaacatttattttaggcttgagctctctgtccatgtgtgcatatgtgtatgcatgcgtgtgtgcagtgtgagttatcttccccctcatctgtaatacacggcaggtcattacatattattattattatatattattgcatacctttttttggcttgtggccctttgtctatataattttagggaactcttctactatctcagaaatataaatgaatataaattcatgattgcaaatatatcagttttgcttctgagaacaaaaccacctacatgcacctgctatgaagatatcctcgttagaggtttatatgccttaaaaaaaaatttacacagggttgtgtaggcgaacctaggtccaatgaagagctggcccatcggtacctctttgggcagcacagaatgagtgatgaagtacaattttgcttgtcagtatgtctgggcagaccattacttatgagatgttgatgcctatgatttagtttctctgctcataaaccatgctggtaatactaaacctttcttaaaggaagtttttggtatgagatagaaataggagcaaggagtattaaacgctttagtttgggcaaccatgtaaaaaatgatctgttattctttataggttgatgattagaatgtagtttttttgcgtgtgttttgtcccacaaagtaaggttgtgttattacaagaaagatatttgaggagttcgaagccacgtaggataaaatggatattggtcttccttgcattgtaatcaatagtgtatgggggaacttttctcctgaatatcagtatgtatcctcttttgtaaatccattttattttgtttttatccgtgttttgcacatctgttagatttttaaagactgtaggatcagattaagatcttggttctaatttaattcctttctcagtaatgacttacatactgactgttacttcctcagttaggatacacactgggcaagatttcaattcaaccactgtccggagtacttattctgctctaagtgatcttttagaggcttgatttttacctgggagattgacactattgggtcctgtggaatctggggatagggaagttgaagagaggtctttgctggtgttcaattctgctgtggcaacaaacaacagcattgcctcatggggccaaattcaattagactagagctagctctttccaacaccgcactttctagtctgaggaaatgagggttcctagtgagagcccaggctgtctacaccctgtatgttcgtctggcctgggatctgagaacatgttccctacacaaccccaaggtatccttgaagttgagtacactgtgagaccagaagcatctggaagaactattgcctacacgttgggctgtgacatttgctttcttccatgggtatgtgttggtaacactgatcctgtggagactaattatttttcctgaggtcctgtaactagttttgggacagtagttactgcaaataaatgatggcatgtgagcttttcttacagtggataactttgaaagaaaggtcagaagtaaaatgaaatctaagccataaaactttttttcattaaaatttaatttgctcaaaatgcctataaaaatgggctgatttctaattgttggaactgattgaaacctatttcaaggcacaaaaacaatgcagataattggagaaataaaaataccaagctaagtctgtttgcccataatgcttccacaactcattgctggcttgttcaccaggaaaactcctcgattggtatgagctcaaaagcgtccacttggggtgatgggtggctggtgctcccctgttctttcaaatagctttgttgagacaagtgtcattttctggtctgggacttagactagggtttgaacttggcatctttctgctaatctcagacaagctatgtaactccttggaggcccagccaatgtgtttctaaaatgagataatagtaatacaggtttgttaggaagattaaatgagttactttatttaaaggacatggcatagtgccctacatagagttaacttgtgtacttattaccattccccaaactaagttgttagctcctttgaagacagaacttgcacctgatcatttgaatcgatgactctgattcttcttgcttggtaggtgttggataagtatttattgaataaatacatttcattggcattttaaaataaattactactgttattcattcttggttcatctcaattgtgagtttcttttctactaaagaaacctctgcctttttcttatttacactttgtccagcagcccaggactgcgttactgtttacagcttcctgtttgcgtacctgcatcagccatttaggcagctgtgaggctggagaggggtggcagaaactcttacttaaccagctatttgcagcttgtcaaagaaaaggccttaatttgccttctgagtagcactaattagctctccggttctctttctgtctgtctcatccctttccaaggggcagcattgattttctcctcagggaaatttctgttgacttttccttcagtgattaaaatgtaaaaatgcagaaaaagggctacccagcattcctggagtcctgaccattgtccagccagccggaggtcactccagccacctctgttctatattacttcactccctctttccttccagctcatctgattgactttggtgaaaaagttattttaggaagaatgcattagtccgcttagtgactctaagcttttgctttgtttttaacccacttaataaaatcttcagaaaagcaccagctactttttattcatgtaccatacagagcacttgaagaatggctcacgagtgtcctgacacccatagtgtttagggagaggagggatgagcactgcttgggttactttagagaaaattaaatcatcttgtgtgtgcatattagctgaaggagggggctgtgattgggtagaggtgggaagaaagatctttgcatatgaatgttaatgttctttccttccagccctgagttttgtgagcctttgaaataaagcaaacagcattttcttttaagggcaacagctttctaacaggggcttctgtcattcttgcatccaacctagttttgctgaaatggaaatttgcctttagatttccagactcataaataatgttctgataaaagaaccaattctggtttaagctgtaatatttatagcctggcttttgttagatgttgggaacaacattcgaaacagtaatatttaaaccacaattaaatttcatttttcttaactttcaattacttgagaggtagaggagagtactggtgaagagccctgctacctgggtccaaagcgccacctctgcctgctgtgtgcctgcaaaagttacttaacctctctgtgtcttaatttccctatctgcaaaatggtagtgatagtagtactcatcctgtagaattatttgacatttaaatgagtcacaaagtacatgctatatgtgtgtttgttaaagtggtattatctatactcaagtccagttaaggaacagatttgtctattattcttcaaaatacagaacatcatcaaatgtcagcagctggtgataaaattattcaggtaatatgaaaatgagatagacatagacttgagaaatttaactgacaggttttggcattctttaaggtatagaatatgtactttttctttcataacttattaaaacacaattcattgttactaggggatgtgaaggggagaaagctgcttcttagtgctttggaaattggagcagacagaaggcagaggtcggaggagagaggcacagtcagtgtgcggaggaatcaggtagcagcaatccaaactcccagctggtcatctgagagcaggaagccagccgtggaggggtgggtgagaggggtctcagagcttcacagtgtcaggaatggataagctgataaagaccgaggtactagaaatagaattgtcccctgtgattccaggacagaggttatttctcttctggcctgtcttgatgatgcctgctttgtacatacagacaatggccggctggcatgccctggcaatcacagaaagaagcttcgcagatgctacctgccctggattatttcagaaatggaaggtgcagccttctgggatgttccatcagttatttgaaccaggccaaacagcagaatatattttaaaagatgtagatggttattaaatatttgttggacaaataaaacggctcaggactgtgaaataaattttgaggaggtgaattcattttttttcccctaaaaaaggcaaagataagacagttggactgcttttgtgtatcatgtagtctttcaggaaatagccagaaaatagattccttgaaaggaccaaagtacattttaaaaatgtgtcattcctttgtacatgagaaagatgtcaggcttgtaaggaaaaatacatttttgcttttttaaaaaaaaaacttgaaagcaatttgttgaaagataaaaagagctttacataagcttatgtggaagcggtcggaaagggttccgtgtatcatttagagacaaacttctggaacattcctcaggctgaaaggcctcagatctcatcattgtccttatggatgtgtcagagtttgagacaatctctttcagactgaaagcattctctttaagagttttgaaggaagagcctgtaatcccagcactttgggaggctgaggcaggcagatcacaaggtcaggagatcaagaccatcctggccaacatggtaaaaccccgtctttactaaaatacaagaaaaattacctgggtgtggtggtgcacacttgtagtcccagctacttgggaggctgaggcaggggaattgcttgaacccgggaggcggaggttgcagtgagctgagatcaagccactgcactccagcctggtgacagagtgagactctgtctaaaaaaaaaaaaaaaaaaaaaaaaagtttctcccttttaaattggccccctctcaatgcaaagactaaggtgtggcatgtttcttttcctatgcaattgaagcaccgtcctcagtgtctgaagttacacaggaagctgccaagcatgggcttccctgacagcgcacaacctcggggctgcttggttttcatggctgtcttcattagcttgggctgctgtaacaaagtcccatagactgggcggcttctaaacaacagacatttctttctcatcattctggaggttggaagtctgagatcagggcaccaacatggtcaggttctggggaggaccctctttggggctgcagacagctctcttctcatggtgtcctcacagggtggaggtagtgaggctcctgggggtctctttctagaggggcactcatcccattcattagcgccccacccttgtgactgaatcacccccagtggccccaccttctagaaccatcacattgggggtgataatttcaacatgtgacttttgggaggacataaacaccagcctaccctgctttttctcacaatattccaggaagccacagacatcactcctcttgtccttcccagtggcctctgaaggccattcccagaggcagcaaaggcaatccatgcacttccaagctttttgtaagtgcagctcagagaaggaaaaagcttttcttggttcaaatactgaccgcaacgattaacttacctccctacctgtgaatattaatcattataagttactgattttgccaaatgcttacactgtgtcaagagctgctaaatattttacatttgggatttcactggaccgtcaattaagtagggactattattatttccattttacagagaaggacattgaggcttagagtttaagcagcttgcctgcaagtcacatagctgagtggcagagttaagatctgtgcccatatttgcatattgcttattacttccctattgcagcttttcttgtcctcttttcaccctttcccattaccctctctgtgtgcaaatagccatattttcacaatctagtggtttattagaccaaactctcttgaggagagagacccatgtgtttcatcttcatgggcccagccagacctcacacaagacatagagagaggccttgacaaaggttgattggctgagtggatgaacattctttttatgtctaagcataaaacttagctctgtgaataatcatgtgctactgtcagttgtagggaggccaagattgagctttccatggtgtttttttgtaaaaactatatgaattttccattgcacaagacgggggaataaatccagtttcctggggccaagaaatgattgcagggattatagactggtactgctccttttaaattctacagtacaagaccttgtgatttgttgtaatcacagtggaacttgaagggaggtgatggtaccatggattggggtccagtgaagaagctagggttaacttatgtgcactttacatgtctgaaatggcatagtcagccccatttgatttttacaaaagatattcttagaagagtctggtcttttacctttagctcgaggacctgtttgagctgcaagtctttgcaatatgagtttttccataacaacatccttcagaattcgtcagtatgttcatgagtgcagttagagacacctagaaagttccaaaggaacattttgaaaacctgagtcattctttctcatttgaagaaaactttcagaatttcttaggaaaataaacctctacttcaaaaataaatgcccaagctatttaaagattaaaacagaagctttctatgagccagcgtggaattacttataacaaagtctaagggattttttttaaagacaaatttctggagatttcttaaactgttatactgactaaatttaggtacttaataataataaaaatgtgtgtggtgctttcacagcttaccatttataaactcctttcacataattaatctaactactcacaaaacaatcttaggcaaccccgtattgttttcatagccattgtacatttaaggaaacagtcacagtagctaagcgactttcccaaggccatgtgccataagggacattgccaggttcaggctggttttcggatctgaagtctcatactcttttcactgcaggatgctgtttcaacacatgaatctatggaaaaatagcaccatttccctctcattaattttacttacttgaattaatctcactggtttatcacaatggacaaagttggaatcactagctggtattctaaatccatattgcattgacaatgaggatgacctcattgccattgtcattgcccttcctgtacacatgaaaacatgaaactacaagtgtgatggtatatgtttaacactcctcttactggggaaaaagaaaaaaaaacaggtagagatagagtcaggctctttctttgcattagttgctaagcagcagccatttcattgtaaaggagacccagttcaagtaatggcataggtattccaagaatagtatttcatttttatagcaattgcatttcaggtctccagaaagcatatgcttctgtagctcagtgatttttaggggaagaaatagccacctcaacatatttgttgaacatatggagaaaattcagtatagctgattacctaataaccagacttccgtgagccgcacacggttcacaggggcagcaggttcaggctacccacagtttgaaggatttggaagtctccagaaaatactgctaacaaacaggtacgttttgaggctgtatttgacattcaccgataccatctcaatgaaatactctgggtaatttagaatgctaagggtattgaaatgacatggtatagaacaaaattttgttgttgcagccaaggggttggatggtgccaagatttcattgtattgagctttcgctggcagctgaaagctcttcaaaatgaagatagaaaatacggtacaagacaagcataattcatggagctcagtttatcagaaggatctgagtgcagaggaggacgtatacttaatgtcccaatgggtatgtgtgtgaaggggcgatgtcaatatacaaagctgtcaggtgctatattttttgattgcactatcactattaattttgaagatggattgatctgtgtgtggaagccttgaagcccttggccctgccttttaaggcataaaaggcatttctgccatctctgttgtaatttgccaaactattgtgaaacttatgtgtatctatacaaatgtattttcttcagagaattgcttcatggagttgttaagggagcaaactttgttgttttctaagagtgtgctgcataatactgctcctcaccattcccctcctcaagatatttgagagaaaatgcccctttccaggagcagctgggatgctgggaagcttgtctttaatttccagtaagttgcccttccatttaaggcaaaatacctcttccaggaactaaaagtcagactcagaagaagtaatacatggatgaattcacaaatggtgaatggttattcccattgtggtgctgggttcattagtatggttggttttagcatctctcgaacaattaatgcctctcatatatgtttcatcatgcacttttacaatgactcaaaacagctttagcaaaagcacttgtgttatacgaacccaatatatagatggtgaaatcaagacaagaaaggctggggaggagagatctaaaacattgacttcccggcctggcataaaacccatagaaatgcaagatcctaagtgtctctcagaaaaagcatatctgggaggtgctcaatgatataccttcaacattaatatgaggtcctacttgccaagaactgtgaagtgctttacatatgtggtttcagttaattcttatcacaactttataaggtagatgcttttactatccatagctttacagaaaaggaaactgaggcacaggataatgaagtaatatgtcagggtgtcaccaccagccaacggtggagccagggtttgaattccagaaccccctgtctagtgcacttaagcattattctgtgctatattcctatatgcatccaaaaccctgtttttccttttaggaatgacctctgtcctcttgtgtgtagccttgaggggctgtacatcaaggtgcctggctctccaccatggtaaccaatgaggcctttggaagctgttgtagggggcttcctctcaccaccctgatagcatcttggggcaagtgtatgacttgagcttggacgaccagactctcttggacttggactcaaaggattgtcaaagggattgccaatttgttcatatccactggcagtgccctggtaggacaattcctgctgctctggttcctgtctttattcaaagcataggttgtgatatggtttggctttgtgtccccacccaaatctcatcttgaattgtactctcataattcccatgtgttgtgggagggacccagtgggaggtaattgaagtatgaggatgcgtctttcccttgatgatctcatgatagtgaataagtctcatgagatctgatggttttatcagggtgagtttccctgcacaagctgtctctttgcctgctgccattcatgtaagacatgatttgttcctccttgactttgccatgattgtgaggtctccccagccatggggaactgtaagtctaataaacctcttctgtaaattgcccagtctcgggtatgtctttaccagcagcatgaaaacaggctaatacagtaaattggtaccaggagtagggtgctgctgaaaagatacctgaaaatgtggaagcgactttggaactgggtaacaggcagaggttgaaacagtttggagggctcagagaagacaggaaaatgtgggaaagtttggaacttcctagagacttgttgaatggctttgacaaaaatgctcatagtggcatgaacaataagatccaggctgaggtggagacaaggaacttgttggaaactggagcaaaggtgactcttgctatgttttagcaaagactggtggcattttgcccctgccctagagatttgtggaacttagaacttgagagagatgatttgtggtatctcataaaagaaatttgtaagcagcaaagcaatcaagaagtaacttggatgctgttaaaggcattcagttttataagggaagctgagcataaaagttcagaaaatttgcagcctgacgatgcaatggaaaagaaaatcccattattcaagctggctgcagaaatttgcataagtaatgaacagctgaatgttaatcaccaagacaatggggaaaatgtctccagggcatgtcagaggtctttatggctgtccctcctatcacaggcccagcggcctaggaggaaaaaatggtttcatgggctgagcccagggacctcttgctctgtgcagactatggacttggtgtcttgtgccccagccactccagccagagctaaaaggggccaaggtatagcttgagctattgcttcagagggttcaagccttaatccttggaaacttccacatggtgttgagcctgcaggtacatggaagtcaagcatcaaagtttgggaacctccaccttgatttcagaggatgtatgggaaatgcctggatgcccaggcagaagttcactacaggggcagggccctcatggagaacctctgctagggcagtgcagaagggaaatgtgaggttagagcccccactcagagtccctcctggggcaccacctattgaagctgtgagaagagggccactgtccttcagaccccagaatggtagttccaccgacagcttgcactgtgcacctggaaaatccacagacactcaatgccagcctgtggaagcagccaggagaggggctataccctgcgaagccacaagggtggagctgcccaagaccatgggaacccatctcttgtatcagcacgacctgaatttgagacatggagtcaaagttgatcattttaagctttaagatttgactgcccggttgaatttcagacttgcatggggcctgttgcccctctgttttggccagtctctcccatttggaatggctgtatttacccaatgtttgtatccccattgtacctaggaagtaactagcttactttggattttacaggctcataggcagaagggacttgctttgtctcaggtgagactttggactgtggacttttgagttaatgctgaaatgagttcagactttggagggactcttgggaaggcacagttggttttgaaatgtgaggacatgagatttggcaggggccagtggtggaatgatatggtttggctctgtgtccccacccaggtctcatcttgaattgtactcccataactcccacatgttgtggaatgagcccgatgggaggtaattgaattatgggatgggtctttcttatgctgttctcataatagtaaataagtctcatgagatatgatggttttataagggggagttttccacacaagctctctctttgcgtgctaccatccatgtaagttgtgactagttcctccttgccgtctgccacgattgtgaggcctccccaaccacgtggaactgtaagtccagtaaacctgtttttcttcccagtcctgggtatgttttatcagcagcatgaaaacggactaatacagatcatcagtctttctattcattgtgaactatccaacatcttcccgataaaattcctttttgtttaagttaactaggtggtttaaaaaaagtctaactgataaaatatcattggcgaatggcccagcagcctctgcttgtgaatgtcctcagtgccagagagctcttggatacattaggggcatagttacgccgttggtcaattctaattgttagagagtttttgttataggaaaaatgaatatattatcatttagtgaatacttaatatgtgttaggaactttcttgcctcctttttgtgattttcttgtttaattctcacaacaactctgagtagttatcactattgtacagatgagaaaactgtctcacacaggggaaataatttaagtcaaagggctataattgatggagtcaattaattggattcagactcagttctaagtcacccaaagcccctatcttttcccattacattctgctgtcttcatgttgagtctgaaactgactccttaatttttttacgtacttaatattacactgtagttctggaggacattcaggataataccctttccttttctgtataacaggtcttcgaatatttgaagtcaaatatcacatgcctcttcagctcttgtttctttagactgcaccatctccactttcattctatcccttatccaaaagtggttttcaatcaacttcacttttctggctctttctaatttgacagcatactgggttatccatggctttcttcataaaaatgcagcactaaactaaaaatgtggtccaaccaaggtcaccattagcacatatggtgcctttgttcaaattagaaacaggtttcaagtctgggatgcatgaatttacaaaaattctcttgcactccagagcacagtcagctccagctaggacctctcctgtggtggggggcactgaggctgggtttctgtccccatctgctcctcctttggattctctggtgcaggatacacctacataccataggcatagctttggggacttcattagcttgctgtggctgttggttgtggatagggattagtatgggtgtggaccaattgctgtgaaactcattccaaaagttgaatatccagactgccagtttaacaaattgctgataatatttccaaagttttgcttaggttgcagccatttcacttaagactggccattttagcttggctaaatgtttacttggcttgtttcctacttatttcagatgccatgcccttttagaatgttccacatccatcccttcctctgtccatccatctgtccctccttccctctctctctcatttttcctagataagaaggggcaagctctctcttaagttctatttactattatctctatttttcagacttatgcctgcatcgtcctccttttgaccctgctgctagtggagaaatgcctgtgaccaactcttccaaaaactggcttaagctatttgagaggttttggcgaactttctttcagtgagttgacacagagccaatgaagaaatccatgtggactttggctaaaactatatttggtggccaagaaaattacttatcttatccagaggacagcattttcctattttaagtacaaaggctatgccgttcaatacagtgggcactaatcctgtggacctaccaaaactaattaagtaaactaaatttgaaatccggttccttctttacactaatcacacattgagtaaataagggccttatgtagctagtagctgtcctgctggacagcacagttacagaacgttttcatcattgtggaaagttctattaaacagcacagcgttgtgggattagggtcaagatactaatttatcaaaattacagaagcctctagatagccatccttgaatgataaccttgaatgatgaagttcttgaattacgaagtctagtttcccaagttaagaagttgtactttcagggtgtaactaggaaggagagagaactgtagacaggaaatgtggggagagtcctctttggtgttccgcatcatccttactgtcctatgttcctctcctcaccacagtggtgactgaggataaggttaaagacagagagtttgtcttctctttcctttgcaaactgcatcttcctctgctttgccagacatattgagcattagatgtaagagaatgtgttctatagcttttgggtggcctagctgttttgccatctaaaatagttcagcttgtggtggctgcacttggaggtagaataaaggttatgggaagagcattattgcttctccagcaattaattcctaaaatttgggtaagaggatcattcaagatgaaggatatgaacttagaatgtggatgtgtagcttcaggttatgtctgtgtcacagaaattgtttcttatgctcttattcttatattattcttaacatcagttcccatcatgttaaataaatatttattgtaaattcacttgggaggcatagaagtaaatgcatggacttatacttttactgtggctcccctgattcctaggggagagaccttaggaagctgtgaaaagagcttcaaggacagagcaaaagccccaggaggatctgtgtgtgtttgtgtggattctatctggtgctttgaagtgccaatattgcacacaagggtgttctaaaaataactcaagtaatgtgcattctctgctgaagggagtgagataattcatgaggatgatgagaaatgaaaaaggaaaaggagagaagctttagaagatgagaaatgaaatacatgcatctcaatggtctctgaggctcttccacgcactgagtgctttctttcaagtcttggtattgaaagctgggaaaaagtacttaaaaaaaagcatcactgggagaacattggggttttctcacctgttttatagcatgaggaatcctctcgataaaaacttacctaagttgtaagaatagatatggaatactaatttgttatatgtgcaaaacactatttcaagcacttggtgaagaatccaaaattgaataataaatgatttttaccttaaagttgtttcaagttgcttataacttattggagaaagaaataaaaaaaatagccactatgtgccaaatactatgtgaagtgctagaaataaaagagaaataagagtctctgttatcaagaatttatggcttggtgatagagagaagcaagacattgacctgtctacaggctgataaatacaaagagagcgggcggtcagcgggcaggataggggagccctgagagagggcacttatgtctgagtggagagtggaggatctgcagcaagtgatggttaaatgtgccttgaaggaggaagagaagataaccaggtggagagaggaattaaaggacttgttcatgtcattgattgaatggagaaaacatactcagggttctaaatggcaaactagaaacagaattttagaacacagtccatttgcttctaatctctcctgaaaagctctcaaagtagatcatttgaatatttgaaggaatgaaaggctttaacaggttccactaacctagaattccacacataagtgagctttactagaagttgtatctattccgtgcttcttagacatcagcagcttgaacaaaggtaaagcagcgggcatagcatgatgcacatgattgtatctggatctgggtgataggaacacaaaagtgggagaggttagttctgtttgggagaagttttcttggagcactgactttaaagagttggtaggatttcaataggaggagatggggacacaaggagggagagtatggaaagcgttccaggcagcaggaattgcatgagaaaggatacagtggtagaaatgtatgacgtatttgtgcagcagtgtgaatggtgatgaagtagtttgggttgagcataaggatagagtggaagataaggcagggaaggttagttaaatgctcattatggaggactttgaatgccatcagaagaatttggattttatagttaatagggagccattggaggtttttgagcctataagtgatgctccatactcagctgtggggaggtccttgttctctctgaagccattgctggttaccctgcatccagagtcactgttatagctgcaagtcattcctgtgcaagtgacacctccaccctgccatgcctccagacactccagtatggacaataacttttctttctcctctagcacatgaagaaggaagggggacccctgttctgtctgcaggggccatggtggctgagaaccaggcttttctcatgccttaggaataataggaagtagggtgagtttctagtctcaagctttgggaaagattgagtaaggagaatttgagatgtccacagagtttgaacgtgaaactcatttttacataaaggaatataacggatggtgtttagatttgatgccattcattattactttagcaaaataacattgtcctaagttctatacaggtaaatacacagaaaattctggaacgtggcttgcctctgagctaggcactttccctctaaactgtttggataaactcgcctgcccccgccgcccccttccccctgccagatcacatcactggactttaaaaaacaaaaatgaagtggatagattttttcccccagattccaatacctagaaatcattgaacaaattaataggagaaatgtgtgttctgaatttattagaaaacagtagtcaagcagcttaaacattgttcactgtcagagggctgtgttactgtctaacactgttacatgaatagagattggctggaccagttaatagaaatacagataattttgcagctaagaaagatttgcctttagctgcaaaccacacactcttttcagacataatcttcagtaaatggagtgcaacattgtggaggaaagtcagtgtgaccaattctgactgctggctttcaggcctgttccagaaggattaggacgatggccggcttattctctgcattatgtacatgcattgcaatgcctgagagctggctcacgctctgcattttggagaaatcacctttcttctcatataatggaaaatagagaaacatagaaaagagagcaactttgagatcaaagtattattaacaggcaggaaaaaatagagtcttggtttaaggccacccagagtgatgaacagtcttggacccacaggcccacatgacctgcctgacttggagatgcaacctacaaactgatttcatgattaagaagttaaaaacttgatttttcaactaaatccaattgttaataatgtggagactactaagcaagttcataattctagtcaacaatactaaattcaaagatgtaaaacttcatatttttttcttgttacttaatagaggcagttttattttaaatgaaaaaaagtgtgtcccacaattttctttcttgatagccttcattcaaaaaggtttacttttcactgccctagattgacaaagacataaacaaattcagaaaacaagtctgttactgtgtcaccgtccatccatgttagaaaatactactgcctaccactgagtgtgtgtgtgtgtatgtgtgtgagtgtatgtgtatgtgtgtgtgtatgtgtgtgtgtgagtgtgtgtatgtgtgtgagtgcgtgtgaatgtgtgtgtgtgagagtgtgtgtgtgtctgtgtgttggggggtgcatgcctgtgtaaatgggcgtttttcatgtcacttgctaatcctcagataggtctcattctctgagccccaatgtcctcatctgaaaaatgaggctaatgatacctatttcccatcatggctgttggtgctgaatggaataatgtgtgcacattgtaaattttatagccctacagccatgcaagatattgctgtcaccaccaccatgcttcatcacatgtatgccgtctgccatgggataacgtgaagacattacaaacttcttagggtaatgaaatttcttaacaccagctctggagcctaggtttataaatggtacagattgttttggagacgtgcaaatgcagttatgtgagggttggccagcttttgggtttcgttgttaaatataatatttatttaaccaaagtaatatataagcaagacttaaggcatagctcatagttagaactacagagctttattgtggaagacagtgtggcaattcctcaaagaaataccatgcaatccagcaatcccattactgggcatatactcagagaaatataaatcattctattatgaagacacatgcatacatatgttcactgaagcactgttcacaatagcaaagacatggaatcaacctaaatccccataaatgatagactggataaagaacatgtggtgcatatacaccatggagtactatgcagccataaaaagggatgagatcgtgttctttgcaggcatatggatgaagctggaggccattatccttagcaaactaacacaggaacagaaaaccaaatactgcatgctctcacttataactgggagctaaatgatgaaaacacatggacatacagagggaagtaacacacactggggccttttggagggtggaggcggggaggagggagaggatcaggaaaaatagtgggcactaggcttaatacctgggtgagaaaataatctgtacaaccaaccgcttgtgtaacaaacctgcacatgcacccctgaacttaaaagtgaaaaagaatgacagggctttaaataaaacccaataattccattttcttttctttttcttttttttttttttgagatggagtctcactctgtcccccaggctggagtgcagtggcacaatcttggctcactgcaatctctatttccaaggttcaagtgattctcctgcctcagcctcccgagtagttgggattacagacatgtgccaccatgcccagctaattttgtatttttagtagagacggggtttctccatgttgctcaggctggtctcgaactcctgacctcaggttatccacccgcctcggcttcccaaagtgctgggattataggcgtgagccgctgcacctggccaatagttccattttcaaagtctctcccatactttcatttcttcagcgttgttatgatatattaactgttttttctgattctgcatttgtatttatacatcacatgctactaaccactaagtgctgtttggtaattttttttaactgtcccttctgaggtgaggatttagtagttctctttttatcccacccttatgtgtttcttcttccatccttccaatacatattacaattttatttaaatcattaataaatgcttatattatcatgactttgtaaatcttatccatagccgagtcacccagtgtgctatgaaaaccttttctttcttgtattattggtcttattttaaaacttattctcatatggacttactcatgattcttccacaaagttcttaacaagacaataaatgttttattgcatttaattgtatcaaataatgagtcagtttcatggtttttcttgtagacagcccttctggttccttccatcatcttgccctgtctgaactggtttttacatagcttccgttcttctccaatactttgacatccttctgccattttcctcaggcggatcctctgacttccagatttcctaagcgtcacacctccttttctgacttatgccttgtctgatggaacaaacaattttaagaaggagaagaacaacaccagcctcctcaatgaggttttttccccaggaactctcttcctatttttagatgaccaagttgaaaaagtttttcaggatgtgaaacatccgcaggagcttctttgcagagggtacatgggagtcagatatttagagtccttttatgtctgagaatatatatacattttaccttcacacttgactgagagcttttcaggttatggagttctagatgggaaataattttacctcagaaatgtgaaggcatatctctgttgctgctgtgcttacagagtcacagctgagaaaaattccattctaattctcaataactttacatctttttctttctttctggtttatttttaacatttttccctttatatacattgtttaggaatttcaaaactggtgtactttgtataggtacatatattcatgggttttgggacctttttagatctcttcgctctaaaaacttttaatgccaagaaattgtctggtattttttttttttgggttgggggagaatattttcctcctccccaatttaccagttgcttttttcctggaatttatattaaatagccaatgtatctactgaactattcctctgattttttttttctattaaagttctcctttaccttttattcttctttctgggagatttcctcatttgtttgccatcctttcactggatttttaaattttttgtgatcatactttttatttctatgagctctttcttgttttctgaggttcctttttgttttattttatttttgttacatagctttaatatcttcttttattcattgagggtattaataataatttttggatgttgtattcaccctacattaattctgttttcttcaaaaattttcttctcttcatgctgatagcttctctttacattggaggctgttcaaatgtctgatgatccagtaatatttaagagagaggccccaaaaggctgaatggaagctcggtgtgcatgtctgtgacttatgcttcaccgtggggtcctggtttgttttattgaaaaaaccctaaactttagcattttctgtttagttttctcagagaagaatcctccactttccttaagagttctacatctatcttttttctgaggctgaataataataataattattattattttggagacagagtcttgctctgtcccccaggctggagtgcaggggagtgatctcggctcactgcaaccttcacctcctgggttcaagtgattctcctgcctcagcctcctgagtagctgggattacaggcatgtgccaccacgcctgactaatttttgtatttttagtagagacagggtttcgccatgttggccaggctggtctcgaactcctgacctcaggtgatccaaccgcctcagcctcccaaagtgctgggattacaggtgtcagccaccgctctgtgccctgaggctgaattattattattcagtggataggctttcatttgctctctctgcttttagtagagggtctcacactcaaacccagctgcggttgtattttctagttctctctggtgtagcttttttagaaactaaatctccagtctcatagctgtgtgtggcacatgggagtagtcagaggtcctcagaatgggggtctaattactctctagaaaggattcttcctgtttttggctcctcctcacaccctcaccttcagcactacctgatgcctctagtttctgagcttttctggaactctgtggggtgaccccacctctttttgtttgctgcttccttcttaacacatttaatttctggatttgtctactctgcctgcattcagctcacttcgcagcttccaaaaaggttgtcatctgtctcttttattgtcatctcctgttttctttcttttctttctttcttttttttttttctgatgtatgtcttttatttccttgactttcatcttactgggagtttctggagagagctgggctaaaagtatgtgtccagctcaccatagtgacctggaagttgcttattctgttttgctttacaacaatagaaaagttaacatattcgtgtatttcttcagaatttttaaacaatgttgttcttagttcctcttacttctaaaggacttttaagagtttttttaggtatttcatctttcccaattctctgtctgtgaccaggggtgaattggtaattttacatctttttttcaagcattccaagtagaggaggcaccccctgtgacttccagtggcattctgcagcaattaagtcgcattcattcagctcatcatttaccttgcagccatcaactcctttcaaaatatccctttgattgtcagtaactacggacgtgaagctgtgggtttcttccaggaacaatgctcttctctgtagcctgtgttctcccagttttctgggaagccctgagacttgtcattctcctagcagctcagatgtcattctcctcaaacacccagatttcatttagcaccaacgaggtgctcagtctgggatttctgagggactgtcactggggagaggctgttgctaatgaggtgcaaattggcagcagctggggaggagctgctctccccctctagggctgggccccaggggaggaggggagggttgctctgacattttcagaggaggttggtgaggggccgaaactagagactcctcaccctttagcaaggcctgatgccggctgggggaggcccttgcgtcttgctgagaggctggtctggtctcacacagccccacctccagagttgctgccagctggctaatttcttggctgccttttctggctggctttacttgcaagcaggagaggccatgatcagacacggggttttcccagacattggagagacagctaagaagacccacagcccccagagacactgtccttgggattggtgttctagaaggttatgaggttggggtttggtggtggaagaggggttactgtagcaactgttgaaacaagagagcccatccatctccccccagcatttgcccgcctgttttacatggaagagcctcttatgcattaaactgttcacctgagtgctcccaccagctgcgcttctctgcttctgcaaggtgcagggctctcacagccattttcatctgcaagggtctctgccagagctgtggcagagttttctgtgggatgaatcagaaactatgttctgatgaagagaaaatggagggcagtgggtggatgtggaatgtcagtaggtagttaagtggctttttgtctcctggtctgtctgacaaagtgtgctgattggggcctcctgctgtgagattcatttgggtgatcttgagcaaatctcttaatttctctgactttagcatccttcatcttttttctctgtatctcattttttctaactttttaaggagcacactgagtgctagcctagatgcaaggatgagtgaaatgaataaaatgcagtccctgtcctcacagaactcaccttctggtggaagaaggtggacatatgaataacatagacttacacatgatgagaaatgcactatgtcgaaggcatgcaagaagtgtcatgggatgatgaaggaaggggcaacgatgctctctgagagggtcagagaatgccctacagcggtagtgacatttgaactagttgttgaagactgattctgtagggggacaaggaatagtaatggaggtttgaaaaaacatggtgtattctagaaaagacaagttgtttgttgacactagcatgcatgtgcaggatgaactggcaggctgtggggctggcagtggactaggtcagatgatgtagagtgcttgccatacaatgagtttggatctcaccttcttggggatggggagttgtgctgggctgtgcagagaaccatgatcaaatatttgctaaatgagtaggctgggccatatgatcatttaagatcccttgtagtctggctgggcgcggtggctcacgcctgtaatcccagcactttgggaggctgagacgggcagatcacaaggtcaggagatcaagaccatcctggctaacacggtgaaaccccgtctctactaaaaatacaaaaaattagctgggcgtggtggcgggcgcctgtattcccagctactcaggaggatgaggcaggaaatggcatgaacctgggaggtggagcttgcggtgagccgagatggcgccactgcactccagcctgggcgacagagcgagactctgtctcaaaaaaaaaaaaaaaattcccttgtagtctgaagttcttggattttctgtgtgggtacaaagctgtgggtctgggaacacagcttcgttgaggagtgttatctggtgtaacgtctgtgagtaggtgtttaaatgtgggctgtactcaatagctatattaagaggtagcatcaagcagggagtggagcaccaggttcccagttaagctggagtttaaatatgcaagtcttgtttcagcctttgatcgtgcttttgaccatggctaaagcacttaatctgtcgaagagccttaggatcatcacctgtaaaatggaaatttccacttctgtgcagttgggagggctttttgtagaagctttatttgacaatgatttttctgttgcttaggtcatttgaggggaaaaacattattttaaagtttaacgttatttctaattgtcttaggaactatcaacatacatggaaatagaaattatctgtgtattgatttgtgtgtaatacacttatgctgagtttttcctgagtttttgatccatagatagataggaatctggtgggagttggaaatatgggcaaaaaatggtgggagggccaggtgcggtggctcacgcctgtaatcccagcactttgggaggctgaggcaggtggatcacctgaggtctggagttcaagaccagctgaccaacatggtgaaaccccgtcactaccaaaaatacaaaaaattagccgggcatggtggcgcatgcctataatcccagctacttgggaggctgaggtaggagaatcccagctacttgggaggcttgaacctgggagtcggaggttgcagtgagctgagattgcgccatgcactccagcctgggcaaaaatagcaaaactccgtctcaagaaacaaacaaaaaaattgtgggagatgggaatatgtgccaaaatggtgtgacaggagctcagttcatgaatgtacagatacacaaagcttaatggtccacttgagccatctgaggagtgcacttgtgtggttgatgacacatttctggactcctaaatattagtttatgcttattgaacttttgacctagaggattattatggaatggaatcacatgatgagcagtttggaccaacttcagagcaattctaaatctctgagttgcttgtttgctttcgggttgggtgtatttccttcaattttgtcttagaaggtttttagcttggtagcctgccatcttctcaaaatattcccagttagctcatctttgtaaccaaatggaataaacggtttctatatgattctcatgctgtaagacaatgtcattgatagtgtgtagccaagtaatggtgaagccaataagaatattcaaaatatggagcaactggtactggttgtggatgactgataagttcgtactagtacatagtgtctgatgttagcccctgctgtggctaagaaggcctgggacacatatgcataggaataaaacagatgtggcatattaaagactgggtaagaacgggtaagaaaggcatgggaaggtaccttttagcattggcctcactcagatacagtttgcattctctacattcataggactcttatcattgaaataatccactggtatctgcagattgattttccagtaggagtgatggtcagtgtgacctaccaaatatcctcacatctggtctgcaagggctttattaatcactagtgaaattatgaccatggtctgtgactataggactgtattgggggaaggtgagtcacaattcgacagcaacagtctttacttgttctatacacataagaaaagtactcattgaagagtatgttttcctcattctgaactcaaataaacactttgttattattgaatgtacgtcacttatcacctttagtattatttgagagttataggtatatatatcttgtggcctctaaataattgtaaaatcctgagggcaaagtagttaattcattcaataaatatttattaagcaccgagtatgtgtcaagcacctactgtgtgttatagacactgaatacaaatgaattagacaatgagacactttgaactgatgacactttgaatcgaattgatgaaaggatgatggggaattgttcagctgaagaggggtgggaagggtcttctacaaaggtcaagaggtcagcataagcacaggtatggccatgggaaatgacttggctgattaggaaataaaaagcaagttggtaaccgagaaatataacatgatcagttgggtcaagaagtgagacgagaatgataacagtgtttatcacttaaattgtcattttagtgttgctattcagtgagggagattttgtcataactcctgggatgctactggcatctagtggttagaggtcaggctgctgataaacatcctgcaatgcacaggatggcccctcacaacaaagaactctctggtccaaagtgtcattagtgccaaggtcgagactcccttcttcggatctttttacatttggattgcatcattcaggtcttaactcaaaagttccttctttagcagcttccttactcaccccctattgtcatataaaaatttgcctctccttctctgtcactctctattacaaaacaatgttttttgtctttataccttttgataccatctaatgttatattatgcatttgtttatttttattatctgtctctcctcttttaaaatataagcaccacaaggtctttgattggttcactgctgtatctctagagcttagaatagtgtgaggcacattggaaaatgcatggaaaagttcaatatatgggtgttctgagtggaagaatgtggtaagttggacatagactctgagttcctggaataatcacagtagttaacattcatttttaccattgatactaggccctgttccaagcattttgcatgtattaactcaatccccaaaacaacctcagggggtaggtatctgattatttccattctacatatgaaccaactgagaaagagagttattttcccaagatgtacatctagcaaggggcagtgttcaagaggtaaattgcccaaggtgatcttgtgtgtttattcacacatgctttttgtggctattagtctgagaatgctatggggagttgggggttaagtgacttgggaattggatttgaggggtttcaaacaatgcatccaaaacatagatggacgggaaatataatgaactaaatgttggtcatatcgcactcaagggacctgtgagccatcaaggtgaaggctaacatgaaaaggattctctcattcaagagaatggtttcagatgaagtgtggaatttgtaatgggaactgaaatcaggagagcagacttgattatttagggacaggttgatgatgggaacagacccagggaacaccctgacatcacaaatatataagggcctataatataatataaaagggtacccataatgaaaatagaaagagcagtagagtcacatttcaagttctgctttgggcacaagcttctatctaaagtctcttttctcccttgtagaactaatcttttctctctctgttctacctacagtattttatattttcaatgtattaagtgacataagagaggtgttagataatagctagtactacgagtgtcacctaagcccgtaaacttccacaggcctacatcttcatctttgttcatatccatgtccctagcgtgaacatccatagctgacatctagtagtctttcaatattaataaatagatgatgttgaatatgtgaattagaaaatgtttattgggagaataaatgtatcatttcattagaaaatttgtttgtaacccacatcaaaagaagaagaagaaatgtgtagatcagtgaacttttctgttgttttttctatttcaaaatacactcaacccccgacttcttaggcaagccatttagctaatttctgaaagggagcagctaatccagcaccaaagcctgtgcagaagctgggccagcaactcaaataagatgattttctgagaatgaccagccatgttggcttcacatatggaagacgagtttctgaattctccctcctctcgggtggcacatggtgtcttctctttctagctgctccaggacgaaggaggggggatgaatttttaaaagattcaggggaaggaattcaggttctagaaatatccaagaaaagtaataataaaaccagtaattctacttttatgagccaaaggtcaatattatttagtttttttttttattttttcctgggaagaaaaaagagagctgatcttttgggtaattattgatatttccatgttttcagcaggattcaagttagccaaggagaagcataatctttcattatccaaactggagatgtcttgagtaatccagtggcaggaattgctgctgaaggagtgtattttcttttagttcatctgcctttttgacctaaaaccagcgtaccatttttttgttttaaaatatacgtgatatacatacatggtttgtctacctctggaatatttataggctcatattcctttctatacttgttctctagcgggggtgcttataacatttaataatacttacagagtctgtttcttagtctcatttcaaacctcaatgtttgtgccaggttgtttggagcagctcaagtctctgaggttattttcccaagatgtatatctagcaaggggcagtgttcaagaggtataatacccaaggtgatcttgtgtatttattcacacatgccctttgtggctactagtctgagaatgctatggggagtgggggattaggggccttgggaattggatttgaggggtttcaaacaatgcaccccaaaacatagatgggtgggaaaaataatgaactaaatgttggtcatttagtccattattagcctcagagaagctagaagctcttaaaatattcaagagtatgagagattcaacccttcgaagagaagaggagttgatgatggaatttgaatcgttttttggcatttctttactttataagaacacatgacggtgttccattccagtgcagaggagctgttcttaactcttaaatggagagccctgctgttagagaaaaggcttcgtgaaggctcctgtgtgtggggtcatcctactctccgggtggcttcctcctcccattcctcaccttcatccatcactgtacttgcacatccatcctttcattctgctctggagatcctttggaaagggagaatagaaaggacaaaccattgatcgatagaggcagtaaagctgtcctttggggtttcacaatatgtcctgtactatttttgtgtttagcaaaaatccattttgcctcattatgagcctgttttcccttgggctttcacttctgagattatttcaagggaaattatgtctatatattagtctcatttgcccacatctcactcaataactattagcgttattagatatcctgaaccaggaagctgcattttgccagcactaaatgcagcttgaaattcaaagattcaatttggagaaaaatcactacatttgagtgggttaaaatcttgccaaaaatgcatttttccatctgtctcatggcaaaagctcttttaagatttgaaatttatagctaaggacttccagtcatctttgcaaagtggtctggaactagagaatatgataagactggaggtacttgggagcattcctctgaggtggaggaaggagttgacatcagtttctttctgttttaagtttattgaatggtggacatcctcagtatcaaatgctgtgaagtcagcaccagcacactcaacacccaagggggtggttcacaaagtgcatccatagccctgccacgcccagtgtgacatgactgaaagtgatgatcatggtcactttcattctttcttcctgacctgaatctgcctgggaatatgaacattgggttcatccttactgacctactctaatacatacaaagaaggctgtcagcttgccaaacccaaacaagaaatcagaggccaagtcaggagttggttttcagcctcttcactgatgtgacccaggagaagtgatgctcccgagagtgactgtctgcactttgtcttagcagtgctgatgagaccagtgagcactagcaccatcaccagtgagaactgtacctggtccccctaagtctgttcctgtgtgggtggaccctgcctcttagggttgttcctggtctatttactttctttaaacagaggaactcccttccttctggttgcatatcaacttgtgtctctggcatactttctcagggtcattgtttggggctctgctctgttgacttcttgaccatttctgctgttctcgcaactgatgctttctgtacttcggtgcattgtgcagcaatgatttgagaggttcagtcttctctcttacacatataagacatcctgtattgttattgcctcaaatatgactatatacctaattagtatcacacaaaggcgcaacatagcttagtgagtagaacacaggctttaaaagtcaaccttcttgggactaaatatttaccactttccaggtctgtggagtcaggcaagtgatttaaaatctcttggcctcaatatccttctttgtaaaatagagatattagtatagtctgtcacatagggttattgtgagtgatgattaaatgaattaatatatggaaagggcttggaatactgccatttatgcattaagatatcaaattttagttacagtgatgatgctaggggctcagcataaggacctcaaaattgcgcctgaaagggcagggtttctttatcagtcatcctgccttggcaccttactgtcctctaagactctagggaaatataaaacaaaactaattaagaggttgagtgtaagctttgctacagttaaatgcctcccgtctttataggatatagaacctagatgatgatgatgatgatagtcaacatttattgagcaattaccatgtaccaggcctgtcctaagccaaatatgtaatcatatttattcctcataaaaaccatatgatgagaagcttatctctgttttttagttgaggaaactgcaactcaaagacttggagctagatttacacccaggtctaactatgaataatcattatgaactttctcctttacactagactggttctcctcaaaacaggaagcccgagggaatggaaagtgaagggcatctccctgggatctagtcctttgagatgttggactttgagcaagctacgcaacttccccaaagttcagaattttaatctgtaaactaagataacagctatttcacaggttgttgtgagggagacaaaacaagctaaaatatataacaaagcaggcaaagatgtatacttcaagagtcactacctacctaggctggggcaattagaaattctaaatatatgtacataagtatttagcaaagttatatacttcaagagtcactacctacctaggctggggcaattagaaattctaaatatatgtacataagtatttagcacagatgataaaggatgggcaattcattctgagattaggctgtagttcttcttcagtatggaatcagagctcaattatctttaaccattgtgatttggggaatagttttggtcctaattgggtgtacatgatgcctttgtcttcagaagtctgatcaatcaggggatgctgcaccacaacccttatactacgttttagtgtttctcaatgtcaagagacttctgtaacagatttcagttctttctgatggctttgaaaaatgctagtaattctctgtctttctaatggagtattttgtgtttgttgtctcctgaggtcagaaaattactttggggaagttgacttttgtgagctgtgagtatggtgtgtgtgtgtgtgtgtgtgtgtgtgtgtgtgtgtgagagagagagagagagagagggagagagagagagagagaaagagagacagacagagagaattaaatctgtattgttagttcttggttagaatagagcttaatggatcttcccatttgtgaaaaccccataactcttcctgtgtaatatcattaaagagcctcctgacagcagtaggtaaggagtagctctggggtgttactttttaatcactttaagcccattttcgtgtgttattacagaaccatccctcttctttatcactgcatcttccaatagcacaccattgctccaggaccagaattcagcaacaattttagtttttctgttgacaataaatatgttagcctgactgatcaaggctgatgcatgagcttgatctttgggattatttccattctacatctgagtacatacgtagaatgtactacataagatagagccagttctgccaactgtctgtggttgtcataggtatgcttcatcaaatattctggcgcatggtaggtgtacttcctggctttgtatatttgagtggggccacctaaccagttctggacaatatgttgtgattggaagtgatgtgtatcacttgtgggatggaatgtttatttgccacaaataaataactaaaaaaaaaacttctccagggatctcttttccttctgccacagttacatcttcttaattgtcagcctgggtccagaaagccccagccaattctttatagacaggcagtgctagatagacataaactgctgttattttaacaagtgagatatgtcttgtgttcctacagtataacctacttcatctcgactaacacaatgatccatagtcagggacatgtgctttttggtgagcagtcaaggtgtggccttgatgtcccttgttttctctgctttgcctttactgtgaagtctgtctagcagtctgagaaaatttaagaccctaataatagatgtcttggggcaatgaaacttagtacctttcatagtttcgttttcttttccttaatttttttttctgtatttccttgtaccagccattaatgttttgcctgtcacatagcagccactcaataagtgagtgatgaatgaatttgtacagaaatccattgattggtagggaacaattagcattagcattatagaagtgttttgattctccctgaacttattgttgtcaattactcttttactcaattcaaccctaagtcatactattttctatttccagggctgccctgatgagaggtagctttggcctatcaataggtgcattggcctctctgagacagcagcacaggggacctcagccttctactgcctacactcagcaaacagaaatatatgaggctcttggctgtgaaagcagaagaacctcttactcctgcaccattttatggccaaggccgtagcaaactgctgactccagagaattttttcacctttttttttaacttatgtggatttttttttttccaactgggttttgcgctgttgctcaggctagagtgcagtggtgcgatcatggctcactgcagcctcgacctcctcagctcaagttatcctctcacctcagcctcttgagtagctggaaccacaggcacacatcctcatgcctggctaatttttgtattttttatagagacagggttttgccatgttgcccaggctggtcttgaactgagcttaagcaatctgccttccttggcgtccaagaatgctgggattacaggcatgagccacagcacctggcttgtagttttaactaaactaaaacttctctggccctggagaatttccctttctctaaacttacgcatatcaggacatgcctaaagtgtctattttatgataaagtgatgagaaggaaagagacaagggttaggacagcccgagactgcaggctgatacctggtggcaaaatactagtctcttaaacactaggcacatatcctgcccaattagagatctccctggaatcaattccttctctccattcctcctgtcattgcttcagatcaggctttcaaatctgttgattacactattaaattagaactgtgcccgagacatcaatgagtatgagctattattatctttattattgctattctgtagcctcctgttcccgtctccagtttttcttcatttcaatccatactgtgtatcttttaaaaatagatcagattctgtcatttccctgtttataaagctctcttgcctccactgcctagaggataaagccctaaagtctgagctcattgtacctcttcagccatgttctcactcatgttagctgtatctgaatcatcaaggaagcttgtcaaactctctgtgccccaattcttttctccaagagattctgggaagcttttgggtgatagggaagggagatatgacacattcctgggggggtgtggagtttgagaaagctcccccagtgattctgaggccacttcttccttacttagccatccccacgtccacagctagaacctctaatgttgccatgtgtaatgttggttccagccacgccaggcttctggagttccttagtctcaccatgatctttgacatcctcatggtttgcaggtgtattctcatcactctttatgttcttcttcctttttctgctcgggtctctcccatggttttttaatatttcatttaaatgttagttcttaggcctttcctgatattcccagatgactgtctgtctcctctcatggcatgttgcattgacctacattattatccttgttatattgcagcctcattatttgtgcctgctactgcctggacagtgggggctaggggaggcaggtgcctggttctgtaatcttctgccagatttgaaccgagtttggtgcatagcaggcacttaatgagaagcacactttatgaggcagcactgtgtgatggttgagtctgggctttggagtcttccctcttggggaccttgtgacaagtaaatgaaatactgtaaacaaggcacttagcctagtgtctggctcttaataaatgcacaataaatggcacctaccatttttttgaaataaatattttatgattaagtctgtatttataagattaataagtctctcatttatatactaatttccaggatgcatagatttttcatccagatagtttatataccagcaaaatgggaaataacaacacctgacttttttactggaaaaatattggttgctgtggagattatctactacgttgtccttactctcaaagagattacagttaaaacacaccaatatcaacatgaacaactgggaaatagcaatgagccaatcacagcagagatcttaattggcttcataacaaagtgtggtctgtaagccaatgggaatgaaaggagaatcaataaatcccaagagacgagagttgcctttttgggggacacagtcatacacacacctatattcgctctggaggaaaaatggtggcaagagggtgtatgacttgatgagtgggggagacatggtcaaggggacaggcaggcaggtgagagtctgggctgactctgggttggtcctagtgttagggccatgccactcaaagtgtgtttatggacagtagcagcagcagcggcacctgggagcctgctggaaatgcagactctcaggctggccccattattttttccagtttctagtttcagggcttgcctgatgggagacagccttggcctatcaatagctgcagtggcttctctgaaagagcagcacagagaacacggatggactataatctgcattttaacagggtccccagatgatttgtgagcacgtgaaagtttgagaagtgctggcccagggatgtgcagtgacttggatgggccctatttagcgctctcctgtgagctgctggaacaaaatagagggtacttaaaagcatatgcacttccactgtaggcttaaaactgcagaaacgaggtagctcgtgcataaatgtaataattctttgttccaaatgtacctagatgtcattatgacaaaacataaaatccatttggaactgttactgattcctagcagctttttgccattagacattttccaggcatccaaacctaaaataacatggatcttgggtgaaggtttttgaaatgccttatattaaaaagtccttgtatttgaaaaccagtaaagaagtatttgggaaccattatgcgttctttcagtactgcatatgcagaatattttgggtcttcacagatagacttgtgacgcaaaaataaaataaactatctcgtaatcacacagaacagatcactgacatatatggcaagctgttgcagtgacccaggattaaaagtttagcatagttcttaaatgtgtgcctcatactgcatcagctccttatttcgagggctcatagtggatgaagcaattacctggatggccctgtttcttgccctttccctggtcttctgccacgtaggttggtggtgatggttgggaaatgggggtggcaaaagtgtcctttatggattttatacagttcttattccactttttggtgggtcactggcctggttgctgtcatgcatggtggggaggtgggcagatgagaagcccagctctattgccaatcttagtcctgagcatagatgcagaggttcaggccgggtgcggtggctcatgcctgtaatcccagcactttgggaggccgaggcgggcagatcacgaagtcaggagatcgagaccatcctggctaacacggtgaaaccccatctctattaaaaatacaaaaaattagccgggcgtgttggcaggtgcctgtactcccaggtactcaggaggatgaggcaggagaatggcgtgaacccaggaggcggagcttgcagtgagccaagatcgcaccactgcacttcagcctgggtgacagagcaagactctgtctcagaaaaaaaaaagaagcaaaggttcagtttctgatattttgtttccaatcatgtggcattgacactggaatcagctagacctgcattcaaatcctgactccatcacttaagctgttgtgtaactttgggctggttacctcactaacctctctcagacctctctcagtttcttcatttgcaaagtggggaataacaacacctgatttagatgcaacgcaagttgcaagtcattcagcatttactcatgatcagtgagagtcactgatatctccgtttttctcgtttcccctgccttctaaagccatcaggtggggaccttcatctaccaaacagacgctaaagaaggatgggcacggtgagtggaaaaaggaggttgaagagttgtttttgctcccaagtgtttcataatgaatgaggttaagaagagaaaataaaataccctgtccccttgctcttatctggctcaaatacagcctgtattatttagcgtcaaagaaattatcttctcatgctttgttcagaccactccaactcatggccacagttctgacactggcttagccttggctgacctgtatgaagtcaaataagttccttcacctttcttaacctcagtttctttatcttgaaaatgagagcatgaacctttgtgatctctaaggtatttccaattattcagttctaagagattatgcccatctgagaacaagtggaattaatgttatgaagggtgccttcaaaggagaaatgcttgagatgggagcaagaatagatgcaaatcatgcctgtttttgagctcgggaaagctttcatatggcagggttttatattcatctgcctggttgcatgcttatgcactgcccttgtttggccttgaagaacatggttttttccattgtttctggtggagataatcacaatgactatgtcacgtctgcttgggaaaccaaccacggctgctgatctttggatccttgtctgggaagctctcaagccagtagtagtttgcctcaaccattcaggggtagctcctctctggccaggaccttgttatgccttccctgcagacagcgtaagggatggtaggcattctttctccattcgctccctcgccagaatcagcactggtgattgtcaggcaggtaaggagaacactgtcatgctcaatggagatgtcagactaatgtgagtcagctctagcttccctcaagcacagctggaagacaaagaaacagatttactggagatgtgcacaaactagtgcctattatgttaaaaaacataaataaaacgagggagaaggcatacagagagaaattatcttttaaaaacatcttggcaaaatagcactcaatacacatcagtacaatagtggagtcatccatgtgtgtcaacctgtagttcttaatgacagggatgtataaacaagtaggtaataagcagcccagctgcttctggggtttctcttaacttactttctttgaaaatgagttggtggaaatacagctgaaaacacagactcagaaaatgaatgagtcatttgagttgaacataaaaaaggagacctggatgaggatttagagagaagatccattcaactccgtaagcctacaaagtaagattagactaaatagatagaaattttattctactcccaaaggataaacatcattttccatttctttttgtagacaggcaaagctctgccgtgaatcatggttttaatgcagacttctttacagaaaaagaaatatatccatttcctttcctttcctgtgcccatccaagcttgttatcgagaggagtgcctctgtaccctctgtcagctagaatcaatgttaaacactgagcacacaaacaccaaaaacgtttacatctttttatttttcttcaaagacttcaaaactgccttgcctttgttcttacagataatttttaatagctggtctagttgtatttatgttaaatgggggcacaggggtcaaagagacttattaaaaggacggaatgagtgaaggacttctcttctgacgaatgaacagggcatcgagccaataattaaatcttattgaagcagagaaaactagcctatatttatatgcctagaatgttctgagtgctttcttgtaggatctcttttcaataattgtaaagtggtaattttcttcattttcctgaagagaaaactgatgctcagagaggctaaataactgcacaagctcacatatccagtagagagggggaagagatggaagtccaaagtcaatgccacactgcttcctatttaacaatatcaaactcaggcatcaagctcctgctctatgccaggcatttgctgggtactggagatgtgaagagagaatggtctaagcgcttactgttgagtgcttcccaaagcatgtgctcagtgtttgctggttgtcacttactctcacaaaggagctccctcagtctagcctcagagaagataattgtgcaaagtgggcatgcttgttagcttatattttcagaaaatgaaaaacgcatgcccggactatttacctcacgaatctaagatgatatagtgagcgggtgttagggatgggacctgggccaaatccaaataggttatgcatttagccttcaaatccttgctgtgttccaatgtccgtttaaagcttgttaaattctccaggatatttgatacacacttacttaatatgtttcatttgcagaaatggttgtattttaattgaagctcctggaagtgaaactgcgcttttgtaagaaattcttaagtaagtggaggaaaacattgtgctcaggaaaagttttccagagacttcaaaatgacatgaaatgttaaggccgtgtccagtcaagatgcctgtatataaatgtgaaaggtgcattgtcttagtagacatcataaagaaaaatagcatcaaaaagaaagaaaatatcatacagctaaacaggtgatctaaataatatacataacttagaaaatgtgaaatcagtggataggattcatatgaggatctttttaacatgtttcctatatcagaatcaaaaatacagttccagtcacattactttcttgtttgaaaacattttttggctctttgttactgacctgtaatttgtctaaactgtatactggaatgtaaggcctctgaagagtgatcacagccccctttttcaaacttacctccatcttctctacaacccagcaaaactggtctcctcactgtgtcctgaatttccttgttttgtctcacctgcgttttctctcagcttgcacccctccatcccttctctccaaatgtagaaacctttaatcgctcacttgcttctccaggatgcatttatggatctttccttaatgcaagcgacctgccctggcctttcctctggattcccttttgtagtgttaatatttgcatagtgattcttattttgctttgctttgtattcattatttttagtgcttgtcttattttacctcctaaactataattttcttgagagtttttctcatctaatttttttgtctttgtagcatttggcatagtgcttcatgaattgtattaatgaacatcagtaggtattagttaaataaaattcaattaaataaaggccagagtaagatgtgcagttggaacagccaggtgttagattttctctgactcagagatgaacagcttcccagcaagggaagaagttcgaggagagaggccggtaggagaggaagccacttctataatttggcactaataagaaatttactctggaaaatctcagtttttcacaaaccatctttcacttttctcatgatggagaatatccctttattagtcaggaccttctgcaaattaatgggcaagtctcatgtcctcataaagccataaccctatttatgacattacaattggttacttagtgataattataatgtcacaaatagaggattattatgatttgaggtgcaaaacagctgtaacaaagaaagtcagcaataagtggacatgatgtagtaaatttgcagctggaaaagaataattcccagaaagatattaaaaatcattttaatagtttttggggaacaggtggttttaggttacatggatacattcttgagtagcgatttctgagattttggtgcacctgtcacccaagcagtgtacactgtacacaatgtgtagtcttttatccctcatccacctcccacccttccctctgagtccccaaagttcatatattatccttatgtctttgcctcctcatagcttagcttccacttagagaacatacagtatttggttttccaatcctgagttacttcacatagaataatggcctccagctccatccgggttgctgcaaatgccattgtttcattcctttttgtggctgagtagtattccatgctgtaattataccacattttctttatccactcattggttgatgggcatttaggcccattttatatttttgcaattgccaattgtgctgctatgaacacgtgtgtgctcgtgtcttccaaaaatgcatttttttgcataaagttttccactgagtgatggggcaggggggcacatgctaaagttgaagcttttgccaaggagagagagctgagggctgcaattcttttggaggatgcttttcccagccacaaacccatattgatttcttccagaacatttactaatcctctctccccagctctcacccccagtgggtgcaagcctgtgcatataaacacactcccttgtttcccattcaggatatggaatcttatacatcataaaagagactgatctccatcctgattcataggactgtcagcagatggcagagagagtgataatgccacttactatcaggtcactccgaattattatttattctgtggagagtgagactgaggactgaaacctgatgtttaatttttcaaaatcacatggttagaaactggagggtcccaagctttctggtcctacatctaatgaactaatgcttttgttgtttatttttgcactatactttatagctatgtaatgatgtaaaggacacagttgttttatgaaatccatttccccttgctccttccttttgaaaccttgatcttttttttctctttctagtagctaatgagattcaggaaagccgatcccatttccaactccagggagcaagaaagtataatatttgaccttccagcctcttagcatcagctggtacttccttcttttctcttcctgagccatgagtcatgcttcatcaaaagtttcccaggctcctgaagtgaaaatgacaaatcagtgcataagagtgataggaagagaagtacaagattgtattagacagtatagaacaaaacactttgcagaatgaaaaattgcagagtgctgacacttgttctacagaaagggcatcagcacttagatcactgttgaacaacattcattttgggatgaatattgtctaaggtgaggctgaaattctttgcttcaaattctacaaaattcttattctacagaatggtggattatttagctaccaaactttactgagtatatagttattgaggatcaactgggagatgcataattgggcatcatgagcattggatggagcattgggtgggggcagaaaatgttaaggtcatacttgaaatatcaaagtgcacaacctaggaatagacttcaatatcaacaagatttgactcagctgaatctctgttttgccagtcttttctaggtctagttttatacctgttaaacatgaacattaaaacatttcactctgtgttagtcagttcttgcattgctgtaaagaaaacctgagactaggtaatttgtaaaaaaagatgtttaatgggctcatggttctgtagcctgtacagaaagcatagccctggcatctgcttctggtgaggcctgaggaagcttccaatcatggcggaaatcgaagagggagcaggtgtctcacatggcaggagaaggagcaaaactgagagttggggggaggtagcacacagttttaaacaaccagatctcttgagaactcactcactatcctgaggacagcaccaagccatgagggatctgcccccatgacccaaacgcctcccaccaggccccacctccaacactggggattacatttcaacaggatatttgggtggggacaaacatccaaaccatattacactccttgcctgtaaccagtgagaacccatttggctggtatatcactccagtttgttctaaggatgtagtaggtatttgccaattctgttgagcaacaatctcaactccaaccttgccatattctataggggggaaattggaatccccaaatctcttgggtacctgagatttctcattctccttaaaaggtcctggttgtcctaaagcaaccatgcctcctatccctgccacccctggtatttgcttcctgttttatttctaacagttgtctagagagaaccgtactgaaaaactgaatcaggtgatttctaatgccattaaatacttaaagttagcatagaactaatcattatagaagaagatttcaaaagcttcaaatacatggttcataatctcattgaattaaaaagctggctaaagattcaaaatggacgcacctaatgggacagcaaacaatatctaagttgtatgggagatgttgtaattaatctctcatttaatcatcctttcattcaagcattcctttgattggtagatgaggctggctggcttacatcagaagcagattttgatcagttttccttaggaaagcatgtgattgacttcttaaccaatccagcccaaaatggatgaaccataatatcaaaataatcacttttaaaagagtaaattctaggcagaataactgttctcagtatgttcttatgaggagttggactggttttgttaataatgacattatgagatacaatttatataccataaaattcatccttttaaagtgtacacttttgtatattttagtgtgttcacagagtttgactatcatcactactttcttggcaatcttttaatcatcctcagaagaaattgtgtacccattaatagtcacttccccgttccccacagtccctggcaaacactaatctactttctatctgtatattggcctattctgggcatttcaaataagtggaattatgcaaatgtaagtttttgtgactgtcttctttcatttaacataataatttcaaggttcatctatgttatcggatgtatcaggccttccttccttgtaattgctggatattattcaattgtatgaatataccagtactgtgttgaatagaagtgatgaaagaagacatcttttttgccttatctaagagagaaaacattcagtcttttactattaagtgtgatgttggcagtgagtttttttaaaaaaatagatgtcctttattaggttgaggacgttcccttatattcctagttttgttgagtggtttttaatcatggacagatgttgggtttttacaaaaatgctatttctatgtctattgagatgatcatgtgggtttggtcacttagtctattaatatggtatattatattgattgattttactgtgctaaactaaccttgcactcctagggtaaaatctccttgatcataggtataatcctttttatatgttgctgggttgggtttgataatattttgttgaggatttttgcattgatgtatttaaaagagtctggacacagtggctcatgcctgtaatcacagcactttgggaggctgaagtgggtggattgcttgagctcaggagttcaagactagcctgagcaacatgataaaataccctctctacaaaaaatacaaaaattagctaggcgtgatggtgcacacctgtggccagctactcaggaggctgaggtgggaagatcacaggagcccaggaagttgaggctgtagtgagccatgattgtgccactgcactccagcctgggtgatggactgagatcctaactcaaaaataaaaaataaaaataaaaaaagcagatatcggcctgctcttttcttttttgcgatgctttggttgggttttaagatcatgataatactggccacgtagagtaggttgaaaggttttccttcctctttcagttctcacaagattttatgaatgattggtatgaattctttaaatgattggtagaattccccagtggagccctctgggtctgggctttccattgtgagaacttttaaaattactaattcagtctctttggttattataggtctcttcacattttctgtttttttctttagtcagtctcagtagtttatgtctttataggaatttttaaatttaatctaggtcatctaattagttggcatatagttgtttatagtattcccttatatttcagtaagatcagtactgatgttcccccatttagtaatttgagtcttccttctttttttcttggtcagcttagctgagtttttcaattttatttattacacttttcaaagaatcaacttttgattttgctgattttctctattgtttaagtcctctctatttcatttatttaggctctaagttttattattttcttccttctgtttgcttttggtttagtttttcttcttctagtttcttaaggtgtgaggatatattatttgcttgaaatctttctttatattttttctccattctttcattactgtcttcttttgtgttaaacatctatttcctaatgtatcattttaattatctcttccacctatttttgagttactttattactgcttttttctgaggattacatttgaaatcctaaaacaatgtagttcaggttaatatcaacttaattttaatagttttcaaaaacttagttcatatacagctctgtttccttctcttttgtgtaattattgtcatatcaatgacctctttacacattataactatatcaacattatcttataattattggtttatgctgtttccatttaaatctgatagaagaattataaacaaaacttattaatactgtccttcatatttacctatgtggttacctttattggtggtctttatttctccatggatactcaagttactgtaaagtgttccttcattttagcagaagggttctttttagtatttcttgtaggatggatcttcttatgatgggttctctcagtgtttgattatctgggaatgtcttaatttctcataaaatttgaagaatagttttgctagatttggtcttcttgctgacagtccctttctaccagccttttaaatatgtcattccttctgactctggcttccatgttttaggataagtcagctgttagtgttattgaagattgctggcatattatttttctcttgctgatctcaagattctgtctgattcggtttttgacagtttaactatattaaatgtataggtatgaatttctgagtttatcctacttggaattcattgtgcttcttagatgtatagactaatactttttattatttaggatattttcagactttattttgtcaaatacactctctgtccctttctttcttttctctccttctggaactctccttgcatgtatgttggtatgctggctcatgtcccacaagtctctgaggctttgtttattttccttcattcttttctgtttctcaaactggatgatctcaattgccttatttccaagtttgttaattctttcttctgtccgcatagttgtgctgttgacctccttcagtgaatttttcatttacgttattgcactttcgaactctagaatttctatttggctcttttttaaatgatttctatttctgttgaaattgtctatttggtgagacatcattctcatattttcctttaactctctaggcaagatgtactttagttctttgaacatacgtaaagcttttttttttttaaatggagttttgctctgtcacccaggctggagtgcagtggtgcaatcttggctcactgcaatctccatctcctgggttcaagtgattctcctgcctcagcctcctgagtagctgggattacaggcatccaccaccatgcccagctaattttttgtatcttttagtagagatggggttttgccatgttgatcaggctggtcttgaactcttgacctcaggtgacccacccgccttggcctcccaaagtgctgggattacaggcgtgagccaccatgcctggccttaaagctttttatttaaaactttgtgtaaccccaatatctaggctttctcagaggcagtttctgttggctgtttttccttcatgtgtatggaccatgctttcctattttactatgtatcttattttttgttgttgttgaaaactggactgttaaagtaatataatagagcatccttggaaatcatatccttactttttgtttttgttgccattactagtagtagtagtagttgttgatgctgtgtgtttgtatgttttttagtgacttttaaaattctgtaaagtctgtgttctttgttgtgtgcagcatctaaaatctctgcttggttagcttagtggtcagctaataattggacagacatttcctcaaatttattcaaccaataactttcccactacttttttgtgatctatatgtgtgagttagagtatgcaataaatactttggtaacttgataactctaccttagcctttacttcctgctttgtcagccaaaagtgagagattggggtcttctcagatccttcctgggaatactcacagcttgcgcatatgcatggctttccagattcccaagaatatgtcagaactttccaaagctcccgtggacttctcatttcccatattttgatttttaagtttttcgatcagcttcttaatttgccgcaacagatagggccacctcaggcagctatgatattaaacaattcctgattcttttggaaaaatcccctgggtacagggatttcctcactgagtaatagctgacttaggtcaaatgaggataattccatgtgaatgagaatttcccagggagcttccaaacaagtacaatagtgataattctctgaggatgggccttttgtggcggatccaaacctattctgctctctccaatagctactaggccactggttttcacagctaccatctttctaaagctgctggttttcaagggtactgcagagatagggaaagggagatgggaataggaatagggtaggtttaagtatcacagagctcactgttctgtagaataagccatttttatttcaaccttttggttaatttttagaattctgaaaatgttgattttgacaatttttgcaactgctctcatactttcagggagcatcattctgtctggagtgcttctttttcctaggtggttttcatatcaggactgacttcttttgagacacaaatatcagactaggaagttgttttgtgagtacagaatcagaaaaagggaaatagatgtgttaaaaaggacgtagctggacgatgaagtctgatgcttgtctcctctttaggaagattgatatctgtgtctccaaggggaatggtatatctaatatttctgtgaacaataaccaccactaaatatttatcttaagtcttgagatcatgaaatgaggatgttggtggtatttgctgctgataaaacctgagtagatatctgtctcaacttagaaacctgataaagccagcagaacacaactgaggcagtaaagctttgggattgactggggactcttgagatacacttgctatccacttgctacttgaagtatggttcaaagagtgcagcatcagcatcacctgagaacttgtcagaaatgtagaatttcaggtcccactccagactttagtaagttagaatcttcatttcaacaaggtgatttatgcacacattaaagtttgataaatacatgcctgtagcatgtttacatcttcatgtggttgtcctgggaggattcctgcaatttgctagcttcatctatttaatgttcatttgtatcaacttaaatttcagaagtatctgctcctaaagtcttggagaatattaatctttgtacagtcttgtccttcttgtaactctttatggtaagaataaatagttgagcttcaagaatatcagagagggagaaaatctgtgcaggctggaatggtccaaaaggcattatttgagttaggctttgaggaaaggatggggagaaagtgaatgcgtgtcatgcagatgaaagaacatgggccaacctacagaggtgggaattatttattatgtgcagtagaggtctaaactgtaacatttttggggacatgcattatgtcttgcttatatatgtatcctcagtgactggatttcatagatgctctataaattattttcaaactgaatagtaggaagattagtttaactcaaggtgagggtttatataagaattatgggaattgatgcaaatttattagcatatggctagatgatggtgactttgaaaacttggtaggagtttgtatttaaatttgttgggtaatcttcagtaagttacgtgggaatggaaggggactaatttgtgattattagaaaattattaacagattaaataactttattcaaactccagaaaataaagtccttcaaaatcttcttggctcttccagatatgtggatctttgaatgagaacatattgtaggaatcacattaaggagaaaaaaagttgaagaaatatggtaaacattagtagcccattttaatgttttatataagttcttaagcaggggaatgacatgtgaaaatggtgtttgtaagagattaaaatgtaggccgggtgcagtggctcaagcctgtaatcccagcaccttggccaggtgaggccaaggcgggtggatcacctgaggtcaggagttcaagaccagcctggccaacatggtgaaaccctgtttctactaaaaatacaaaaattagccgggcatggtggtgtgtgcctgtgatcccagctactcaggaggctgaggcaggagactcgcttgaacccgggaggtggaggttgcagtgagctgagatcataccactgcactccagcctgggcgacagagtgagactccgtctcaaaaaaaaaaacaaaaaaaaggcagcaaaatgctagatggattggaaggggaagagaatgggtcaggtagactaactagggctttttttcgttatctagagatgaaggcagatggacagagaccaaggtaatgtcaggacagaggaacgaacgttgctccttgaagtccctagtattacaaagtagagacatctaattaagcagtttagcttttacacaaaaagaaaaaagaaaagaggaaagagataaactatctgatgcaatagcaataatagcaactattctttaccatcctcataagacaatggtgagaattaaatgagtgaatgcttgtaagttgctgtattaatctgttttacattgctgtaggaatacctgagactgggtaatttaaaatgaaaagaagtttatttggttcacggttctgcaggccatgcaagcatggcaccagcctctgctaggcttctggtgaggccctcagggagcttttactcatggcagaagcaaagggagatcagacatgtcacatggtgaaagagggagatgccaagttcctttaaacaaccagctcccatgtgaactaatagagtgagaagtaactcatcaccaaggggatggcaccaagccattcatgagggatccagcaccatgacccaaacacctcctgccaggccccatctccaacaatgtggatcacatttcaacatgagatttggaaggaacaaatatccaaaccatactagttgcctagaaaaatgcctggcacatggcaagcactcataaatgttagtgataagctattgttaactggaagaaagaacctcctggtgctatcgagtagcacttctgtttctcaaaatcagcacccaacacagtgcttatttgtaatagatgcttaatagatgcttaatgaatggatgaaggggaaataaaatatctctcaatgtaggaatgaaatatgttgattatagggtcacattttgctgttgatttctattatacatataatcccccaatggaggattgggggaaagtagttattgatttctcatattctgttctccaaactaactttatctctatctcattctctttctctctttgtccacacccatcctaagggatttccatctctatgcttgtgattcttggaagccggctccccctgtctgtgtttcatagcacaggtgctcagtcgacatttgtgttcattgctaaaccaatatattctagacctatggctcatgcctcagagcagtgctctcagggaaaaagacactctcttttctctgctgtatttaattcagtccttttcaatagtttatcctttctgaatggccactgagatgtttgatacagccaacttaatgagttgtggctaaactgctttattttatgtggctgaaatgtattcaactgcgcatgtgtacataagacttaatctctagacatttcatgataatttgacagcataattgaagtgagggggaaaggattgagtggtttgtttcacttacatttcttcacccacccctaaaataaaatattctctgaagcaaatgtcaggaacttcttccaccactgtcaccatgtgacaatgagttagggaatggaattaaattcgttatctagcgtctctttccaaagagctaaaaggtttttttgttcattaccagagcatctctccaacagaatagagaccttcccatatacagctgcagctgagtttcacacttaagaaatcttataggatcttataaattttaagggacatagctctacctgaaaaagtctgtagaaacctgaggtccagctcttctgattgccttgggtccttttatttaaagttggcttgccttttgtaatgaaacaagccttttctttagtgtttaataccaatgaatcttttggagaagatatgctagaaagattttgagcaggggtagagaatcttcctatgtcaggaccactgacccaccaaaataatcaggcacatttaagaaaggacaacctttaggtcacttgcaaaagaatgcaaacccattaaataagtattcttctagttcatattatggccagctgaggaagatgagagaagagatataggaggagaaatagagtggataagaaggaaagagagaaaaacaggagaggtagacacatacacacagaaatcaagagggatagagaggaggaggtttgtgagtactgaggtgagagttactgagatgtggtgcttgtcacatgccattgctcacttgggctggtttccttgctaatgagttgcttaagccttgctcacagctccttctacagcagtttttcaggtgaaaaaaattatcctttggactgtagcaacactgaccccagtggtgcctctctgagagaacagagaaaattaagccaagtgctgaaggttgcctaatcctttgaggggaatgcaactaacattaattgaattcttattctgtaggaagtgctttatagaggttatctaatttaatcttcaacaaatctaacaacaggcactgttatacccattttccaggtgataatacagtcattaagtgctttgtcaggtaacaccaccagttagcagggagagaatgggattcatgcaccagccatcttctgagtcctgctctttctgtttcaccagccgcatccacgtctctttctagagcttaaagaaatttcagaaaatcatccaagtttgcaaattggtagaaattgctccacgcctcagactgataataatttgctttattgattagtgcgtcattgggccccatgccaggcatctgagctttttatctatttaaagtagagcagcagccagttggttggaagtattgtacctacccttctttgacagatggctttctatttggcttttgaaattccataagaaagaatttcacagtttctcacagtagcttattgcagtcatatccagagtcagtcttcggatcatgaatacattgatcccttttctctggctttgaatgcagcatactgtcataggcctgggcgaaagagtggttccagtgtgtgtgtgtgtgtgtgtgtgtgtgtgtgtgtgtgtgttggtaatacacaatctgtaacatagtcaaagaagaaataaagagtcggcaaactatggcccatggaccagatctcgctggctgtttttgtaaataaagttttactggaatacagccatgcttattcatttatgtattatctgtggctacttttgtgctacagtgacagagtggagtagttgtgactgagattgtgtggtcttcaaaggctaaaatatttattttcttgttcttttctgaagaagtgtgcaatccttgctatagattaacatatcaactagagaattcttgaaaagaacagagcatgaatatagcaaaactatggtgttacctaggtaatagtactatgaggatctactacagataatattttccaagtgccccttgttgtgtttgggggaatacaaagaggaggttctcttacttgtatgttgaaataactccttagaataaggttggagaatttctgataggaatgttgcttgtgtatcaaaatacagaattgcgcttctccgttctgactgtggttcttgtccaggcaagtttggaaattgtgactccttgaaaccattcaggcagccaagtgttccagctgatgttttgtgtgtttttttttcctccttcatttaaaaatacactttgtagaatgttttctttttcacggctccctaaatattctgttttgaaacatttaattacccaggttatttatatggaaaggtttgataatgtttctatgggagtctgttatttatttcttttgctaaatcttatcttatattaggggaagggctgaggttggttactatggcaacattctcaaaactgcaacaatcccattacggatgctaaaactatagtcatttcagtgggagggtagcatggggagtgggtggtagtctttttatttttattttattttttttaaaaaaacctctcccacttccaaatcttttgcattcatttattttaagctttgcagcttagggtactaaaatgagaaacaaaaagtaaaaaagagtgtcatgtctctctccattaaatttctgtagtcctttatcagctccctttgtggggatacccagttttctacctactcttttattcatttatgctttcagttattccccaaactttcattgagacctgtgttatgggtgaataagagaatccttgttcttgtttctccttttaaattataaattctttgaagccattaattcacttcactgtaattcatttaaacaaatacttattgagcaatttgctttgtatcaagaatcatacttgcataagaagacaaaaaagaaaaaagggattctgttgaagattaacattttgttttgttgggcagcacagggaagggcacatagtgaagcacagagatgattgaaataaaatttgataaatgcttacacaggggcacttaatccacttaactccccagcctagaaagcatagaaatgactgcagggaggtgacatttgggttaccagataggcattttctggttagggcctagatgtgtgtgtgtatggcagggggatggaggtgtgtgtgtgtgtgtatgtgtgtgtgtgtgtgtgtgtgtgtgtgtatttatgggtttgggtatgcagggcattccaaccaatctagaccaacaagaatagagatatacaggcgaggagtccttggccatgagcaggagaatttagaaaacacatggatgattggtagaagaacagtctggagacgtagccatcaagagaagtcatgtctgggaggttggatttcgacattgggaaccattgaaaagttcagaaggaggagcaattgagtgttccagtttagaagtggaagacagtgaagggaagggaagggggaagatgggattgggaagagatatggagacttgtaaaaatggcaagattcaccttgggacatgatgagttttaaatgaaccccatcaagttggaccgtccagtaggcagctggaaatgtggctccagaactgacaagaagtgtggatgggacccagagatctggatatgatcagagaaggctttgaaggaggaacaggaacctcaagagaaattacacattatcgtatccctaatatgctgtctcacttttagtaaaatattaagtatttctaaaaagatttttaagtgttgatgtgaccaaaatatttttataattttttattttttatttcaataggtttttagggaacaggtggtgtttggttacatgaataagttctttaggggtgatttctgagattttggtgcaccatcacttgagcagtgtacactgtacccaatgtgtagtcttttttcccttgctacccctgacagtttcccctgagttcccagagtccaatgtgtcattcttatgcttttgtgtcctcatagcataatagtgtccagtttcatccaggttgctgcaaatgccattatttcattccttttcatggctgagtagtattccgtctgtatatacaccaaattttctttatccactcattgattgatgggcatttgggctggttccatatttttgctattgcaagttgtgccgcttaaacatgtgtgtgcaagtatctttttcatataatgacttcctctgagtagatacctagtagtgggattgctggatcaaatggtagatctatttttagttctttaaggaatctccacactgttttccatagtggaactatgtactagtttacattccaccaacagtgtaaaaatgttttcattgcatccatgccaacatctattactttatggttttttgcttatgggcattcttgcaggagtaaggtcgtatcaaaatgcaattttgatttgcatttccctgataattagtgatgctgagcatttttcctgtgcttgttggtcatttgtatatcttttcttgagaattgtctatgcctgtccttagcccactttttgatgggatttttttttcttgctgatttgtttgcgttctttgtagattctggatattagtcatttgtcagatgtatagattgtgaatattttttaccactctgtgggttgtctgttaattctgctaattatttcttttgctgtgcagaaggtttttagtttaagtgctatctatttatctttgttttagttgcatttgcttttgggttcttggtcatgaagtctttggctaagccaatgtctagaagggtttttccaatgttgtcttctataatctttatggtttcaggtcttagatttaagtatttgacctatcttgagttgatttttgtataaggtgagagatgaggatcaagtttcattctgctacatgtgacttgccaattatcccagcaccatttgttgaatagggtgtcctctcccctctttatgttgttgtttgttttgttgaagatcagttggctgtaagtatttggctttatttctgggttctctattctgctccactggtctatgtgctgatttttataccagtaccacgctgttttcctaactgtggccttatagtatagtttagagttgagtaatgtgatgcctccagattttttttttttttctttgcttagtcttgctttggctatgcaggctcttttttggttccatatgaattttaggattgttttttctagttctgtgaagaatgatggtggtattttgatgggaattgcattaaatttgtggattttttttggcagtgtggtcattttcacaatattgattctacccactcatgagcatgggatgtgtttccatttgctgtggcatctatgatttctttcagcagtgttttgtagttttccttgtagaggtctttcacctccttggttaggtatattcctaagcatttcatttttttgcagctattacgaaagggattgagttcttgatttgattctcaacttggtcactgttggtgtatagcagagctactgatttgtgtacattaattttgtatcctgaaacattgctgaattcatttaccagttctaggagctttctggataactctagggttttctaggtatacaatgatatcatcagcacacagcaacagtttgacttcctctttaccaatttggatgccctttatttctttctcttgcctgattgctctagccaggacttctagtactgtgtttaatacaagtggtgaaagtgggcattcttgttttgttccagttctcagggggaatgctttcaacttttccccattcagcataatgtaggtggtgggtttgtcttggatggcttttattcccttaagttatgtcccttctatgccgattttgctgagggttttaatcataaagtgatgctggattttgtcaaatgctttttctgcatctattgagatgatcatgtgatttttgttttcaattctgttagtggtgtatcacacttactgactcatatatgttaaaccatccctgcatccctggtatgaaacacacttgatcatgtggattatctttttgatatgctcttggcttcagttcactagtattttgttggggatttttgcatctgtgttgatcaagggtattggtctgtagttttctgtttttttaatgtccttccctggttttggtattagggtgatactggcttcataaaatgatttagggaggattccttctttgtctatcttgcggaatagtgtcaataggattggtactaattttctttacatgtctgatagaattcagctgtgaatttgtctggtcctggacttttttttttgttggcaatttttacattactatttcaatcacgctgcttgttattggtctgttcagagattctctatcttcctggtttaatctaggagggttgtatattttcaggaatttatcctgaaatttatctcctccaggttttctggtttatgcacgtgaaggtgttcatagtagccttgtatttctgtggtattagttgtaatatctcccattttgtttctaattgagcttatttggatcttctttcttcttttcttggttaatctcactaatggtctatcaattttatttatattttcaaagaaccagctttttgtttaatctatcttttgtattgtttttttgttgttgtttcagtttcatttagttctgctctgatctttgttatttcttttcttctgcttggtttgagtttagattgttcttgtttctccagttccatgaggtgtgaccttagatcgtctatttgtgctctttcagactttttgatacaggcatttaatgctatgaactttcctcttagcactgcttttgctgtatcccagaggttttgataggttgtgtcactattatcattcagttcaaataattttttaatttccatcgtgatttgtttacccagtgatcattcaggaacaagttatttaatttccatgtgcttatatggttttgaggggttcttttggagttgatttacagttttattccactgtggtctgggagggtacttgatataatttctattttcttaaatttactgagacttgttttgtggcctatcatatggtctatcttggagaatgtaccatgtgctgatgaatagaatgtaaagtctatagttgttgggtagaatgttctataaatatctgttaagttcatttgttatagggtatagtttaagtccattgtttctttgttcattttcgatcttgatgacctgtctagtgctgtcagtggagtattaaagtcccccactattattatattgccatctatctcatttcttaggtctagtagtaattgttttataaatttgggagctccagtgttaggtgcatacgtatttaaaattgtgatattttcctgttggacttgtctttttatcattctataatgtccctctttgtcttttttagctgctgttgctttaaagtttgttttgcctgatataagaattgctactactgctggattttagtgtccagttgcatggaatatctttttctacccctttgccttaaatttatctgagtccttatgtgtcaggtgagtttcctgaagacagcagaaacttggttggtgaattctttatccattctgccattctgtatcttttaagtggaacatttaggccatttacattcaatgtcagtattgagatgtgaaatactattctattcatcatgctatttgttgcctgaataccttgtgttttttacactgtgttattgttatataggtactgtgaggtttatgatttaagaaggttctattttgaggatttgtttcaagatttagagcttcttttagcagttcttgtaatgctgacttgggagtggcaaattctctcagcatttgtttgtctggaaaagactgtatctatccctcatttatgaagcttagtttcactggatacaaaattcttggctggtaactgttttgcttaaggaggctaaaaatagaatcccagtcccttctagtttatatggtttctgctaagaaatctgctgttaatctgataggtttttctgtataggttacctgctgcttttgcctcacagctcttaagactctttcctttgtctggactttggataacctgacaactatgtgcctaggcaatgatcttttcacaatgaatttcccaggtgttctttgagctgcttttatttggatgtctagatctctagcaaggccaggaagttttcctccattattccctcagatatgttttccaaacttttagatttctcttcttcttcaggaacaccaattattcttggttttggacatttaacatagtctcaaacttcttggaggctttgttcattttttaaaattcttttttctttgtctttgacagattgggttaatttgaaagccttgtctttgagctttgaaattcttccttctgtttgtttgattctattgctgagactttctagtgcattttgcatttctgtgtgtccttgatttccagaagttgtgatggtttcttatttatgcagtctatttcactgaagaactttcctttcatatcctgtatcacgtttttgatttgtttaagttggactacacctttctctggtgcctccttgattagcttaatagtcggccttctgaattctttttttgtcaattcagagatttcatcttggtttggatccattgctcatgagctggtatgatttttcagggtgttaataatcttgttttgtcatattaccagaattgtttttctggtttcttctcatttgggtagactatgtcagaggaaagatctgggcttcaagcgctgctgtttagattcatttgtcccacggggtgctcccttgatgtggtgttctcccctttcgcctaggaatgggacttcctgagagccgaactatagtgattgttttgctagccacccagtggagctacagagctctgagctggtactggagagtgtctgcaatgagtcctgtgatgtgatccatcttcaggtctttcagctgtggttaccagcacctgctccggtggaagtgacaggggagtaaagtggactctgtgagggtccttggttgtttttgtttagtgcactggttttgtgttggttggcctccagccaggaggtggtgctttcaagagtgcatcagctgcggtcctatagggaggatgcaaaccttccccagggatacctggttagtattcaggtttctcaggtggtggacggggccatagagctcccaagagattatgacctttgtctttggctaccaggctaggtagagaaagaccactaggtgagggcagggctaggcgtgtcttagctcagcctctccttgggcagggctccctgtggctgctgtgggggatgggggtgtggttcccaggccaatggagttatgttcccagggggattttggctgcctctgctgagtcatacaggttgtcagggatgtgggggaaagcggggagtcacaggcctcacccatcgtccacacagcctgcagtcctaatggccggtctcactctcatcatgcccccacgacagcaccgagtctatttccaggcagccagtgaccagggctgagaacttgtcccagaccatgagccttcccattgagaaagcaagcagactcacagttttttggtgtctcaaggagtctgcagaggtgatctagttcgttacttgaaagggtctgtggattttctcagcttttctggtatgttcctacagtagttcttggagcaaaagttcatggtgtgagtctccacatgctgctctgtctgtctgagcaggagctgcaagctattcctgcctcctatccaccatcttaattgacagtggtaaccaaaatgtttagagccattttgacagattgaggaatcactgctatgattaaaatgtagcacttgagatgaccatgctcaactcgtaggatgccatcatcaaacagctttgccttctccctccatttattctttaaacctgcacagtgggacatgtccttccctggcaattccggtcactcttaggcaattaaaaaacaaaacaaaacaaaacattcaggttaaaaacaccagataattcagtacctgaaacgtccagcattatgtactagcaaaaacactggagttgatttagaattgagctttcttccctcctccaacaggggcctgccccagccctgcagtcatggaaggagagtggtcagcttccctctttctcctcagtattccttcaccccttttcttctctaggctagcctcagtctcagaccccattaaattgggttgagagagaggaggaggaaggaaatataagggaaacagtaaagtgcttacttaactgctgatgaattgttagtctagtttcagtgctttctgaatctagcagatatgtaagtttacttctctgtggagttcttttgtgtattctttgcccaaaaagaacataccctccccccattgctaagggtctcatatctgtagttctctgagacaaaaacaatgcgttgctactgggctacacctttcccgacccttaggctcctggccacacctccagctaatttctgctatgccttttgagtagtacctgaacagtcctgatatggctgtctcagatgcacagcccacaccttgttcatggaagacactcaaataccctttgcttctgcaaactctgggagtgcaaccacctctcctagatccaccaacaaaacagccagcaagcctagatgctatcatgtctgatgtcagatgtggttcagacacaaatctatttgttccccaaactgcacagactgctgaggacagatgtgaagccctctgtctgcctttttaaagtccctctttcttgacatgaggtgaagcggcaagccccactaaccactggctctccttgattgaagggttgtggactctcaacacatcaatagcttccttgaacaatccctccaaaactgtccaattcttgatccttttaaggaattatgagttttataaacagtttatagcaccttttttggtaaattttgcaaaacgtctagctcttttaaaaaaattatttcttgatgcttgaaagaaaatattcactgaaacatcatgttatgtgagcatcatttttctacccccatttagaaaaaagcatttctgactagttgcagaaggaattttgttacatggatatagaattggctgcatctagggatagattgaatggatgacaaagtgaaaccacgctttctttatgaaggttgtattttcaccttccttgtagacacccttccttttccagggtgcccttagataaacagctgtgcatcttacaggaattgcttacaatgatagatttcccctaagctcatgactgccaaatttgtctttgtagcccagacctctttctgagatgcagatccatatatctgatagcttactctacttctctgatcaaagtattacaagtttagctcacatcatcattactctaaataccattcctcattctgaatatctatttgccttcatgtaatttatctttagtcttaagaaatggtacttagaaacccttagttgtttaaatcagaaagttgggagtcatcaacagattcttaagttcttgtcaaccatgccactttagcaatctggtgatgtctctgaccgcctttcaaaacagtgtttgtaagaatacaggactactatggaaaccaatgatatggaaacacagttctgttatgaatgacttggaattcatgaattgttttccttctcatctctcacattgattcagtatatcattcacagatcatctcctgaatagcagtcagactcattttattttctctatcttcactgatgctttcttacttcactccttcatcatctctcactgaatgactgaagtttcatttaaaaaacaacttatactgataaatttcaaatatagacaaaggacacaaaataatataatgtaccccatgttgctgttacctagttttacattcccactccccactctattataatgacgaatttatagactttattttaagtaaaacttataaactgtcttagtctgttttgtgcagctgtaacagaataccacagactgggtaattcttttgtcaaacgtctgttcaagtttttatttttgactatttttaattgtttaaaaatgtttattagtagttgcaggagttaaaaaaatctggatacaaatcgattatcagattcatggttggtaaatatgtttttccaatctgaagcatacttattaattttcttaatgtaatttttataagcaaaaacttttaatttttaaaaatgatattatgttctatgtccttctgagaaatctttacttatctgcaagtcatgaagatcttcttctgttttcttctaaaaattttatgtgttagctttcacacttaggtctatgtatgattcatcttgaattaatttttatgcttgctataagatagaggttgaggttcattctttttttttccatatgaacatctagctgttccagcataatttgttgaaattattgcttgctttattgaatttctttggtggctttttcaaaaatcaattgactatagacttgtactatttctggactctctattctgttctgttaatctatttttctatctttatgccaataacaccctgtaggtttaaagtaaatttcaagtcatgtggtatgaattctctatcttttttctgttttcaagattaatgtattctggatcctttacatttccaaataaattttagaattaacatgtcaatttttattttcagaagacctgctggagttatgattgggatttcattgacttagaagattaacctgtatgtatagtttattttttagccagtgatttgggagagagatttatttgcagattttagggatcactgcctttgtgacttctctctatttaacatattccccctaactttctgcagttttgccttcccctaagttatctgatactttgatcaagtaaggaaactgaggctttctgcaaccccagctatgtgcaaattgggagtgctaacagtcaaatatttgcaaacttgcaaatttcattcattgcagtttgtcttttaatgggggtctctgctccagattttgcctaaccatgttcactttgtagtgcctttgagtagtttttttttttaattgtccagatctaaaaattgttatctgtggaacaattgttctgacctagctactttgctattaacagaagacagagcacctccttcttgcctcctctttcatctccctgtaacacacctgcccattgtcccctaagtaatctttcaaaaaagcaaacccaagcaaaccattttctggttgaaagcccatcaatgactcttcattgctttctctctgctttcttatcttccttttttagattcctcctcacttatcctatgcactctctggctttattgaaccatttggcatttcctagacacacccttcccttaaaagtctccccttcttgggcttatatcatgatcctgactaaaatgcctctatgttctttgtagccgggctaactcctagttcttcaaaagtcagctcgaagtaccaactcattggtgaaaacttctgggcgttattgaaagtgggctactcatactttcatattttcctaatgtttttgttatgttttagtatcacaaaactcatcaacttatatttaattgtttaatcacttattacactgtgagctgtgtacgccttggtagggtccatgtcttacctgtgattgccaatcgcctagtattcttgttgaggaaataagggaaggtgaacggactgaatagccacatgatggttgcattttaggtgtatttatgacgaaattttaggtatctggtcattcccaaatattttccctttgtcttctcactcatggcactgaatatttaaataccaatatgcgattaacaaggtaaagttagaaccacagaaatgcctcagttatccagaggaaagctttccaggagcctcagaaaatgaaccagatgaagacttaaaaatctatgtatataaatagaagaattctttaaagagaataaaagacattgatgagtcgaaagcagtgacatagtaaataactaaagagccaatgatgccaatatttcatctgttgagatatgacttaaagttttatgaacacaaaggaaaaggctgattctgatttcaaaaattaagcagctcttgaagctttaattggcgtggctacagtatgacacagaggaacactgagggagctagaccatagccgtcgctgctgtgagacacagggagccagaatcctttcacattttcctggacatgtcaacctttctttgtttcttttttgactgctacataatcatataggcattgcatactttttatggagattctttcttggtggaatcccagttttaattactgtttccatgtaagttattgttggtgagcagacaatgccttttccactttttaaaataatgccatagaattccatattactaccatgcatatatactaaagtttctcccgcctcatcctttttttaacagattggtgggggtctcactctgtcgcctgggctgaagctcagtggcatgatcataattcactgcagcctcaaactcctgggcttaagcaatcatctgctctagcctcctggttagctaggactacaggcatgtgccaccatgcccagctaattaaaaaaaatttttttttttggtagaaacagggtcttgctgtgtttcccaggctggtcttgaactcttggcctcaagcatttcttttgcctcagcctcccaaactgctgggattataggcatcagctatcctgcctggtctttttaaaaggccttttcttacaattgattattatctcattactcctccttttctcatgtatttttcgtctcttctccagtccatttttgctttgagcctctcccacatacacctgccccctcaaatatctgtcatttatcacaaaggctttctcatactgtcatgctttaagacactgataatccacttcttccattaagttgccctgtaccaatcatagatgatcgattgcgtggttatatgaaatagataatacaaaatgaaaaatgaacgtttcttctttaagtacaccttcctcagatacacctcttcccctaccctcagaggtaaccacacttaaccattttctgtgttgtgtaatccttctatattttttctaagcatctatgaataaacacacacacgtaaagtaagatgatggtcaaaatgtttaaccactgcatggtaatataaaacttagcacttaaaaatatgttctattctctaggcagaccaaactatatataattgcctaccaggtgatctatgttagaggttaaatcattcatcaaactattccaataattttcaaagcatttattgatttttaatgggtataatcttttgtttgatgcagctgtcggtagttaagtgatgtccctgtatcaaccatgatttgaaacagggaaacacatcaatctattccaatgattcactcattgcataatactgccacttgcttctttcatttaagaatatacttttagctgggcgtggtggctcacgcctgtaatcttagcactttgggaggccaaggcaggtggatcacctaaggtcaggagtttgagaccagcctgaccaacatggagaaaccccatccctactaaaaatacaaaattagctaagcatggtggcacatgcttataatcccagctactcgggaggctgaagcaggagaatcgcttgaacccaggaggcggaggttgcagtgagccgagatcacaccattgcactccagcctgggcaaaaagggcgaaaaactctgccaaaaaaagaaaaaaaaaagaatatacttttgacatctttccctgtgagactataataaatctactttattgtatctaatgataggatagtatcccataatatggatataagtttatctatcgagttccctactgtttaaatgtttccagtgttttgctattacacgtaatgttgctaaaacattctcttacatctttgtctgcttcggtgcatacttttgtaagatagacttatagacgaggaattgttggttcaaagtagatgtgccaatcaagaatttgcccacttataagtaactacacacatcttgtgtgcacatgcaccgacatacatattatcacctgaaaatataaacccagatgcaaacacaggtgagcactaaattaattctaaaattcatttgaggatttggcaccatgaagttgcatagccacataccctcaggtagacaagacaggggaatggcagaggtaccttggtagaaagtgaaggagaagaagaaaggttggtggtccagagaagtcagtatttccttgcctggaatgagtgcctgcctatcgaattttgataaaacttcttgattgtcatccttgtttcattacggtcctcccaggaatattttgcttttttctaagctttaaagatcatagcttcgtgacttaatctttggactggatttccccacttatatgagaagaactaataatgccacatggagcacaccttttcaggactcaaggagtctaaaaaaaagaaaagaaaaatgagtcagaacttctgcctgtgagtctgagtcagcttagtgtgttaaaaaaaataataataaaaaaagaaaagaaaaaaaaaaccgtgtgaggagacctgcctggaaaaactgctgaatggaaagacttgagaacagcttatagatattgacggcagatgaagaattttcatgtcttttcagaaatggttagcagccactcataacagtcctgtgacgtcacagaaatcttgactcctgcttgtctttctcgttctcctttaagcccttccctcctccttttcatataggaccttaacacaagagggtcaggaagagaagagaagggttgctcacaggaggaaagaaggcaaggggtagctgttactttacctggtgggccatgtgtcgctacaaatcaggtggtctctttggaggagatgccacttggtaagggaggcttcctgagcactcgaatactactagcaactcagaatgtgggaccgctggaaggaaaaacacccctggatggggcgaaggttgagttcaattttattttttactctgtgtgtgtgtagggggagggtaatgggaaatgtgtgttttgcagacacattaacataaggagaatagcggatgcgactttattatcctcattcacgtaaaggtggacatttaaatttttttttacagtagggaaaaagaaccttctgagttgatttggtatagtggaaattgcatggaaatgtttagcttcctctgttttcacaaacatgtaaccttctaagaaaatctctctttgacctatttcaaagtttgatttttttttttaaaacagttgggaaaataggagctaacatgaattgccccttttccaacagtgaaaatgtttgtaatgtaccttttcatgttgctctaattatgaccataacttcttttttattcaatcctgaatctgttatattttaaaattatataaaattataaaacactggccaaaattagtcacccaggaaatagtataagggacccagttaagaaagtaagtgtaagtgactgaaaaagtttggtgccttctcattgaggcagacttgcttatttgtttgttaacctcagaagtattaccatacatactgtctatggatttagatacatgatttttctcaccttctagacatccaccttgttgtgatagaaggagcatggatttagagtcaggcagccttggatctgaatcactttactacttctgtggcccttagcaggctatatagcttctgtgagcctcagtttcctcatccataaaatgaaaataatgtctacaggttagtattgtaacaagggatcactcagattaactttggaaaagctttctgctattaagcatttggaaaacatgagtttctattttttttttgtattttggttatcattattggcttggttttctttctaggccttggattctccttcactttatgtagaatatgatcttcttgtagtagatagatgtgagtcctgccaacagaatttttctgaattggcttcttgtcttttctttaccaatagctgcctattcagttcagctgcctgatcaacatcttgtctctcaattcctgtgtgccctcacagatctattaaagcatcctgagaagagggtccctcagagtcaccaggtttcagggctccagcttttcctggggatcagaataccccttcagaggccaacactctaaggcagtaatgtgtttctctggccaaacgcctgatagtatcttcttggcaagttcattatttattcccctttactggtgtgagggttttcccaaagtgtcatgtctttgcagagtttttcctacccttccgtgctatacgtgtggtaccattttatgcatttgtttttgctaatatgaaataaatcccattataaataattccaagggattttgcagatgattgtactgttcagaataagaggagtgttccgtgaatcatggagctgctttggtacacagtttgtagaagtaaaatgtggtataatgtaattgacccatgggtcccttcttgtacagagtgtcacttgctgagaagtaagcaaaaaagggagtgcattcctgcatctggcaattcacccccatcctgcaagagtaactcatagagcagcagcttattccattgtgacactgactcacccttcctctctccacccccattgtctagtgctgatgtgttctgtccccactaattctagggtcacactgacttatgccttcatcatcctaagtggagaagaaagcttgtctgtgttgatgaaagtatgaaaatagaaatgccataacttttaatgcaaacaatatatgtttgttgaatgtatgaatacaacaacttggaataactgctgacagtgtttccaaatattttgggtctatttaagtaaagagacatgaataatttgaaactggcattctttttcttcttctttttttttgaattagcaatacatgtgatgaaaccttaaaaacaaattctcatagttacgaatggttgcctttagtgagcaggatggggaacagatctgggggcttaggtcattcattataaaccattctgcaagctttcttttttctaaccagatgtgtgtattactttaatgtttttttgatacctcccttaagtaggcccagtccagtttaagtgcaatctcttgagtgccttgtgtcagacactgtgccggtcacccagggctccagggtgaatcacgaatagctctcacatgtgaattcacagtctagttggggagacagaacagaccaaaagcagataatatttaaataacatgatgctggctaagagagaggtagccatggagttaagtatcttcctctccattttattcagccttttgttttaaaattctacctttatgatgtatttcaacagagttctgtgtcatgattttggatttagtggaaaaagaacagaggagattttcttgttaccttaattttcccaacatggaagatttgggaatgaagaaggacactgcaaagagtgaggcctaaaatggaaaccagtcatgatttttattttgctactttctttacggacacgaatgcacacagtgtagagcagccttaactctgaattggaacaaggtcgtgtaagtgccaggacgttatttccagaagcccacagctgctgattcctacacccagtgatttccactgccttttcatgattctggaattcccaagaacagtgtcatcttattagaaggtatttcccagttcgagttggagacaaaccaaccttccctcacaggctgagtccttctggtttcactgccaaagcttccagactcacccagggtctgttagacatatttgaatgaatctgtcagattgttcagtcgttaatgaggtcacactttccatgaagaccatagtggcgtcattttgtgtaccaacaattgtatcaagtcatgatgattttttaaatatcattgaaataatcattaaaatattattgagataaagatgcatgtttattggtatctatttattcctttctcttgtttaagagagaatttacttagatgtgtacaaaactgctttctggcatacttaattttatgggtttctgatttccacatcactgaaagtatctggaatacctatgatgcaatgtgaatcttgtttccactaactagtaagtaaatgctttgttcgagatttaagaaagttggcctggcacggtggctcacacctgtagtcccagcactttgggaggctgaagcgggtggatcacctgaggtccggagtttgagaccagcctggccaacatggcgaaaccccatctctactaaaaatacaaaaattagctgggcatggtggcacgcacctgtgatcctagctactcaggaggctgaggcaggagaatcgcttgaacccgggaggtggaggttgcagtgaactgagattgcaccactgcactccagcttaagtgacagaggtgagatgccatctcaaaaaaaataaataaaaataaataaagaatgaatataattgcaaagataaaacgtaaacccagattgggaataagaagcagaattataccaaaatggaagctgacgattacacagattcactccttatttactcattcaaagcttgcctcacataccataggtaaagtgggtaactctttctgatttttttggttcacttcaagactatatgatcttgaaattttaaataaataagctaaaaaggccctaaaatattttattaaaacccactgagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaacccactgagtataatttattgatttttataaaactaattctttttttttctgttttacttataagttttgggatatgtgtgtagaatgcgtaggtttgttacataggtatacatgtgccatggtggtttgctgcacctatcaacccgtcatctaggttttaagcccctcatgcattaggtatttgtcctaatgctctccctcccctgcctcccacccccagacaggccctgatgtgtgttgttcccctccctgtgtccatgtgttctcattgtttcactcccgcttatgagagagaacatgcagtgtttggttttctgttcctgtgttagtttgctgagaatgatggcttccagcttcatccatgtccctgcaaaggacatttcatttttatggctgcatagtattccatggtgtatatgtgccacattttctttatccagtctatcactgatgggcatttgggtaggttctaagtctttgctattgtaaatagtgctgcggtaaacatacatacgcatgtgtctttatagaacaatgatttataatcctttgggtatatacccagtaatgggattgctgggtccaatggtatttctggttctagatccttgaggaatcgccacactggcttccacaatggttgaactaatttatactcccaccaacagtgtaaaagcgttcccatttctccacagccttgccagcatctattgtttcctgactttttaacaattgccgttctgactggcatgtgatagtatctcattgtggttttgatttgcatttctctagtgatcagtgatgatgagctatttttcatgtttgttggccgcataaatgtcttcttttgagaagtgtctgttcatatcctttgcccactttttgatggggttgtttttttttcttgtaaatttgtttaagttccttgtagattctgcatattagacctttgtcaaatgagtagattgcaaaaattttctcccattcataggttgcctgttcactctgatggtagtttcttttgctgtgcagaagctgtttagtttaattggatctcatttgtcaattttggcttttgttgcaattgcttttggtgataaaactaattcttaattgttatcactcagtgaatggtactagtttgatcttcccttgctgattaatccagttctttccagttcacttgaaacccatttctttgactcagatagctttcactttagttccaaattttcagggacatttggtaccaaactcttcttacagaactttaccctcgaccaccattgctggatctgccacagtcagagttcatctaccgggtctaacacgtctcggcttcttttgcattttctcccgtgtctcccttgggtgtcgcagaagcagcaagagattattatcatgtagtagggctccgtaatcagaatgcgaaatccctatgcataaatgctgtcttttctcagaatttcctgacccactttctattttttgagaagacaaaattgacttttttttctgacttcttcagaaatctcttatagtgactggtattttcatctgctggcacctctgacaatgactattacaacgtgcctcagaatacagagtgctaacacctcatcttctaaaagaaatgcttcctctgtaaaagtgttttctctgatgaagccgccatatagaccattgaataggaactgcagaagactccggaacacaatttgatagccgttcagccaagcggctgcaatttattttgtccctgagtgtgaaggaggcagcccaaagaatgttggctctggaggaggaaggcaaggatatggggaaacaggggccagagaagggcaggatggggcaaagattcagggcaccttatgtaatgaggcacagcgtgattctgcccggggcctgtacgtgcatgcagtcgggttgcctccctttcccctggaaatgtgccctttgcttactttttgtttggttttaaagcagctggaaaggatattttttgctcagaattggtgcttagcttttgcagaagctgcttcttgagagtcgtctcttgtcatccctctgggttttagctcagtgtgacgaagctatttaaaatatgtgtgtttttaaatgattctaaaaatgaagtattcacattgttatgcctcactccctccccactattgagtcctgctcccctgacagcaactttccatttctctagcttatccttctggtatttatttatatctgtgtttctaaatactatgtttatactatgatcatttggtttgccaattgtagacattatctgttaggttggtgcaaaagtaattttggttttgccaagatgatagtattaggtaccgacctaataccatcatctttctatgagatggtaccattttagatgaacatcttgtgtccacttaacatcctcccactttctgtagcttcctcatatatgtagatcaaagttcttggttagactcatgatcagattatttgttttttgtttgtttgtgtttgttttgtagggacagggtcttgctgtgttgcccagtctggtcttggagtcctggcttcaggtgatccttctgcctctcatactggaatattatataatatttttaaaaatagctcacctttattatgtattttctgggtgcaagacactgtcgaagagctttagacatgtattaactaatctttatagcaaccatgtaaagcagatactgttattctttccattttgcagatacggacattgagacctgggttaactaactttccaaagtcatgtaggtagtagctggtggagccagacttcaaaccaaagtaaacgaggctccagagtctacttttaaccactacactttttaaatgattaagattttacaaatactatttatagtggagccacatgtatattattatctcttctccttctcttctcttctcttctccttctccttctcttctcttctcttctcttcctcttcctcctactctactcttctcttctcttctcttctcttctcttctcttctcttctcttctcttctcttctcttcccttctcttctcttttggaactcttattagatggaagttgtatgtcctgaatttatcctctaattttcttacctttatctcttcattacctttgacctacattctgggagattgctttaactttatcttgtaactcttaccaaagagttttttttcccctgtgacactttaaaagcccagtagctgtttcttatttttgttctgttcttttatttttcagttctttcttcctaattgagtactttggccctgtctttcatactggtggctttcctgcaatggcaggagatctgcagccatcaggtcacatacatgaacaaggctctgaagagctgacaggataacttccgtgggtggcccaggctcatctggtagtggcccccccatcaggtcacagacatgaataaggctctgaagagctgacaggacaccttctgtgggtggccccggctcgtctggtagtggccccccactgcagagtggcctaggatcacagatctgttcacttggaggatcctcagatgtcagcatctggaagcttttcccttgggctggccagaatctccataatagaaccacccagacttgttcctggggctgtgcacctgctgcaggtgttgtgggagccaagtttggagtgggaaacagaaagatctcattgtgggtgttgactttcactcaattctctcttttcagactcacgtttacccatgcaccaccctcaccaccctgcaagccctccctatttgagtccctagttcctgaggatccctctttcagtttctctagaaaaagaaattcctcctgtcctgccctgggtgtgctgagtgggaaggagggaataaggaagattctctttgccctggaggaagtccatgacacttccaattcctcctccaattcctcagcttttctgaggggctccgtgcaaattggcttgctttttcttggttttgctctttgagatttgtaactttctttgtgctaataggttagtaataacttgtcaattcactttccatcttccagaagactgttaacatttatttctacctctccatttctctgtgtccttgtggaactttactttttaaaaaaacttaattactttcattatgttggaggttgggaagggagtagagatgaacatcacgttgacacaaccatatttgatggaagtccgattagatcaccattggaaatatttgtttcttagagtttgcttcattttcctgttaggctggaggatcccatgatatttgtctcagaataacgggagggttcacttttcattctgtttgagctttcctggtgtatacctttcttcctttcctcttaggatcgtaagtcctgaacaatcttgttctagctcttttctcctcttatcttcatctgtaaatgaaaggggctgagagctggtttcaggcaggaactagatctgacatttaggaaatctcctgttcaggtagcttctcttggccttttcctttcagtgatattttctgaaaacctgacttgccatactgatttaaatgcctgataccagtgtaaggtatagatgtgacttctcctaggaacatagataaagctttgggggtgaaattgacaatagagtgtgtctcctttctctctttagccagtgggaaggttgggtgacttggggctgcaggattccgggaggcctccgtatcgtatgctgcctgtccttagagtccatccagacctgagggctacttagctgaattgtttagtaaacgacgtgggattcagctgcatcatctctatgaagactctcatgttgacttatcattacaaagggctgatggtggcagtggttctaaaccttgacaagtgaacggtttctgcaggaaggctctttggaagactgtgacatcacagacaagacaaggaatatcattagtgaggtcattttaaaattctcagatcttggacttgctctgggcagtgactttgccagcaagttggaagagggcacaagaagtgtgctcatcaaatttgtggcagacacaaaactggaaaggatggccaatgtaatcgatgacaaaaacaaaaatatgtctcaaaatgatatagatatgctggaatgctgggttaaaaataacacaatgacatttcaaagggataaatgtaaaatcttattttggaataaaaaaatcaacgatacataatggtgggagaaaaaaatctactggcagtagttctggtagagaaagacactgaagttttatttgactaaaagctcagtataagccactaaatctgactgaggcaactaaaaagctgcattaatggaacgttaatgtattgaactcaggaagtaacacccctcttcaatggttggactgcacctggcgcctcatgtttgcccagagaagggcaattagcaggtgcctgagggtctggaagcatgtctcaggagaaaccatggaaggaactgagtatattcagatggaaaagaaaactgtcttctccttattagctgtgaaactttaggcaagttaccctggaagcccctgtagcctcttgggtaaaatgtggaaggagaccatttctctgtggtataggtagggggcagaaagaaggaagtactggaggaagagattggagaggtaggaggtggggatgggattgagaacatattcatagctcagggtaaggcattcacagtttatcctgagctgcaggaaaataatatgggcactgtattatctttcaaaccaggacattcagagtgaaagccaggcttattcaataaaacaggacaaaaggtaccaactagggctgttgcaggtaccctagacaaaccaggaggaaaggccatactgccgaagagcactgtcagtagaggacatctgccttttggggtggtgagtggtctgcctttggaggcatctaagcagggcttgaatgaacttctcttgtggaccagcacaagagaagtcgggtggaaatgaacgaaatgaactttcagatccttattgagtactgctacaagggatgctatgttagagaatatatgaaacaaattaaacaggagccatcctggctctctgcaaattcttttagatgtgtatatttggcaaaaagagggcagaaaaaggaactctgaccctttctcaatgtaaaagttccttctgaaggatgaaattaacttaaaggttcagaatctgttcacctggaacaataattctggtgtgctcaggaagctttttaaaaacacagcttcccagggtgccaccctggacaaagagtcagaggaggggaggggcactttaaggaatatgatctgtcctagggcaacaccgttcacatctagggtgagcatccacctactgcatatttagtaaatattcgtgggctctgggcctagatctgtgatagtgtctgatcaaagtccatgtgggagccatcacttgacacttttaggggcttaaaataaatgttgtgacaatatgcaaacactgaacaaatgccaaagcaggtagacgacctgtcccttatttagcggtctgtttttcaggcctagactaccctatccttactggttagaagtattacagcatgctttgctaattattacaagagactgaaaattgctctatgtggaggttgagaccttattggagacttggagcagacaggcatggcctgaaattctctctggatgaggaaggtgtaaggaaacactggcctgagctacatgagtcaaaactttttagcccagatgaattacattctagatacagagagaagctatagaattactgtttagaatctttggagaatcgtggataataaatgggacaggagctggaaagctgagataggcaaacattttctaagttttcaaaaatgaggatactttggatttcacacactgtagatgagagaatctgacataatttccataaaacattcttgaacaggttatgaaacaagcagtttgggagtcgttggacaggagatgagtgatccctaaatgcaaacactggcccactgagaatgttaagccaaagcagcatgatttctttttaggaaaattaaagttgcaaagccttaaatagagcaaatacagcagatgtggcatatctaggatcctgcgagacatttgaggtgtgtgtcagttcacacccgtagcttcctggacaaggctggtgcatataaactgtataataggacagtcagatagtcagatagcatcattcttgtttgaatggcctctccagtatttcacaggcaggcagacatttgacggtagtcattctgttgcctataaaaatataaaagtgtccagtcctttgcagtccttaccataccacttgagtgaatgagtacctaaccagagagaattctcatgtggactctgtaccttggcccctgatttgaaacttttcatcagcaatttagatgagaataaagagaacatggaaatcaaaatgctaagtgatatgaaattgggagggaaaatgaatactttggatgaggccataaggttttgaacagatatgaatagctggacaatggagctaaagcctactggaatcattctttgtcactcagtccacaatattaaattccctatttgtctggaacaggctaggtgctgagatcaggagatgtgcacgccatagcaaggagagcaggaggcagacgtatcctgtaatactttggtggaggtcagccccggatgctataggagcacacaatgaaccagatctcatgaaagcttgaggtgggtaagggcttggggagagctattgaaccgagcaaggagatcagatatctggagaaggtgatacttgaatggttttgaaaaaaaggagttagctgtgatccatgctggggtgagggtgttccacattcaggcagcaactataatgatgtcataaccaggacctgggtgtgagacaacatggaaaaccaatttgcaatgctcatcaatggcagagaactggaagagagagaggtgttacatatttttctcactttagcgttccctgctgctggagtatagaatgtgagaaagactctagggatactctaaaaaggagcagttgtaacataaagggcatgctcttttatcttagaggccagcattttccaaacttacctgatcattagaatcacttggtccttgttacaaatgttctcaggccactttcttggcaaatctgatttcaggtgtgtcagagtgtttcccaggaatctattaagaagatcgctagttaagtttgggatatactgttatagacatggggaactattggagatttaatatcgggaatgaactggtcacattggcattaaagtgggctgttctggctaccgtatacggaatgatttgagaggggtaaatacatttgacactctaggccagaaataatgagaaataattaagaaaatcagtaatagtagacagctgttggcttgagagagactgaagtggaaccaagtgggtttaattactacctggacttagaaaatgagggatgaggacgaggtgattgacggcaccagttttcaggcttgggcttttaggtggtgccatttattgggatagaatcttgcttcggtcaagttgagtttaggctgcctgtgagacattgaggtggagatatacagtaggcagatgtatgggtctggagtctaggagagaagtctggaggaacatagagatttgtgggcccaccatctactgtggtagttaaagccttgggtataactcagattgcttagtgagaatgtttagttgagaggaacagatggtccagaacaggaatctgtggaccattctatgaaagaaagctaatgaggctttcaaatgggagcccaagggggaaaatacagggaaagaagaagaaagaggagaacatggtgaagagtatcaagaggaagagatcgctgagtgctgctgagggattcaggtaagaaaatagtcattaatgatttctgtgtactttctttgagtgagcactgctgtggttgttttacaaatgttgtcttatttaatcaccacaataaccaggtgaggtagcccctgctatttacgtcaaggaaacatggggaaactgaggcagcagaaagggtaaataacttgaccaaaggcacaaagttgataaatgccagggccaagatttgaacataaatgaaaggatgccgaagtcctgtgtgttgaccaccacaatcacttgttaggaaacacagtggcaaaaaggctacaaagggcttgcagaatttaacaacagggaagttcttcataaccttggctctggcatggtcctgaagcaaaccaccgtgcagtggcttgaaggcaaaacaaagaaacagacagaaaggggagatgactttccaaaaaggtgagttgctggttatcaaagggtaatacgggccaactagggatgtcgttttaagatgggaaattgtgtttcgatgctgagaggaaagagtaggtagagagaaattggtttaagattcaagagaggaaattttggttgaattaagatctctaaggaggcatgggagaacagagtgcagaacagcctaaagggaattgcctggactagagatggaaatgtcgtccctctggactggaaggaaggagggatatgacataaggatgcaagaggaggggaaggattacctctttgaagcaggatgtaaggtcttattctgaggggtggcttgttgggtgaagtggtattagtggacctcagcagacccatctaataactttagccatcagcttctttttgccaaccgaaatggttcctattggacttcccccttctggctctcctctctccctttctcctccatttctggagcctgtgtagaaccttcattttcaatcactgcttgttgctgtcatgagtggtgcttttccattcgggaacagaaaagaaaccctcccgataaaatccagtagactagagtggggtagggggaaggaacagtgattgctgttctttccttttatccctcagggaaagaaggggacgaagatggggcgggagggaagtagtgaaggccacagaggtaggaagaaccaggaggtgggctggagcagagccagcttgtttagcaagcaaagcagataaagattagagtaaccatgacaacaggctactggcaaaggcgctcagcatttggggaggagagagggaggtggaatggcttggctgggtataagcccagagttttggaaaatgccgtttcttcccgcagggctcttggttgttagagaaatcaccatagtcaccaacagtgagtgcaagggaaagaaaggagagggcccgcaggaaagattagtaggtgaggtgggctctgctgattcaaagaaagagggagtgactcctctgtgactggaggcacagaagaggattaggaggattccctgtcgattgcctcaattgcctcagtctatctgtgtgtctcagggtacatatatttttctgtttagctctattttctcactcacgctatggtagcaaaggcgccacaactagtatgcctttttgtttctagtttttcaggataccacattttttacttctggagaatgaggcatgagaatatcaagactctgtttttttttctgaggatgctcaaaatgtgtgtgagggagggagggacgaaaaggaggagagagaaacagagaaagaaagggagaatgagttcatcttggtgtaaactcttcacccagcctaggcctgtaattagttaagaatttcttggaaatctttttcccttgttctattgccacccacttctatagctgcttgagaatctctatcaataagaatgtagaagggctgggcatggtggcttacgcctgtaatcctagcactttgggaggctgaggcgggcagatcacctgaggtcaggagttcgagacgagcctggccaacatggtgaaaccccgtctctactaaaaatacaaaaattagccaggcgtggtggcaggcgcctgtaatcccagctactcgggaggctgaggcaagagaatcgtttgaacctgggaggcggaggttgcagtgagctgagatcgcgccatcgcactccagcctgggggacaagagtgagacttcatctcaaaaaaataaagaaaaaaaaaaaagaatgtagagcagccatagaaaataatgaaattatgtcatttgcagcaaaatggatggagctggaggccattgtctcagtgaactaagataactaagtgaactaagaaatagaaaatcaaatattgtgtgttgtcacttataagtaggcgctaaacagtggatacacatggacataaacatgaaagtaatagacactgagagctccaaaagctgagggagtaggagagggagggggttgaaaaattacctgttgggtacaatgttcactgtttgggtaatgagtatacttgaagcccaatccccaccagtatgccatgtacccatgtaacaagcatgcgcatgtatcccctgcatctaaaataaaatttaaaaaatttaagaagaatatacatacttttaacatctgtgaatatagttgttcctttgtgagtaagcccaaagcgcctatatgggaaaagtaaaaaaatggtatgattacaaacaaatggtgctttaggtttgagtatctatctcctgataacacccagtgtgatcttgcccaaaaaagcaccagcactgttggggaaggacatatcacactcttccttagtctgatacgtcagactgagatatatatatatataattttatttatttattattatttttgagacggagtcttgctctgtcacttagacttgagtgcagtggtgcaaccttggctcactgcaacctctgcttcccaggttcaagtggttctcctacctcagcctcccgagtagctgggattacaggcactcaccatcatgcccggctaatttttatatttttagtagagatggggtttcatcgtgttggccaggctagtctcaaactcctgacctcaagtgatccatccaccttggcttcccaaaatgctgggattacaggtgtaagccaccgcacatggcctctgagatatgtttttaatataaagtgtatcacaagcatggctttgagaggagagtccactcccttccttttctaccagactactacttcgttgcctacagaaatggatgctggagctaccacttgggccaggacctgagtcccagaatgagcccatagctcacccaggggctcatagaaccccactggttccataagtgtgggtgtttcagatatcattgctgagacttctccgttttgattgaggaggaggtagtaaagtggattcatttccatttccaaatctctttccttccaaataagcatgtatagcccaagatattggaaaaagaaggttcttttgcacaaaggaaacttaaaccaggagatacaggacttgagcttggttctaaactgtcataaatagctgtgaaaagagaaaacattaagaagactgatttccccagggtgcagaggggaacaagctctctcaaagttggaaagagtgttacgattctccaatttcgctatatgtcttaaactactttttagagaaatatctacttctgccaggtggatatagttatcttgttcttctcagctacgttctaattcatgaacacatagatttggccagcagtgatgtcaagtgcccagtgccttggggaaccggcttggcattgagattttattggttaagagagagatttcctgaaccaatattgagctgtttgccaggttctggcttgagtaatttttttttctaataggaagtagaggtggagggacaggtgttgagggtcagataatgggtacggttttagacattttgaatatgagccattcccttccagcgggtcaggagaatggtctctgacagggagagaatgttgggactccttaccgtatgggactagctggggcatgaaagtggatgacttctagggaaatcacatggagaggaagaggggctgaacacagaatcccagctgacaccaacggttaagaaatgggaagatgagaagcctgggaaggagagggtgtaggaaaactgggaatgaatcatacacaaaagttagattaagaaagagtggtaaagagaaggaagtggttaccagtgtctgtggctgaagagcaggactgagaaatactaaggggttctgtctccatggggatggtattgctgactctggggagagatttttcctgaagtggggtgggggaagcccgatgacccaggtttaagaagtggatgcagcgttaagtggagcagaacatagtgttggtacccagggcaccagtggtgctttgaaaagtcaggggcggctttcatgcctttattttggagaggattaaaaaaaaaatcctggagaatgtttactgagaaattccagagaagaaacaaatacaaaaaggaaatattaaaaaatataaccaaacagttatataccccaaacacatccaaaatatatggaacccacatggttgagagaagaaggcagataaatatatctggatgagaaattgaaaattaaattgtgggtaggtattagtggtccttgtgtggttaggagagggctttggaatggaagggcaagggaaatgtgttgggcagttagtcttaggaacccagtactaatcaactcttaaatctacacaatgtagtctctgaggcaagttcattttaaaattggaactaattttttttttaaacccacaagtcaaaatacttagtcttttagatcgtagatatggatgaagttaaatagctctttaagaacagcactgcatggaaaataactaggtttactagctaagtttagcatataaagctctttactgaatggcttctttgtcaaccccaggctggaggagttcaattcctttttatttggtgaattccttaattggattttgtttgccgatcttactttctcacattgtaagattttaataaatcattataatcattccctcatgtcttacaaaaataacctttctgacggttcccgaatgactttttttcttctgtgtttgcatcatgggattattagtgtagcttacaaatgaatcagaaaagggctgtgcagctgagggtatatttccattattttctaggtgtgaacttggagcctgataacaaggaacctgtgaggtcacgcttggctgggagggcacagcaggtcttggcatattatctcctgtctggattattgatgagatccactgcttggaaacaggagagagatctcctatctgcttggttattaaagcctctgcaggaaacaggtttattggtgatgtatgtacactggggcttctgttgcattctcagctcagattcttctgtgtctgttactgttgatgactgcataaggaagaacttattttgttcaactgacgtgtttgttgaatgtctggctcaaaatatacctctcctaagaacttccatgactgaccttttgcaaggctgaaggacatgcttggttacccattaggaactggaccaggaacccaagtctttttctttcaattttcagagttttgcagtttgctctttggcttgtggatgccaacacttagagtttatatagtcagtttctgcgatcctgagatgtatttttttttgcaattgcagttggttgtttctcctcctacagtttgtttagcctcttcctcatccattatcctccaggctgtatctgaagtgggcataggaggagtgcccttcccatgacctgcacaatgttcacagcccctttcctgttggtggggcttttggagaagttggggttcccttgggggattggcagttacaagatttttcagatgaggactgtggtttatttggcaattcaatgccctaagagacttaagagcattcaggtcgatttgtttccactttgttccacgtgtgagtgaccaaggcaaagatctcaatctagacctagaagcaatttttaagcctgaaaagctcacttgtctcgattctctgtttctccctcctccctctgcccttaaactaaagtcaaccatcttgaggccatgtgaaaaaataggcttggatggaaaggtgcacccttaatctaatctttgccatggattggccccctcgtttggtggggaactcttcatgggacatgttgaaaaagacctcacatctttatcattttttaattcatgtttcttaccatattgaattggtttttgccacttgtaacaaaaggattcctgatgaatgcctcctgtgtttggagtcttattttattcttcctctctgtagctgcagggtctaatatatacctaatttataatctgtgtaggtgccaattacatatgtaattgtgtgagcatatgtatataaaaacttagaagcagatatgcccctgagagcaaaataaagaataaagttcctaaaacatacagagaaaaagataatgtaggagaaagaaagcagacgttttaaagtatgcgttgtttgagcttttatgcgtctgtcaaacaaccctgaaagttccatcacgtgtgatattttaaattttgctcccaaatggagaaaggcatcttcccacccctctgctgtgagtcaaaccactcaagcagggctgtggctgtcagtgtgaagccagctcttccaaggacccaggggaagctgccatcgctgccgtttctgcctctgcctttctttgctcaaaagttggcaaatgctggtcatgtcgtggatctatttatagtaggcacacgtctacccaccttgttcttttcttagcatcaacttgacatgctatcaattatccatgaggtgaatgacaacacaagggaagttatttgaggcaggtgccctgaggtgagagatgagggggtggcagaggtcgcacagtgacagctccgaatgaaaagggtaaaacaaacgtcccttgctgcatctggctggtgaatgattgcagacaggttggtgggaaaccctgagctggtcacgcagcagtctcccactgcccttcttccctgtgcctgctgatgtttgaaaagcccatttgaaacagacaaggggcaggacctgaagatgtgatctccctccagtggaggtcatttttgttattctcttaagccacaggaggggaggacacaaggacctcctggggacagggggtggatgtggcagaggctgatactcttcctccacgtaggagcatttctggtgggagtgaagcagccaccgggggatgaaaacagggtgccccattcctcactgcctttgaaccagcagggaggctattcctggcagcagcagtgcacctgcccctggcccacagtgcctcccaccttctttacataaccccccatgacccctcttggattctagactaccctgtttttgctcctcctcactgacaacatagttcccagttaggggaactactacttcttcttctcctccccctccacgctcctcctcctcctcctcttttttaatgttgtaatagaaacattgattgcccatttcagtgggactggctaccctggtgtcctttttttatttatatgccattaatttggggctgctctgtaggagctggtggcatttactctcaaagctgctctaacgatgatgctgatgttattgttttagctccaggaattgaattgctcatggcaatagaggcgacttctgctttgtctgtagcctcatagatcacccctcctgtctatgtcctctgtccaccttggattttgaatgtgaagagagagagaaagattgaattatggtcaaagagagtggaaagcaaattaattaaacctctatcagccttgccttcagatataaactgactcagactttacaacccgttcctctctaagtttgctcaactcccctcctcctgctcccactctgttccgttcctttgggcaatgaggtactaaactacctctgtgataaatgtgtgtgttgattccttagggatagagcggctgtgccctgaaaggccttggaaccctcgcaaaattcctaaatacatgtggtgggcactccagcagttgctggcagactctcccagggatcccggctgagtttaatactgtctgccaggctaatccactttccggggcagtgtctagcaccagagactctctgtctggaagtatcctggccatttaaatgactccaggttcctggggatcagtttgcagcctttgttatcttttggcagagccaccttgcttttcctttctcatcttctctgtagtcagaccactcaagtgtaactttgtttattatttagggacctcatggggagaagttgagatgattatcctgagtacagaatagccaacttccaagtgggtattgtgggtgtgcgtgtgtgtgtgtgtgtgtgtatgtacattcgtatgtactagcatgcactagtaacacgtgtatgtttgtgagtgatactggctgtctaggaaggatgagtagggtttggatgaatctcttttgcaggaaccaaaacaggtgcaaaatacccgtgtcagagtcctcagatggctggtgagtggaggtgtagcaggacaagccgcagacaaaacccctcagacactgagttaaagaaggaagggctttattcggccgggagcttcggcaagactcacatctccaaaaaccaagctccccaagtgagcgattcctgttccttttaagggcttacaactctaagggggtccatgtgagagggtcgtgatcgattgagcaagcaggggttatgtgactgggggctgcaagcactggtaatcagaatggaacagaacaggacagggattttcacaatgcttttccatacaatgtctggaatctacagataacataacccgttaggtcaggggtcaatctgtaaccaggcccaaggtgcggcgctgggctatctgcctgtggatttcatttctgccttttagtttttacttcttctttctttggaggcagaaattgggcataagacaatatgaggggtggtctcctcccttagcggaattccgtacattttgttctaagttataaccaaaaaactgaagtttataaatatgaggccttccttttccctctttgtagactaaagtttgtgaaccaggaccccctatcgatacctttttagggattgtgagatctgactttttttttttgtattgttgattttgctatttctcagggatgggagttcaccacccacacttttgtgctgttactatttgaccacctcttcctctttgctccccccacaacttttattatccagggagaaatcttttggaataggatagaagaggtttctggggataagttttggaaataggcaaatttttagtctgaaggacattgtagtaggatttatgattctgaaatgtagtgattgtatgtagttatgtatttgggtacacagccttatgtacattgcgttaaatacatttaaataattggataatgcctagacataattaataaagtgatgctgctttgtttcttttgttattatcatgttattattattttatatcatcttatgcttgctttttggttctgaggttgattgcaagggttagaaaatgacagcgtacaggtcaatttttgtaaataaagttttattggaatgcaggctggctcacttgtttatatattgtctatagttgcttttgtgttacaatagcacaggaaagtagttgtgacacagattacctggccaacaaagcttaaaatatttagtatttggcctttcgatacaggtttccaccctcaggtttaatttagtcttttcctttacatactttcaaaagtgctagaacaatgctttagaaagtgctagtgtctttaatggaagaatgagtcattatctatactcaagcatattctaaaccaatcagaagagcttgagagacacgtctgaaacgtgtgtaggaacacatatgataaaaatatatgaaaagatactcagcagatgtttgtcagatgccaccaagtacaaggtagcttttcaggtgctatgagaggtactcggtgaatggaataccatcttattctcagagagttaactgcccaataggaggaatctgctaacataacagagatgtctgatagtggctatagacaatatacatttttataaaactgaaaggaggtagaatggcttttgtagccaagtctatgtgtagaaaatttggaatggaaattaagaaactgtagtgatgactgctgcttctaacagtaaaggaaatatttatgtgtatcttccagatgtttactgaagtagaaccttagtaagttatttgacatgaagcccaaagttataatagacacaaagatgcttcatttcaagccttagataggaacaaaaatatgattgaaaccaaaattagcctagaactagaagtggcctttacagatcatctactaatatcctgctcattttgcagctgaaaagacgggggccgagagatctagttgtataaaattgtctctgaaacctaggacttctgacttccaggtctttactaaattccagtgtaatttttaaaattttcaagccagattctctgtggatgtggagaatatcaacatgaagtcttgcactgccttaaagatcttcattagcatgctattcctttcctttatcttcctgagtccccaaggtcacagatgtaggagtaaagtattgaaaagccattcaggactctgtcttctccccgttgccttgttgaactgcttatgggggtgatgttcaggggctgggctagggcattccactagagtgcccaatatctttatacagatgctgattgctgccctgaatacccacagcaggaatttttttgagagaggaaggtgagtgtgggcaattgggaaaacagcccacaggtaatggagggagggaaccttaagtttccttttaactgccaatcagtaattctttgttcatttattcaagtatttattaagcacctactatgtgccaggctttgttctaggcacttgtgatacaacagcgatctacacaggatcctccccttgagggctttgcattttggtgtgcttcatggtggaggagtgtgtttttcatggtgaagccatttggaatctgccaggttgaagcactgaaccaggagtaggaagacctgcatctaggcctcagcactacctactcaccagctctatagccctgtgcatctcatttctctgcagccgagtcctttcttgttagaaccttcaccctggctcctctacgacaagggtatctttcttctttattctggtgcttgcctccttatctggtttccccacttcttcttgcccttagtttctgctgatatgttcttttgtccagttgcctcttactgggtctccctgatgccagttgtgtgtccctgtgcaggtctctgctctactgtgacaatatgttctgcctgtttgcactttctcagtctttgcacttctgctcctacccaaccccactgagcaggtctagctccatatcctggatcccacccataggcttatccacaccagggagagttccacccctggctatgtctggaatcaggacttgctgcatgttgattcactcattcagcagtatttattgagcaccatttagggatgtgattggaagaagatctagtctcggtgctcatagacctcatgtgaaccaatgaggaatcagaattgaattttgattaaactcagggaccctgattcctcaaaaaaaatgataaatttggagtaaacttcaacaaccctttaagctcaagcactcagtccacaaaatttctctatttcagacatttctccctagcccttaaatcctctgtctacaagctgattgactaatatattcagctaaggttataaaagcaaccagggtttcttaggcagccaaaaagaagtcagagagcgaagaggagagaaaaagccaagaatgccatagatcctggatcaggtgggccagctaggggagcaaggtgggaagtacaagctttttgatgcctgagaccagtggtttgagtggggagcttgcttgggaaaaatcagcagggtccacagaaatgaaaggggatgtctaccaggagcagctaagaagagccgggagggaggtctggggggctcctggtcctcaccttgttttagggtgctgcccttgcctttttcaattaaagaaacagaaacagcagctatttggggttttgagcatggaaaggtggaggacagaggagctgtctgagttatcttaagaatctggttttactgtttattgaaataaaatggtcagagcttgaaggaaaaagtaatttaatttataaatagttgctgatcactcttgtgaatagtatattctgttgtcttcagaaataatcctgtagacatcacctgcatgtcaatatttggttcagaaaatataatcaccagttgctgttattgtctataaggcacgatactaaattatcttgtcatctaactcagtttttatcattatctcttggtaattttattgaaagaaaccagtaacttgtaaatcataaaaagatgaataatcccagttataaattcttttccttaacagatgtctttaagacaatctgacttaagttctcaattctgactaatttttttctaatggtttttagagagctgcatcatgatctgtgtgatgggatatgtttgggaatggtggatttaaaatggatttctgatagtatatgaagggtatatatctttgaaaaaattgaaggcagaaaaatatacagaagaaaataaaagttccccatggcttcctcttttccaagaactaatactagactgtaagaggactgtgaggggcagatacattgtctgttttatgctctgtgcctgtgtcaaaaagtgcttggcaaatagaagggactcaataaatagttgtaggatgaccaaatgaatattttgtgcgtttccttcaaaccttttttctatagatatatgtatgaatactatgtaataatgattacttttatatctttaaataatattctgtatttcagttttatattccgcccccattcttttttttttttctttaaccacaatagatgtgtttatatacataagtttttcgggggatcagaagaaagtataatacaaatagtattatatgtggagtgatttaaaatgttttgtttatattttaatagttagtgactaagaaatttgaagtcagccttcctcctttgccttagtttctcagctacaaaactgtgtttgtagaattagcacttaggtacagagagccaatgttcagggatgataatgataaaatgatgttatatagataggattgagagcttatttactagagtcagaagagcctgaatttgaatcttttccctctcatagtattagattatgtgaccttgggcaagtgaccttggacaagtgtcaacctttataaatcttatttccttgtcgtaaaatgtgtttgcatttgttaggattggctagctagagtgtgttgccataacaagtcctggaatctgatcaatttagcaaaacaaaagaatgtttcttgctcacacaaagtctgagtagagcctggatagtgagtggcagtaggggtttaggttgcctactctttgttgtgctgccatcccatctaaacagatctttaatgtctctgcagcaaaggaaaaggaagcttggtgatggtgttaccagtagaaggtctccaggttcttggtgtcttgaacaaataattggacaaaacacacgtacaaagcaaggaaggaatgaagggttttattgaaaataaaagtacattccacaatgtgggagccggcctgagtataggggctcaaagaccccgttacagaatttttgggagtttacataccccctagaggattccactggttacttcggttatgccttgtgtaaatggagaggatgaggtaaagttacaaagtcatttacggattatgccctatggagagggtattttctgttatagctgaagtgtgaatcggccttatgttccctgcctccagaccctattttcctgcctcaatggcacactagctcttgctgccttgacaatgaagttacacattacatattacttctgctcacattttgttgtgcagatctagtcatatggccacacttgagtacaagggctgaaagtaaactttttaggtgcttaggaagaagaggagacccagaaataggtaagcactagtagtttttacaacagaggtgaataatagtaacttcaatcaaaattggtgtgatctaatcccctacccgcttgtgattaaaaaaaataggattacactttttttaaaaaaacctaaattattaggccaaggagcttcccactagcaaatcgctagaaataaattctcctcaaaatggcttttaatgattttgaggaattcccagggtcctgactcctgggtattttcaaagagatcttttaggtttccccattctagtcccttcatcttgccccaggctaactctgatgttttgagaggacttctttgttgtgcctatctgtcccccattggtggccaatgctctccctagttcttttcaggacacgataaggctgagttgatgagaacatattaaagtcttgaggataaagccagccaaacccaaggaacagcttacacctgataccaggtgggtttggactcacaacctcagatctacacctaaacttcagagtctccttttctgctagttcttagctcggttccatcttttccctgccatagggaataaatcaagcctgtgcatgcttgagcacctagacccaaatggtttgccctatttctaggcttaaaaaacaaacaaacaaacaaacaaacaaacaacatctctggattacttcctcccaggatggctgccagtgggaaattcattttcctccagaagagatttcacagtgtggcttggctccctgtctctgaatatgtaatgcgacgcttgacagcactttactctaaatctagattattcatgcgcaaatcatgccaccatggggaccaatagcctatccagattgtgctttgtcaagtttgtatcaccttcatgtgacttttcttccagcagttgatgagggaaaatagggctttacctctctcttgatattctaggtccagctccatcacccaaaagcagatgcctggacaacttaagcacagtctctccagaacaatccagaatgtcaagcattgatcaattttaatttaagctttgggaaccaaaccaaaccaaaaaaacctccaaaacaaaaacaagaaacacccctatctctgcacatacagttctgttagtgcagccaattccatcgttaaatagatacagtatccccccttggaaagccccccagtagatgcctgaaactgtgaattgaaccaaacttgattcccatcaattgtagcacatttctgtttgtctcttccaccgacaaatttaatgccttttccatcttaactaagcacttgtcatagactgtggccataatttttgcaatttgaggtgcaacagtaaatctagaacgaatttatttttccttcttcacgttttcaccaatgaaattggtcttactgtagatcttagtaacctcagcatatgtttttttttctatcctttttaagctgagaactctcatctattcactgaaagaaagcactttatggcttctctttggcatatctgagttgccaccatcactactcttgcattttggaaccattattaagtaaaacaagggttacttgaacacaagcactgggatattgtggtagttgatctgataattgagcccactactgagtgactgagggacaggtagcactgacagcatggataccgtggacaaagggaggattcactgcctgagcagaatggagcaggacagtgtgaaattttatcatgctagtcatagtgatgcataattgaaaacttgctgtttatttctggaattttccatttaatatttttggactgcagttgactgggtgtagtaactaaaaccttggaaaacatgtctgaataaggggggactactgcatttaatgtgtttgtctgaaggttttatactgggtgatttctttggacgtagtcttccccaaggaggagagagaggtactcactgccttccatctacataaacaaaggggtcatcaaagtaatcctttccataacaccggctagtttgtatctaacaacaaaacaaatacattcttcactttataaggcagaaacccacaaacggatgtttttacagctgcactacattttttttatttttatttttaaaatattattttagattcagggggcacgtgtatagatttgttacatgggtatattgcgtgatgctgagatttgggcttctaatgatcctgtcatccaagtagtgaacatagtacccttatcttgttccagttattagggggaatgcttccaacttttgcacattcagcatgatgttggctgtgagtttgtcatatagggctcttattattttcagatatttttcttgatacctaatttgttgagggtttatatcataaacggatgttggattttattgaatgctttttctgcatctactgagatgatcacatggttttgtttttaattctatttatgtggtaaatcacgcttattaattttcatatattgaaccatccttgcatcccaggattaaagctgactttatcatggtgaattcactttttgatatgctgctggattcagtttgctagtgttttattgaggatatttgcttctatgttcatcagggatattggcctatagttttattttcttggtgtgtctttatcagattttggtatcaggatgatactggttttgtagaatgagttaggaggagaccctccttgatttttttggaagagtatcagtaggattggtagcagctctcctttgtatatctggtagaatttggttgtaaatccatgtggtcccaggtttttttggatggtatatgtctatatttttttaattactgattcagtttctttacatgttattggtctgttcaggatctctgcttctgcctggttcaatcttcagaggttgtgtgcttttaggaatttattcattctctcaagattctctagtctgtgtgcatagagatattcacagtaatttctgataatcttttgtatttctgtgggatcggttgtgatatctttgtcatttctgattgtgcttatttggatcttctctttttctttgttaatctaggtagcagtccattaatcttatttatcctttcaaagaaccaattatctgtttttttgaccctttgtatggtttttgggtctcaatatcatttagttctactctgcttttagttatttctcttcttctactagctttgggattagttttttttttttttcttttttgagatggagtctcactctgtcacccaggctggagtgcagtggtgctatctcggctcactgcaacctctgcctcccgagttcacaccattctcctgcctcagcctcccgagtagctgggactacaggcgcctgccaccacgcccagctaattttttgtatttttagcagagacggggtttcactgtgttagccaggatggtcttgatctcctgacctcatgatccacctgcctcggcctcccaaagtgctgggattacaggtgtcagccaccgcgcccggccaagattagtttgttcttgtttttctagttcctttatgtgtgaagtttagattgttaatttaggacttttctatcttcttgatgtagacgttttggtatgttgtgtttctgttttcatttgtttcaaataattttttgatttttgccttaattttttgttgtttacccaaaagtcattcatgtgcaagttgtttagtttacatatatttttatggttttgaaggttcctcttagtgttgatttctatttttaatccctctatggtccaagaagatgctttgtataatttctactttttaaaaattgattgagacttgttttatgatcaagcatgtggtactttttacagtatgctccatgtgcagatgagaagaatgtattttctttggctgctggatgaagtatcctgtagatgtcaattagatccagttggttcagtgtccaatttaagtccagaatttctgtgccagttttctgcctcagtgatctgtctaatactgtcaatgtgttagaggtcccctactgttatcgtgtgtctgtcaaagtcttttcttaggtctaaaagtaattgttgtataaatctgggtcctccaatgttgggtacgtatatatttaggatatttaagtcttcttgttgaattgaattctttatcattatgtagtgtccttctttgtccttttttactcttgttggtttaaagtctattttatgtgactcaagattagcgactcctgctcttttttgttttctatttgtgacttcactataattttaaagcccagttcccactagaacttcgttttgttagatgctttgactgtaataaaacagccttcgatttttccatttttatctttttattcattatcttttgtaataaattccattatgcataaaattttagtggttacttctgggatcaagcctgttaacccactcacacaattaaattttcctttctgactttattttttttcccccggtagctgagtacctttcttgatgtaacattgagtaaaacattggctatttatacatctaggctttcattctcataagtgtgtgttttaagcatgggtattaatttcattatgtgggtccaaacctgtctctgacttggaaatgacttacgggtgcacatgggtctgcatattaaggtctcttgtggctgtgggagtgagtgggagtgacgggagctactgtgggcattcttgtgtacatctggccatagcagtgggtcccaggctagatcactggcacttctttaattaaggctctgtttctgcccagagcaaatttgaggttctctgcttcttttcctattgcagaaggggccctacctaggaaggattttgaagttctgtttcttcctttattttttttttatccttttggatgtaacagcgcaccaaccactgccagagctgacagaattggaatggaagtaggtgggtgggggttgggggtggaaggagggatggcagtcatcagtttgggaacaacctctgagccaaagaaatgcctttggcatatgagaacagtgtgagtttatctcttttcctgtttggaagaaggtacactataaatccgactctacccaggaactgtttatgggagatcgttattaaagaatagatatttgatttttccattggtttggagaaactaggagtcaggcactaaggacgtgctgtgtactcataacttttctccagctatccataaggctaatatacatttttgacaggaatttttttaagtaagaatttttttttacattgtatttatagatgtaaaagcactgagagcttcattactagaaagcagcccctatggttttcagcattgctagaatcaagagatgatattcttgttgactgttgaccatgcttttccagatcacccactgttgcacattcatgaaattggagtgagcatacaaatttgttgagagaattatcttaactagattcaacctctgtgcccatgaggtactgtcattctcagtgattcaaatagatatttgggtacaggtggtcatgtttggcgagctggtttctgtgcagattcagcacctgtggtttgtttcatcttatcgttcagacacagatgctcttagagcaccacaccatgcattccaatgaaatctttccactgaaaccataacctctgtgatcctaaaaggaaggagtcagtgtacagagggacatgacatattcaaaatcagaagttgggataagccagaaggaaccttgtgggattaattttcttctttaagtgtgggtaatgtttttcgcatgccctcttttcaaacctcagcacttcacttgtccatctgcattttctccaagtattgtaaatgtcaggtttgtgtgaagaggcatctgtaaaactgctggcatgaataatgactctgatgtttatgtacggaagagcgcacctgactttagcactcttattatcttttactaattaaaatcaagaagatgtttcagctagacattgcctgtgcatagcacctgctggattgcttttctccttttggtgtttctggtttggtggaaaggcaagaaaggtgagctgaatgacttggagcaaggaacagtggtgatgtcccatcactctcggacaagcactccttagcctatttaaatttatttttctagttctcaaaataataaaaaaaaaattaagacttagccaccctttttatcagtgaggaaattcaggctcagagaggtgagctcatttacctagttactcagcgtgtgacaggattaggatttggacccagagtcacttctgaagcttgttctacttccaatcttataattaccttaaaaatagggtgtggctgtatagaccagcttttgcatgagaaaagcctcattgttcatgaatttagtttatattggatggttattttaaattatagtcatgtgctgagcattatgtcaccagcaaatcatagccgttttccagagatatttccctggttaaatattcacatgacatttgaacatactgaacagccaagcatgttgcttagttgttatggttgtttttgtgcggggatatcgggtaggggaggggattaaaagtattgggctggtctggctaatttctagtctccatttcttgcagacgacctctgattctctggttttgaagtagggaagtgtgactgtggtgaatcccaagaaacagcttgatagctttacaccatacacctgccattgctgacatactttggaggggactgaagtggagatgcaaagcagtcaggctgtaggccccagggagcttatgaatctgacctcaggggtcctccctgtagagattcctcacaccaaacatctgaactcatgtcaggcagtactgttttaacctcactttttgcccagaatgatgggaataaaatcaaaattgacagacagaggaagctggtctttcctccagaattgataaaccaagatactttaaacttattcccaagaatgtggatttctgcatgtatgtatctcttcaaggttgcataaatggaatttgtgcttcaatttgtcagaatcctgaatttccaaatcctgatgtaaggatttaagtaggagagatacctggatttgaattgttgtgaaatacagtggtaggttgactagctttattccaacagagtgaggttgatagtctttgttgccatgagatgcttcaccttttcccctaccaaccttcaaagacatggtggagcggaatcactgggcaacaccagtgggaatagttcaaccaacagtagttctcacttagcagagacagacctcaggttcaaccttttcttgactgccatttcgattctgcaagtggcaaaaataaactggaaagtggatgatcactctcatatgctctattgacaaataagaaaaacagggaccaaaaacaactttctctgggcagtctggggaataaaagctgctgggaggatctagtgtacacatgcgtgtagcactttttacattcgctaaacccttttatagttactctgtcattggccattctgactatgttgtgtgcagggcaaatgagttttgttcttcccattggagaaaggctatctaaggaagacccatgggaaattagcaagtaagccagggctggagttcccagagaggccctgcatgaggtcccataggaagccgctaggatctcgaggtctagtcgttatttttcctctttggcagattacaccgtaactctgaaagagccagggaagcctaggttgtttgttctttagagtttttaacatggaaggaggtttagaatttattttgcccgtcttttcattttagagatgaggaaaatgagacccagggagatgtgatttcacaggtcaaatagtcctatgacactgggtagacaataggatacctgatgtgaatgttgaaaaatgtgccgtaggagaaaacagccctttaggcacttgacttggcaagctgaggttacttggtgcaaaggaagagatgcccttctttcaggtggatgtagatccatgctgagacacgtggctcagagtgctgagcatgggctggatttcagctcctgatccctctattttcagtccacaaactgcatactctgtgaagtggctctgcatggttttgctggttcacttaaaacatatttggataaaaaacatgactgaatgagggagtcagcttttcattaggtagaggaggtgtccatatgtctagtaattgccctcatttggcacaaatcaacgagacctgagggatgagggatgaatctgtgtcttcttttttatggttatgggcatgaacagttaggatgaaaccagacctgcgtgttctggtttggctgatgatggatactttcaaaattgtatcaaagaaaatagacaatggaagtctggcagactttacaatgagtatctagtaaatcggatatgaaaaggaaagggggggggggaacctcatcttctctgtgaatttctaaaaaagtgttcacataagacagggctagatagtttgaaggatattttccaagcccaaaactgtacaagaggaagttttctctgggagctggaatttgaatggacaaagtcaggttggtctcagtggttaatgcttaaagtttataaacacatctttttgtttttagcacatcctacaaatgcagtttattaatatggcattttatattgaaaggtaaatatcaccataccattgtgaataattctttggtagtgaaaatagccctatcttacagtgactagatccttcttataaatgctcttcaggtagcccaaagttctcctttgtataacccattataattagattatacatataattgtgtagaggtatgtatttaatatgtgtctctcctagtagcttggagtcagtatagcacagcagctaagggtccagccctcgagatctgctttcaaattctacttttgtcacttagtatctacattacaccgattaacttaatcagtgtcatgtggtcctgctaactgcattaatttgtctgtatttcattccgcatctacaaaatggtaataaacataggacatattttatagggctatatattgaatgtattaaatgagaaaatccttgagtattgcttagcactgtgcctagaacatgaaaactcttaataaagcttggctattagtcttgctaaacggtaaagactgtttctgtcttatcccttgtgttatccccagttctttgcacagaacttgtggcacgcagattaatcatagaaattattgaataaattaatggtcccatttttttcctagctccactgtggtgaagtctcagattcccaaggatgtggttgtgtgcagataggttccatgtggccagggctcttgttcagtttagtgtatttattctgccacactttgcttaattccagattgatttgcttttatatgaagatagtaatatatgggaggcattgattcttagcttcttaaaaactgacagctaatgtttagaggcatttcaaaatacagtatctaaataatatgtagggaaacaggagatgtaatttgggttgataggaaatgccttgggctcaagtaagaggttctgggttccattccgaagtctatcagagatgagctttcatgtcacctgcttaaacttaactttttttttttttaataaaacgaagggactaaagtccattatcatcaaggtttttgcttgtgtttgtattttatgacagtaagatgttagttacttttattaattccttaaatgcatggaacagatttgcctttatattatgaatagaatgcagattcaatttctgcaaataatgtttctttgtattccagggaaacttgctgttgaaagttctccttccatgagtatttcttgtaaatcaagaatcttttctaatacaaatagttatctcatgtttctgctttgaaaatttgtatgtattttttttttttttttttttttggtgaaatgaggcatatttgaatgctttgaagtaaaactaataccatttagtgagtatgcacagacccagcatagggaactaagtatttcaatgtttatgattttaaaacactgtcatatttcgtgctgtccaatcacgtttagctttaatagttttccgtccaatttttcggaacccaccagacttgatttttaagagttagttcaaagattgcccaaactttgattcaatctggcttataagagataacaaagattattatttaaagccacagtcattagtgatatgagggtagatatgaaaaagaaaaactgaatagactgcttatctcttactgtgatctgtatgacctctgattaatttaatcatggttctgtatctaatgttgagggcctgcaacaaggtcttgattgacaaaatctattttctcttcatactcattcaggcttcttggaagctaggggtttctgattaaattatgctatttttgtaacccacagaagatcccatatggtcaatttcaagttcccgttactttcagtatttttcctagatgttatttcacttaggacaaacaggatgcaatttgtggggtggttgtttgaccttctcgtattaaaaggttgtaagtgttgtctctttcagctgcccattttagaagttaaatttattgattgctgagcactttagtgcattctctcatttattcttcacagcaacgtgaagaggtaaggtctgctattaatcccattttgcctttgcaaaataagccatagaggagctaaataatttgcccactgtcacacggtaagaggttgagccatgtctgaaattcaggtttatttggctccagaacccctacattagccttacaataagatgcctcgtgcaacctagcttgatggagattgcatgctaaatatattttaatactggaaatggtttactgatgtttccagcattcataatgatcaggttgcaaaatctgtttggacatttattaagagattggaaccaaattaatgacatcttctctgaaatttctcttggcttatcttaggagaaattagaatgaactgaagcagggaaggataggaaagagctatgtgaaaaattaaacactgtgtttaccaatgttgagtggctttctacacaacatgtgtgatctgtgtgtggggccctgtgtccagtgctcaggttatggtcctactgtcattttcagccactgttcattgatgtacactcactgttcagggtagtagagtccacaaaagcatgcaatgtcactgacatagcggacggtagctagcacaggcgtttagtgtggccatgagcctcagctcttgctcctataatttcatttctcaggaattgttgttcttccctgttgctgggtcttggtagggtctgctctggtctatcctaatcggtgtgcttaactttacatttggagtactaagagttgaggttttgcttcctttcttcccagaattgctttggaatccttatgcagtttgctctgctttctttgtagtgaccaagtttatatactggcacttctgaatcccaagaaaatgacttgctattcaattgacatttcaaaatctaagatggtacccttgcaaccaagaaaatataatttattttataaaagaaaaaacccgtctacctcatcatatgcatcagatatacaactaaactgtggtaaatgcttgtacaccagtatcttcagggtcctggggagcacaaaaagggctacttggccaaatatgacagatgattcctgatttgactcttgggggataagtaaaatctaaccagatagagaaaggtggaaagagtattcaagcaaaagcacaggatgaacaaaagaaggaagcaatgaattgatgattagtaaagcaaaagcaaaatagattagcgttgctaaaacaaaagtatgaggcagagggtagcaaaagataagtttgaacatataggtagaagccctaaaatgcaatgccaaggagactggaatttattttaggttacagggcacccctaaagggtgttaaatgggacagacgtgtttttcacacagatgagtctaatttcagcataaaagatggatttcagggccagtagctagagtggaaacagggaaatcagtgaagagatgttaacatggtaccaatgtgaaatgagaaaggagccacccagggtaatggtaatagggatgcagaagatttttcaattatatagaagggcaaattgacaagccatcatgatcagcggtgatgtgtaaaggagagggagtagttgacaaatatttattgatcacgcactctgtgccaggcactttaaaggtcatgagtcacagaagtctggatttctaaaaatctacagaatgactgcaaggtctctcattgtgaattcattctctgttgctgcattggaaattgccctaaagcttagtggctagaaataatatttattatctcacagatttgtgggtcaggaatataggagtagctgagctcagggtctctggctcaaggtttctcttgaggtagcagtcaatttgttggctgggctgccatcatctcaaaacttacctgggtttgaagaatctgcttcgaaggtggatataggtccctagtcacaggggcctctctgcagagccacttaacaagaaggcagctggttctccccagtggaagcactctaaaagatatgacgaagagcacacacgtcagaaactgaagtcttttaaaatcttcatcttggaaatgacgtcaccagccactcctagattcctgacccgcaaatctgtgagataataaatgttatttttagtcactaagctttggggcaatttctaatgcagcaattgagaaagaattcacaaggagagatcttgcagtcattctgtagatttttagatttttatcatctcttccctgatctccctgctcccactctagctactggcccccaaatccatcttttatgctaaaattagactccccaatacttctgttgtattctgtttattagaagggagtcccaaagtccagctcacagttagaggagggaattacacaatggcataaatgccaggagacagggatctgcaggggccctttgagagactgcctaccacacctgtatgactgagtagatggcagtgcattaatgaagattaggaatgcagttgaaagagattttagggggttaatgaagagacttgtttcagatagaaactgttgcctattcaaatggatctgtgcagcagcattagtaatggagaagtagattggagggtggtcatcgttttataggtagcatgtgaaaccatacaagtgaccactaccttacctccttacaaatcattgctcagaggccaccctttcgatgaggtctgtcttcaccaatctcttaaaattttaactcttttttcactctaatatcccatctccaccttttgagttatgcatagcacttaccatcttctgtcacgcccatgatttacttattgttcattgtctgtttcttccaccagaatgtgagctcgattaaagcagagttctttgttttatacactgatgtacacttagtgcttagtagagtacctgatgtatagctgatacgcaatagttatgcaaagaaggataaaactttgtaaaagtagtacatctaagccaaaggtggaaataatccaagtattcattgatggatggatagataaaccagatgtggtacatacatacaatggaatactatttggccttaaaaagtaagaggattctgccacatgttacaacatgagtgagccttgaggacattatgctaagtgaaatgagccactcacaaaaggacaaatacagtatgatttcacttaaataaggtacttaacagtcatcaaatacatagagacagaaagtagaatggtggttaccaggtgctgaatggaggaaggaatgaggagttattgtttagtgactgcagagtttcatttggggaagatgaaaagttctggagatggttggtggtagatggttccacaacaatgtgaatgtagttaatgccacagaacagagcaattaaaatggtttaaatgatacattttatgttatatgtattttaccaaaaaaaaaaaatttcaaaggttgtggacgtagtaattaagataaggactgaagaatgcctattggatttgctaaaacagagacctcagtgagagctggttcagtgggacactgggagctgagatgatactgatgagtgattgagaagtgagggggatacgagctagaggaggcttctttataaagaatgggggggatctcagaatgtttcaggctgggagaagtggtagtggggtgcatgtgtgtgtatgtatgtgtgttgtggagactatgtggggcggggaggccacttggagatacagctattaaataagtgaacaacaatacaaaaggcgggctgggggaagggaggaaggaaaccgaaggaacctttcctgtctacttgtatggaggagtaatgtctgaaattttccaaatagccaaagttgtggcacatgaggaggtttggagcaaacattataatagcttgggttaattatcacagtctgcaccattcagacagtgtctatcagaacccaggaacagcctataagactaagctgtgccaaactgtggaaaggggtcgatggtttagggcagttagggctgcaggttctagggcagttatcatcatgaaaggctgtgataagacattaactgttgaacattcttacagcatattgtattgtaatagactctgaatttgaatattttattatagcaagtatgttgtatgcaaagtactcaggcattgcaaatcaggcaaagttgaaaacaccccagtattattagagctctaccacacagattctgcaacatggggaaactcaatttaatacattttcattgaatacctacctataagcctccgtggtatgaaaggcatacaaaatgtgtatttactatatatattgtaaagtgattatatatactattgtgaaactagatcactatttggtctactagctaatatttatatagatggtattagcatagctattgccacataggcaaagagatccatgttacagatgacagaattgcaggttttctcaagaacttctagtggattttaaagtattattggaaggtggaaacttttgttcagacacaaaagtgttgtactgaagtaaagattgctgcataaacatgcagtaatttatttaaaggtacatggtcctactagagcatgggcagttagtctagaggtcctgatcaagcatggtgtaggacagagagcttgtgtgggatttctatgtgggggcttggcaattctgggattaatttcagcaggttcctgaaggtcaagtgggccaagcttcaaacagaagacctgtggttatgtctattcagtggcgaggccagatttaggaagccgagaaatcaaacattatgaggaacaactagttccagaaatcaaggtcaggcaagggcaagaatgcaaggagaaatgtgagtcaagatagtgtcattgctgtcagaatacacatatgggcctgatttgaagaggaaagggtttgttctagggtttctttcagagtgagaggtttactacgtatggtggtgctaaggcacataatgatgatgaagaagaagatgacgatgatgccgtaatgataaaagctgccatttgttagatctgtgctatgtggcaagcactgttagttcaacaaatatttttagtacctagtatgtgcctacatactggggaaagaacaataagcaaaacagataaaattcttgttctcatgaagcttatgtttacgtggaaggagacaaataataaatctgtaggcaaaaatacaataatctagagaattataagccctttggaaaacacagaagaagcagagtgaatgaagacggtttggaagagggtaaatgtttcatgtacgatgcttaggaaaggtctggaaatttgaacagagatataatactagtatggagacaagccaagcaagtttggggaagactttgaacagagtgagatcaggtgtgaaggccccgtggtagggaattgcttgacaagtaaaaggaatagcaggagggccattgtggctgaggcggaatagtaggattctttagagcttttgcttgtggccatcttaccagctttgcctttgaacctagtgaaatgagaagcccttggaagcttctctgagcatcctgaaacttaggctgtattatcctccagatacttgtgtgagataggtaaaattattattgtaccttttacattaatgaaaaagctgagacatggagagagtttaagtgatttgcccaaaaccagctctaaagctttggaatgaggatttttaacgtggggagtgattttaggttgcacagaaaggatggcaaagggacacaaggacattttgcggggtgatggatgtgttcattatcttgtctggctggtttcatgcatgcatatgtatgtaaaacagtgtgctttaaatatgtgtcatttattgtatgtcactgatacctgagtaaactcataaaatacgtttcaaaaatgagggagaggccttgatggagtttaaagcagagaaatggcattcatattttgggaaggatggattagagatcaattagaaagccattacaaagatccaggaataaaccagtaaggaactgaaccaaggtagtgtagagaggaacaagagaggactttgactgtaaagatgacaagacttgaaaggtgatgagaatgaggcatgagagaaagaaggaattgagcatagttaccaagtcggctgtgttcagaggtgaaccacggtaccattaaccaaaacgtaaaatcccagaaaggcatcaggtcctgggaaaggtgatgacaggtgtagacagactgtgatctggttgttgtgggatatccaggacaggaggtagtttaacttagggagacttctggttgagaactagagatgtggagttggtgtgtaggcggcctattagagctataggcatgaatgccatgccagagataagaaggggtggaggagaaagctcgaaagctctggggagcaccagtatttaaaatgagacatagagaaaaacttggtctgcattgtgccctgtatctcatttcaaactcacaggaaacactgattgtcagtcacaacactctttccttcaggcgtctgtcaacacagtgttggtagaaaccactacgtttgatcagtgtcaacgagcaagatgaatcctcttttccacccctgattttagtagtgaacatggaaccattaaggagatgaaggagtgtttgaaaaagttagtagaggcccaggagataatcatgtcttgaaggccaagaaaatttcaagaaaaagacagagtaagatacagacctcactcttataagaactgaaacatatccattgtttttggccattagaaggttaataatgactttgtggagtgtggtttctatggcatgagagggtaaaggtcaaattatagtggatccagggatgaaagtgaggactgtgctccccggaagcacaacttggaagtgaagaagtaggaattttattgaaaaagtctgtgttctttttataaatttctttacaaatcaaagagttatttagtttttatagattgtcacatttatttcttaaatataggaatatccttggagtctctttgctaggagacttttgggcacaaagcagatgcccttatttctgggtagtttcctgacctgaagtgtgggacaagactacctgagccttagagccatctgggatggtttcccagctgctggtctaccagcctttgccatctcagagtaagagaagttgcacatggtgcaaagaaaagtgagaaaactgagttttctataaagagcactgctttatcctgagattatctttttttcttatatttgggttgaaatgtctttgtattagtaggcagtatttttttcttttaaataccccacctagcaaaataaaaatttggcacctctctgagttactctgttttttctcaatgattctaattccttaattccttatgaacagccatcttttttgtgtgttttaagtttttatcttctctaggccagaattaatttggagaacgagaactaactagaacaatgatattgttagtcctcaggagctacaggcagatggcctatcacccaagaactccaaaatatagtacatgagattatcctgataaggagattattcttcctaaaattagagctcaaaatcaatcatagtagataagtgtgtaaagtcaccttgaagatatagaatagctcccctgccagccagatttaactttcatgtgattaaaaatattactatgtctaaggaaagaatgtgttaatgaacaaagaggttgattggctatgagaacatgggaaaccatggggggaaaagctggtgatatctgtctgagcactggttagacaagaggaaatgatggcagatggaggcctgaggatagttaggtttcactggcagagaccagatggacccactggattggagaggcccggctatgtgagcctgatgtcaccccttaccctcaatgcatccagctttccttcatcttttcccatgcctactctttgcatttgacttcccaagtaggaggagaatgcagtagtgctggggctaaactattgcttctcatacagactgaaagtttaagtccctgtgtggatcatttctcgatagaattttttaaaccagcattctggatttatccctcagtctcagctctggtagaaaaattctttaatgtgctgacaaagtctggtttctgagcttgtggtgctgaggtctgattgagcctcttgtgccttcagccaggaggaccctggctttccttagatgggagcagactttgacgttaccactgtgttggaccacattgtgacttgctgtaatttttcttttaaagtttcctccaaaattaccattttaaaagaaacaccaaattaaaaacatatttattgaccagacattctgcagaaaaccatgttcaagaataacttttgccatttttcactagacaatttttagaattttgtcatttcaacatttttttctttgtttctcactccaaacttctgtaaattttttattcactaaattttgttcacacaattataggtagtcttgtgatgattgtctccaagctggttccactttctttgtttttaattctgctccgatggattatttgtcttgaagatcttgaaagaagttgataaagaagagcttaatcatagcaaaatttcttagattcttaattcggaccacaagcaaaatggtctgttttaagcttctgctatgaaaaattacatggagtttttctcatggtttcaaattattttattcctaaggctcaaggctcttgatgtgatggtgaacatctgggagaaaaacttaagaaaaaatgtagtcatttgaatgtttgatgaacagtttgagaagttcacaaatttgtaaacattctgattttagtcattcgggttcttcccctacttctttcatctgctcttgtcattatgtaaatagagccctacagaggggatggagaaaaattagtttttgtccaaatattcctctcttttgcatttgatcagaatgttctctgttcttgacgatgggtgataaaattatgggcaaggagaagctttgcagaagggcaaaaggagtaagctggggctctgtgagtattgcctaattgagtggctttgctcaaaaatctttttctttttgatgataactttcttgtgttgttgtcatattacatatttagaaatgaaaataagatgaaatatttacttattgaacatctgcttttctcctagatggggtcacagtctccaagttccctgtttatttaggaaagattggctggtaattcctgtcccctttcctcccttttgtattactttagatatctgattattcataccatctctgttaaggaaaaaaatacttatttccatggaaataacattaggaagtggctttgggagctaaaaatcttcttttcatgagaaaacatttttttttcttttgcagatcttgaaaacaacggcatccttaacatacaatatacacaaatagatgttttgataaagaaaatagatccatataagaactattttatctgagtttacattagacctgcaataacatagtagtgagttgatactaggaagccataaagtcataaaagttttaccagtatgcttaagagaagattctcttgaggaaattaaaacagaagaagtgatatatcataatctttcacaaatctgtataatcaatagcagagatcaatagtaatatagctaaaaatctttgaaccctaaagatattttttgaagggacaacgttttaggaattcttagctcattcttggctgacgtctccatgaaaccagggttgtttgtgattttgcttcataggagaatccttgatcactccgtggaagaacttgtagttccagaagaagaaagctcatgatcatagaatgtgtgatttattaaattagaatctgcattttgctcaaattttgaaattctcagatctttttaacaacaaacatcatgatccagtaccattatattttggttaataatttcggtctaacagagttgtttttggtaactacggaattatcttacctgattttctcagaatagtgaccatgagaaaaatattttggaattggacttggattggaagggaaaagtggaggacaggagaaatcgatcagaagcatttgcagcaatctatgtggacatggctcagattggcctgtggggcagaggggatgcagtgaatggagagcttcaagacatatgggagagagagaattgactgcattcattcatcattgattgtggaggttgagagtgatgaagtctgaaaggaagatccctagcaactgaagtgagaaaaggaccattgcctgagaggggagaaggaccaaaagttcagtttggtgcatggtagttataaaggatcttcagggtgagatatagagcaggcagtgggagataggagttggggtttaaaagagtctcttggtccccagacaaggcatgttaaaatagctgacatttgatgagctttgagtattctatttaataactaattttagatactgtactatatgacagctataaaaataggagctgatgtatctgaaaatatccaaaaagaaaacgaaagaaatcacgttgggtctaataaaaatcagtcagtagatttaaagagaagaagagagttaggctaggagagaaatgtaaaactcccaatttggtctctttcggtttcatttacatggaaatctatgcttgaaagggaaatacagacgactattagaagtcagaaaacaaaggtacaggaaaagaatggaaagtcacctgggtttcccaccacttgtagttttctaaggttaattaaatctatttgcattttataatgagaaaaatatcacaaccttttttttttttaaagaaaacaagctacctttttttaaagtgatttgaaatagaaatgcctctgctagcttctctttttcatgctgagaggacatttcccagcaagccccaaggctttatcgtcttgtgatgtctccaggtcacctcagggacatagtggtataataaggaaaaccaaagggagaatggtagaggcataaaaatgtaatgaattgggggaaggttgattggaccaggcaaaatctggttattttgaccctttgtcaaggcggtcccaggtgtatctctgcccagaagaatatatttcaaatgtcttcagctgtagacttctgaagctacagatgattccactgatttatcacttctcccgtaggttgacaacattttgatactcaaaatgcagggaggaaagaagcataagaagtaggtatgaaagagaaatcacaggctttgggagggagtggtattaaagagcagaagggggataatacccacagaatacctgggatgagttcctcagggaatccttttcaaaccttctcgccctccccacctcatccccttctcacctctgtataaagagctttgcccttttctcctctgcttttcctcctccatcactggctgcttctttttagtctttttgctagaaacgatcttaccttctcaacttctaattgttggagagcccctgggtgcagtatgagtatagcatttcttttcttctttattcccagctactccctacttggctttcatctgttcctgtaactttatataccatttatatgctgcagatgttcaaatgtacatctctagtgcttgcctcccctgcactccacacctcctacttgacatctctgcttagaagtcttgtaggcatcttaaactcaatttgttcaaaaccacatctgcctaattccaatcacatcccaaacacttggtcctctgtcaatgtccccatctcagtaaatgtaccaccatttgtcctgggaccttgagtcatccttggcttttcttttttaccaacaattcatcattagttcattaatagtaatccattagcaagtggctctgctttcaagatatacctcgaatcttaccacttcttaccaccagcacagttaccactccaatccaagccatcactttctggactgttgtagtagcttgttaaatgatttctctagttatacccctcccctttcaaactaattcagatatgttctccacataccagcgaatgtgacccttgaaaacataaagatgttcatatcatttcctggctcaaaaacttatgttggtttctttttgcccttagaaaatccaaggtcctcaccatggcctataaatgcctctggccccagatgcctctccagccttatctcctgtcacctcctccctcgcttgctgaggtccaacctcacccactttctggctgttacctgaacaagctaaaaatctaagggactttgcatttcaagttacctttgtctggaatgttcttctaccaaatattcaattgactgtctctctctctctctctcttacctaatgtaggggtctgctcagaggatgtcatgataccttatcaaaaggaaatcatgggccaggtgcagtggctcacccctataatcccagcactttgggaggccgaggtgggcggatcacaaggtcaggagatcgagactatcctggccaacatggtgaaaccccgtctctactaaaacacaaaaaattagctggatatggtgatatgtgcctgtaatcccagctactcaggaggctgaggcaggggaatcacttgagcccaggaggcggagtttgcagtgagccaagattgcaccattgtactccagcctgggtgacagagaaagactctgtctcaaaaaaaaaaaaaaaaaaaaaaaaaaaagggatatcatgataccttatcaaaatcagcatcccttgccctactcttgatcttgttcttcatcactgctgtcatgatttcactgtatactaagagtgtatttgtttgttgtttgactcgtctcccaggcagtaagctatctcaagcgggggcattgttgggcttttttgttttatgcccaccatccagaagacttcctgcacatgaggcgtaactattagctccataaatactagctgactgaatagcaacgtcagtaaccaagggaattggtttttgatttgcgtggctttttattttgacagccttggaaacaacagtgagtctgcccagttctcacaagtgtctagcatggcgcctggagcagagtttgcacatataaatgtgttgggtaaattagtgaatgaccaaatgaatgaataaagtcactttagtgctttaatcaccagtacatcttcagctaccctttagacccattcattacacagagttactatggcaaaggaacctaaccttgtctaagggttccatgaaggcctccctgaggagggtacttcatcatcatcatcatacctaacaggttctgagcacttactatgagccatctactgctttatgaactctaactgatttaatcctcacaacaaatctatgaggttgataatataattagtcccattttacagatggggaaaataaggcacagagaagtagattcatttatctcaggataggtaactaataaatggtagtctgtttccagagcctgtgcacttcaccactcactatgctatacttttttttttttttaacgtagtcaactatttaattaagttcttaagacatttagaacaccaatttgtgaggataaattccattcgtcagggcaaccacagatcacaggtagccctggagctgaggaatagctttgatttttggtaaaatttgtgagtccacagctttctgctcaatcttgcactgctccgtaatctcatatttctctttttctgtgtcgaagatctcaccttcctggtgtctgggcttccgcagcttcttcttcttgaagtaagcatcagtaagatgttttgggatttttacattgctgatatcgattttggttgaggtggcaatgacaaatttctggtgtgttcttcgtagaggaactcgattgaggaccagaggtccagtcacaagtaacaagccactagccagctgcttcaggaaaaccaccctcttgcccctgtggcgtccagtgaggatgatcagaatggtcccgggggtaatgctggctcgcagttttctcacgtgctgactgaagggttttttgctgtggctcaacagctttcgaggcacatcttcagtaggataatatctaggcattttgcgaagtttaaccacccgggtactgccgttcttgtcaccaccaactggttttgtaacagttgcaagaaccttctccttctttttcttttcaaccttggatttagcggctgagtacttcctcttgtacatggcctttctggaatacatagcagatcgggaatacctgccaattcctctgacaatgacagggttgcggctgcaatggggcttccccttcttgggctttttagccttgaggttaccctttttcaccttgccaccagcatcagccttcttggcttcaggtttcttctctttagtatctggcttctcaactttttcacccgccatcttgcaagatgggaaagagctcactatgctatacttctaagctgaggactgaggatggagtattagctggcttgatggaggattggaattaggcagaagttagcattctgggcaaatggaaccatgtgtgccaagggccagatcattgccagttccatgaaagacatgacaggtttagtgtaaccagggcacagactgggcatataagagggtaagagctgaacctggttattaagcaatggccagattgtataggcctggtaggctgtgctgagtttggacttaccttaggcaaagggaaacattaaatggttttaagcaaaaatgttaggtgtacagatttacttttttaagcagtcacattggtgaccctgtagaggatgagaggatgggctggaaagcaagcaggtggagggcagggagaccgttaggaaggtctcacaatagtccaagaaaggggtaatgatgacctggtctagggtattggtagaggcagtggagagatagtataggtttgaggtaaaatcaacaggccttgtgacttggggtgaagaagtgggaggtgtacagaaattgaggatgactcccagatctctggcttaggatggcaggtagaagatgttatttatagggaccaattagttgatcaattctcttctaggattttattctacagatagactagttactagtacagacacacaagcctttatacagaaagacattcattgtaggattgtttgtagtaggattagaaacaatgtggtgtagggccttgcacaactccaggatctgccattcacacagaatacaatgtggaggcctccctgaatttgcacaactgataaattaattcccgaattacaggatgtccaaaccatgggatataatacagcagttaaaaagtaggatgtgagtctttatggactggtaatggttgccaagataggttgttatgcaaaaaggtatcctatgatttgttttatgtaagtctattcatacacacacatatttacacttgtaaacacgtaacatagttctggaaagatacataaaattttgtaacagggctgcctctagggtagaggattaggagacgatagtaaaaaagcttttttgtcttgtctcatttttaaatttgtatgcattacctgttaaaataataatatgttaaaaatacatcatggagacttgataatgcagtgacaattaagtgattaaccaaataggaataaaggaagcgtgatactaatttataattacctttccattgaaacacttctgaaacaataaaaatttaagccataataataaatcccagggcaaaattaaatatgaaggtaataaatatggggctttgaaatagtgtatgggggatattaccaaaaatcccacctggcaaattattataaggactcaagactttttcggccgggcgcggtggctcacacctgtaatcccagcactttgggaggccgaggcgggcagatcacaaggtcaggagatcgagaccatcctggctaacacggtgaaacccggtctctactaaaaatacaaaaaaattagccaggcgcgatggcaggcgcctgtggtcccagccactcggggggctgaggcaggagaatggtgtgaacccgggaggtggagcttgcagtgagccgagatcgcaccactgcagtccagcctgggcgaaagagcgagactctgtctcaaaaaaaaaaaaaaaaaaaaaaaaagattttttcaagtgtgaaaaaccttaaagttgatgaattttagattgcacttctagttataatattagttgctcatgaagtatggggacctcagtgtctggcaggcaagtattacagctctagtgtaacttaaaggatctgctgtgttcaccagggcatgtgagaatcgtctgcaaaatgaatgcacactataagcaagaagaatacagtgaggcgggaccagaatattagatcaagtttgccattctagccttctttagattcttatcctgcacgtaatcatgctgttttgagaggggtcaggcttcaccagccctcacttatctgtgcagccatgaaaatgtttcaggaccaggttactgtctttttttattcagaacttccttggattttaggtgaatttagaattggaattagtttatagttgcagtggtaaaatttactattggcattacgtggatggcagaaaaccttaaaaaaaaaggcctgagtaacagaaatgacaaagtaaaggtaaattccagctagagagtacttatttctccttactcctgtcccatctgtagtaaaccagtaactcaaactattgaaagtataatacgtatatatctttgtgatttgcaagcacccaggtgattctgatagcaataaagtttgggcagcgtggtgctgaagagtgacactgccttcccaaccagcctcagatgaatcccgtcgagtacttcatttgtgaatcccttcttcaatatcattctgcttgggggcctatggaggagcaaaactctgctggaaaactctgatgattctgcctagaaaatgataggtttgtgttccagggggacgtggagatatattacttctaaattctctgatctgttgaccaaatgcggcaaggctaaccgagaaaatcatctggttttaaaagatattcctaaaaaagttgagacagttgcaactaattcttggctgctgcaaagattcctgctgtggaggggacttgaagcagaacatgcccctcactgccctttgtggctgtaattccatcaagggattctggcagcatacacctcagacacagagaatgtttgacttcagagactcctaggtagactgtgaaacattttaggacacgttcgacatgaactccagctttataccctgtttacatttcagagtcatctattaaaggtgggtatgagataatcagtggatacagaaaatctagttctccaagacattaaaatattatgtgccaagacctagatccttctgctgaccaaaatatcgatggcgtgaaagaccgtgccccttgtatattttacacagaagtccatcatactgaaaagtttgttccttttttgcagtgatcacattggccacaagtcccccaacaggaagagttttgctaatggcaggcagcctttaatcttacatcacatagtctgattctgcccttaaggagtcacctgggccttggagaggaggccgtcttctcctttgttgcccaggactgagagacctgctagtgtatcctggcaactgttgtgctcacctcaaggatgacaagtccctcagaactgtgacttttcttatgttgtccacatttcagaggcttctttttcacatgtgccagcaaatgactgcccacagcaagtctcttgttcttttgaggcagtgccactgagcctggagctgtgtgtctggagccttgcgtatccaaggagaaagcgcttgagtggccctgagtcagaaaaagcctttggcgttgcctctcccttttttgtaatagtgcctctttctccctggctgcggttcccttctcagcctcccctgtttggcatgcccattacacccctggcagggtgggcatctctcctctaaggggccacctttgggttcaaatcccagccccattgttatttacttacaatttgggacaagttacataacctccctgggtgtcattctcctcatccgtaaagctggtccaataacaataacaaccacaacaataatattactgcctagggtttgcttttaagaaacctcccacatgctgtccgacaaagtggatgccccgttgctcactgctgttgttctcaggaggctcacaagccatccagcccacccggctggtttttgttttaatcctcttgagatgctgtgagtgggcagcaccatttgggtgagtcatcactcctcattctaggtgggacggcactctaagcacattctgagaaagcaacctccgagcagtactcctcttgtcctggtagaaaagaataggtctcatgatagctccttccgctgggtgggttgtgtaatttgcaacaaggattctaaaaggaagtttaaatcaatcagaggctgtgtatgtggaaacagtgcgattcatgtgctgagatgtttttctacccaggaatagccattaggcactggctttttacgtaagaagcctttgtgagaaggtaaagcatgctcttgttccaaccccttgttagaacttaatctttttcttctccatgcctcacttccccgcccccacataatattcctcttttcattaatttttatggcaattcaacttaatatttccaaatatgcaaatattagaaataaaaatcaacataaaaatatttctatatgagtatgtacacacacacataaaaatatatagtgtaggcattactgagtgctacctgctttcagttgtaaacggacagacagacatatgtttatgccctgcaagaagctccatagcatcttctaaaatgttaatatcacttacaatgtgcttacttactcttagattttatttcttttttcattttcctgagaactgttccttgtagccaaaatgccaattactcactttaaatagagttctaatttcttgtaagtcacaaagaaaaaaaatatgcaatttttcctcttccttttccttcttgagagccaaaaaaggcgtgtctgtgccatttcttctcacgactaaataatgggccctcccacatcccaccagctctgaaccagtacactgaagaaagccactcttttgacattttcctgtgtacagggcaacatttctttatgcagttttattcacattaaccagtactattggccaccttctatgtgctggtcacttcgtggcccaaagtaagacagagtctctgtcttctgtaatccaatcagaagggtcagaaaagcaagtttaccatatagtacaagtagaataggatgagttccataagaaaagataaaagcccatctggaaggagagagtaaggttactggtgagtaaaaggatgttgatatcaagttctgtaagagtcaggtaggaatggagtaaaaaacacgggtggaaaaattttcttaggccagaaggtagagctggttgttatttgtttttcacagaaggagaggcaaaggaataggctagctatcgtactgtgaaatgtttaaataggagcagagagaggtaaaggaggtgcctaccttgatcttggggaattcggacagaaggtattttgcacagaaggtgggagtggagatgaaatttgggacttgaggagagaacctttcttggtcagtgatgacatgtttgctcttggtttatctttcagtctttcaacacaccctgcatgtgttcagcagtctacattattgtttacttttaaagatcgttgagagaatagtgatttcatttttcattacctccctgctgagttttccttcactggcatctctggctttatgtttgagttaacctattctggatccggctgtcttctggtcactggtataaagtagaagtgagtggcaggttgttacagcaatagaatttgatagcagttggagatacctgtgggaattggtcatgagctcgaatagttagcaagctctttcttaggaaatttttacagtcatttaaaggcctttcttgcagtttttattctgacaatgagtcttttcatgaacgttcagattgtctgaagatgtcgcaaaattacaataagacagttgtaagaatgttccgtgattcccagagaactataacattgaatttcctattaaagtcgtgaataagaaagattttgcagagaccagattgtgaatgcaatctcttacacaaaagcattgggtgattcccttttgtctgtgacctccttcctaggtcattcagagcttcaaactcttgctctcagccatccaccttcatgccttgtttctttccttcctactccttacattctggccctagtgggtgactttttgtaaccagcacaaggcattcaccgtcacagccctggggcttcgctctgctttcccctcttgacagcacactttgaacctgattgtttatctggtaaagttcttctcaggctgaactcctcctctgtgaagacttccctacttctctcttacaagcagaattcactccctttctgagacaataccactaatataataggtttgggcttctatcaaggttgtctggttagtcatcagggagcacagagtatttctgagttatacatgcttttccctgttgctttgcacaccctttgttcatttgcatgctacagggcactgctgtgtgtgctcatacttgcttattcttttaggcatatgccatagtattgccctaagtgaagctgggactttaatagtgattctacaagactccatttaatacccaattggtggtctggatgaggctaaaaggaacaacgtttctggactttaagagactttcaaaataggaggggagagggcagtgggtctcataactttccaccctgctccaccatcagactgacacattgttttggccagcatttctcaatctgggtttgccaggaacctagattttcacaatacaaatgtctaggcttcagagcttctaattttgtaggtctggggatgataattaaggtatttcccaagcttggctggtgacttatacagtggactgagaagagttgatctcactgtggctttagccctggctgcacatttgaatcaccgagggaggttttccaaatattgaagcctagtttctacccgtaccatttagatcagattctcaaaaaccagaccactggtcttaggcttctctctgcttttcaccaaaaagcaagatgtagaaaagagcagtaaacagagaggggtgattatattatgggaaaccacagagaagattcagtgtagtcctttttatggcggttatttttgtttctgttttctgattaggaaggagggatggaggataacaatatgaatgcctagaagctaaggacaaagccatttcaggtggaaggattcatacttacgaaggcatagaaatgagcgattacttttcctggtggaaagaccacatatgtggattcatgagggacacccttgcatgaaggacgacagggaggtggtgagtagggaaacccaacatctaggttgaagataatggatttcatgttggagagaataggtagttactttgtttctaagcaaggagtaattttagagataatattgagtttcagtaagatgtcttattgctatggttagggtgaactgaaataaatggtaacacagcagggttttgttcagggccaacttgtgtgataggtgtgacaaggtggctgctttctgttctgcatgtccaatttgataaaccaagatctaccatgggatttgggcaatccatagcttcctgccctctctctactcctgcttctcttgcccttctccacttccatatctctttctctgctaaatatgccattgtcctctatttagggtaaacatctaaaaataggtataaagaaatagaagaaaaataaaaaagtagcaatgatgggcactcacattataaaagatgtaaattgttttagggaagacagaattgtttaaagtatgtatttaaaagcagatatgtgttagatgtttttaaacattttttttaaccttgaaaggaaaagaaaataatgttaaaattttagatctataaaggatatgaatttatgcccaatattgttttaattcaattaggataattattttaaaactggaaaaaggaatcaatattgataatagcaaataatccaaaatcagaaagaatctattaaaaaaactactttctttgaagagtgaagttttctacattcaaataaattataccacagatagtaagagatcctataaatttggtcataggactatgggtcaataatgtctgagaaatagtagaaatgggagagtttctgaaaaattggtggtaagaaaatatccccattcaaaattgggcaagtggccaggcacagtggctcatgccttataatctcagtgctttgggaggctgaggtgggaggataagttgaggccaggagtttgagaccaacctgggcaacatagtgagatcccatatctacaaataaatagataagtcagagatggtgatgtatgcctgtagtcctagctacttgaggcaccgaggtgggagcattgcttgagcctaggaatttgaggctgcagtgagctatgattgcaccactgcactccagcttgagtgacaaaaagagaccctgtctctaaaataaaaattaaaaaaaattgggtaggttaacttacagcttaataagttaatggcaacctctacaaaattatcctaacagtaattaaacagatgttttatgtagaattagaaaagaaaatagtggtcataaagagctagcatgagttccttaaaaataaatgtgtattatgtgtctcatttcatttattggatggggttattatagtgatagctttggaaaattccatagacaacttgtgtctaaatttcagcaatgtatctgataatattttgtgatttccctgtggttaaggtagaaacatatagataggctaaaattaggccaaatcacaaatgttacatcccaccctactccaccctatgtgaatattataaattaattccaagctggagccaggtatctatttgagcaggggtcctgcagttggttctgtgctggttgctatgtttatcaatgacaggtgaatcatacatgaatgcttatcaacttatcaacttgctcttattctcctctgggaaagacagctgagacacatggtgatagaaatcagatttagatatccatagactggaacgatggtcccatatcaactaatataaagattataagtttagaaactgtggcaattagcctttcaccacttgtgctctagggtgttttgtctagatctttgttacttagaaattccaagctgaagctggctgaccatttttcaggattcttcgcagaacaagttgctaagtggcgaggaagcttgaatttgattatttgctaaccctgaaagtctattattctttggaattacttggagaaactgttttatgaaacatatcatcatctcaattgtctatcatacagctaactcacctatctcatccatcaaacttagtttcaaataacttgttgctgttggaataaaatgaaatctatcctcaaaatatgacgactattaacattcagaatcttccaaagagtgcctgcaggttcaggaggcatttccaaaagaggaatcttcaatgctttaaacaagatactggaatctcagttaaataccatttgctattgggagagatgtagtgtgtattttctagggtgacagctttggacagcagcaatttgactgtgtaaaggcttacatatctttctattcctaattttataatgcttaaaatatttttattattgcacattcttgagatcattactagaatttgttgttaatatggcacactttcaattttgattagaacacaaaacatgaaatgttctaaatgtataattagaataaatctgatgcttggttaaaatatttttattgagaagagaatatatagtaggatacaacaaaatatttggaaattataaagggtaataacccaacaaatatctgagtattccctacccattttaataacaaagggtaccatcgtaataacctctgaagtctgttgcttattttccttaatctattcctgagcatccccaataagcttaaatttttcacttattgttcccttgctttttattaacatttaaccaaatatttgtatctttactaatgatagcagcataaaactttcatatagtgatttctatgtgccaagcacttaaatgccatacattcatttaactcaaaagcaatcctcagaagcaggtatccccagccaggcatggtggctcacgcctgtaatccccagcactttgggaggcagaggtgggcggatcacgagatcaagagattgagaccatcctggccaacgtggtgaaaccccgtctctactaaaaatacaaaaactagctgggtgtgttggtgggcgcctgtaatcccagctactcgggaggctgaggcaggagaatcgcttaaacccaggaggcgtaggttgcagtgagccgagattgcaccactgcactccagccaggtgacagagcgagactccgtcttaaaaaaaaaaaaaaaaaaaaaaaaaaaagttggtatccccattttacggatgaggaaatcaagatatatagagattaacccgaattccagttcaggcagtctgactgcaaattctgtgctcttcccctctgttccatgccccctgtcaagaatacatagtatagctctatttgcatttaaaatgttatgtaaatgaaatactactgtgtgcaatctgcaattaacacttttagtcaccactgtgttcttgagtttcatatgttttgttctatgcaactgtagttcatttattttcatttgtaaagagtattatttcattgtatgactatattgcaatgtatttatctgttctgctttcatctgacatttgagttgcctttatatttttctgtaataaatagtgctgatatgatattttaactatcatcttgtgtgtatataccagagattatctagggtgcatatcctggagtataattcctgtgtttatgtgcaccttcaatattcctatagaacagcaagctgttttccatagtgatgaaccatgttgtcctccttgtgacagtatgtaagctctatatcttgccaagaggtaatattgtcacactttaaaatttttgtcagtctgtttagtttaaagtggtagaggaatgatgaggaggaaagaagaaaagggggaggaggaggacggggatgaatttccagttatctgatggatctgaacatgtttttctttttttactgttaatatttggtttctccttttgtaaactacctgttcaaatctttggttcactttttgggggaggatgtttatctttttcttattagtatctattagttgtagaaaacatcttttattttgtggctaatctttttaccttcttcatggtgtttttgatgaacagaattatttaattcaattgaatttataaatattttccttctaggatttctagatttttgtgtgtgtgtgttctatttattaaatacttctgttcactttgattttaaaaagatactttcctgtattatcttctaaaacttacatagttttgtatttcacatttccatttttaatctacctgggatcaaatgtatatatgcttcgaggtataaatacaattttatttaatttttctataaggataagcaattattgtgggaacatttgttgtaaagtgtatcttttctcattattctgtaatgccagttctgtcataaatcaagtttctatgtattttttggtctgtttctgactgtctttgtttcattggtcagtttgtttatttctgtcttaataccacactgtattaattgttaatggattataacaggtcttgatatctgctaatgccttccctacttccaaatctttttcctagggagtcttaactccttttgttctttgttcttccttataaattttagaattagcttgtcaagttccctcaaaagcctgtgggacttttgattgaaattgtatggatccataaatcattcagggagaattgacatcttcaaaatattgagtcttccatggtatgaacacagctttccttttgtttgggttttaatgactttctaatatgtctttaaatattgtctgtacccaattctctcttcaattctctctgttctttttttgaatctctaataaacatgttagatttaccttttttctcttctctatgtctcttaatgctttaataatttatttagatctacattttaatttactattttttctgtttctgtctgctattataacccatttattaattttaatcatgattgtccttattaaaatttatttttgttctttttaaagtatttattcatttgtttatggtctcttctttagtcttagttttaaccccatcttttattttttagcattaatcataattattttatattctatttatgataatttcagttttctggagtttttgctggcttatactcattgattctttttcattctcctgtgtttgtgatttttgatgaggatttcatgtgtcttggtacttttttggaattctttgagacttgggtcttcagagaggatttgatttgcttcttggacatgcagggaaatttatgaagccataagtactttatactaagtatttggattgcagtctgttggataacctagagaacgaaggcatgtaagggctagtgtgtggtcagatatgttggaaagatgtttttccttccatcacttagtgccagtattcaagacgaacatttttcttgtagtctttaagatgagtggaatctttcagatttagtctttcatttttgctgacatcactttagacaatatgccagaagtgtttacatataaatgtatgtatactgttgactgtatgctgactgtatcctctctcctctccctacacacgaaactctgtgactcccagtacccagtggcccataagagaaagaggccctgaaatttaagcttccttagtttcataataaatccatctctgcttaagagtagatgttcattattttatcatatcaagtacactgaagctttaaaaacaaatatttttattatataaagtagtttatagtctcatatttcctgtaaaatgtagtcttctcttttacagttgaggaaaagaagggttggagcagcgaagtgacctgcccagagtcataaagttaatgcgttgaatctggttttctgtccagtccactttccactttacaatgccagtagttctctatttagttataatagatgcctttttcaaaacctttactgtgttttaggaaaaaggtacctttaatatgcttactgaattgcatcttcatggcttctactcgaggtcacttcaaatcctgtttctgtcacctcctcttagtagcctttccctatcaacatcattcccattttctaccacttattcccatcattccattcatagcagatctatatctattagcaataattcatgcatttgcttacttatgtattgtctggtttttcccctgagatcataagctaagcaagaagagggaccatgtgtattttgtttacttccatacaaacagcaattactttgagcctagaacatagtagaagctgaataaaaatattgaatgtctaaaagtctgattctaaaacccatttctttttgctaaatatatttattgaatcggatgtttcctgttatcttagaattacaaccaagttccaaagctgaactaagtatcctacattctaagttttgagagctgccagtggttaaggccagacatctactgggaggactgagatcagaaaattattcctccaaagctgtcacttccactcctgtaaattaatataaagcgagaatgggagagaagatattgcttttttggagtacaatgttaataaagcaagtttaattgcttcctttactctaaatctgccactaagagtagggcgagaggctcaaagagaatattaatccaagttatggttgtctcaaagaagacactacaggtattttaatctccattagaacatatgcttagccaggcttggcgacctggctatctggcagaagagaagaatctgtaaagagacatcttagtggggtactgccaggcaggaataggccacaagttggggtttacttcaagttctggttcgcagaaagtttggaagactgatgccatatctgctgtcaggctcagataattgaaaccttagggataggggtctagtcttgttagtatcctcacaatttggggagatttggaggcaaaaaacaaaacaaaacaaaataattccctgtgtattagaagaatggatcatgacgctaccatcctggtattaactggaagatctaacaagatcttggtcaggatggttgtattagtctgttctcactttgctataaaaaaatacctgagactgggtaatttataaagaaaagaggctcaattgattcatggttctgcaggctgtacaggaagtaaagtggcttctgcttctgaggaggcctcaggaaacttataatcatagcagaaggtgaaggggaaacaggcacatcttatatgaccagagcaggaggaagaaaaagagggtggagaggtgctatgcacttttaaacaaccagttctcacaagaactcactgtcatgatgacagctccaagagggatagtattaacccatgagaaaccacccctgtgatccagtcacctcccaccaggccccacctccaacattgggaattacagttgaacatgagatttggatatgaacacagatccagacatatcaatggtcagtgctgggagagctgtgtgggtcaatggagcgcactaaagctaccatcagtccaagacaataagctcaatgtgccctgatggcttgccaaggccagcgatgctaccaacgttatccaatcagttgaggacactgccttttccttctccttccttcttccaaaatgctagaggaatccgcataggtgaatagaggtacttacgataagcagaccaccccactccctaattcaaagccatttgtaccacaggtctaagggaggagtggtggcatttagaattagaaatgaaaaatgaaatgaacaagatcaaaatgaacaagattgaccagcggaaatcaaatgagactgttaggggagactgttaggaaggatagatttaacatgtcacgactggggaaatagctgttggaaaataaagctctttctcattcataatcagtgaagttgagagtccacattaaactattgaaatagttccctctggaaggtcaataacctaggactggttcttaggagagaattatttaaaataagggtgtttcggcggggtgtggtggctcacgcctgtaatcccagcactatgggaggccgaggtgggtggatcacgaggtcaggagatcgagaccattctggctaacatggtgaaaccccgtctctactaaaaatacaaaaaagtagccaggtatggtggcatgcgcctgtagtcccagctcctcaggaggctgaggcagaagaatcgcttgaacccgggaggcggaggttgcagtgatccaaaattgcaccattgcactccagcctaggctacacagcgagactgtgtctcaaaaaaaaaaataaaaataaaaataaaaaataaaaaatagataaataaaatgaaataaaatgaaataaaataaaatgaaataaaataaaataaaataaaataaaataaaataaggatgttttggtacttcagtataccacccagtctttgatttcctcttcaaggtaaacactgtggtataagacctaacattttgttttaactggaactaaaggccaaacttcatattttcccttggtggtctgcatatttcatctgtgtagctattttaatgtacctagagaacaaggaaaaggaaatacatcaaaagttacagaaaagaggagaccccagtggtttgtatctttgggtaaaaaggccctgtaagggggcattgataaattgtggtataaacaaaccttgatcctggcaatatagtagccaggatctttaaaaaagataaatatttaaatatttatctttaaattatcctttaaattatctttaaaaaagataaatatttctgaatatttgctaatctgggtggtgattccactattaaaattagcatagacctgagttttaatagactagcatgcttggtgcctagtaggaatgcaataaaaattagcttaaaaagatgagtttccaaatgattgttttgtgggctcataaataaagatgcttttaagtgttttattgttttcctcctgaccctctctcagggttatatctttactgcatgttccatatttaatttcatgatcacattgaatatcagagaaataagaaacaagttatgttcatggatactgacctccattgtttaataataatagctatcatttcaataaatatttattatttgtctattaatttacatgcctttttcttttttgtaatttttattaaggtatatttaaatgcaagttatgagttttgcaaatgtgtacagttgtataatctatatatttattaagatatcaaacatttgcatcactccagagagttaacttgtgtgccttcccaatcagccatctcccctccactcagcaaccactgttctgatttctactgcaataggttagtttttcctgttctataactttatgtataatacatatacaatatgttctttctgtgtcccattttttttcactcagaataacgtttctgagattcattcatgttgttggaagtatctgtagttcattcttttttattcctgagtagtatttcactttataaatataccatagtttctttaatccattctcctattgctggacagttgaattgttttctttttctttactaatatgaataaagctgctatgaatatttatatataattttttatatctaggagtgaaatttctgggtcatattgcatatttatgtttaagtgcattaaaaactgtctaatagttgtcaaagtgatttactattttattcttccagcaacaatatatgagagttcttgttgttccacattcttgccaacatttagtgttctctgtctttttattttagtgaaatgaaatcacatttcattttggatttactttacattacccagatagctaaagtattgagcatttttttctgggcttattgggcatatttatctttcttttgtgaagcatccacatagaatttctttcttcatttttgattgatagtcatgctggatataaaattcttggttgacagttactgtttttatttcctttcagcacatataacatatcgtctcactgccttctttctggtctccatattttctgaagaaaccatccattagtatgaaggatgccttgcatgtgatgatttattttcctctagctgctttcaagatactctctttatcttttacttttgacattttgactatgatgtttctagatgtgaaggtctttgagtttatcttagagtttattgagcctgttgaatgtatagattaatatttttcttccccctcaagattgggaattttctgtcatttctttaaatattctttttgcccccttttctcttcctttttcttctggaatatctattatgaatatgctggtatgcttgacggtctgccacaggtctctgaagatctgtttttttcttcatccccttttttttcctgtctctctaattgaacaattacaattcacctatcttcaagctcactgattccttcaactatcagcttcaatctgctgtccagcacctgtagtgaatttttacttcagttttgatatttttaacttcagaatttctatttggctccttttcaatattgtctgtctctttattgatattctctatttgataagacattgctctcatagtatcctttagctccttagacatggtttattttaattatttaaatatttttaatataggtgctgttatttatttatttccccaggctggagtgcagtggcacaatcttggctcactgcaacctccgcctgctgggttcaagtgattctcctgcctcagcctcctgagtagctggaactgcaggtatgtgctgccacactcagctaatttttgtacttttagtagagacggggtttcaacatgttggccaggctggtcacaaactcctgacctcaaatgatctgcctgccttagcctcccaaagtgctggggttacaggtgtgagcgactgtgcctggcctgcaatttttaaaaaatgtctgatcttctccaaaaaaatttttattgacttgctcatttcctgtgtatgcgtgatactttcttgtttctttgcatatctcataaaattttatttaaaacaggaccttttaaataatacaatgtgacaactctggaaatcagatcttctctcacttctctccagtgtttgtttatgttgctgattgtagtattgtcattgctgcttgtttgttgactaattctgtaaagtctattttctatgttgtgtatgactactgaagtctctggttagcttagtggccatctaatgatctaattattggacagatactttcttaaatacctgagtacagtaagtgtccccaattttttcaagtggctctgtatgaattgtggggcatgtcttcaacactcaggaatgtgtaagatggtttacaactttgcattggccatcacttcctgtttgtgtaatgcctcccttttagccagaagtgggacattagggccttctcagatttttcctgagcatgtgtacagtcttatacatggtttggatttgtgtccccacccaaatctcatgtcacattggaggaggggcctggtggaaggtgattggatcacgtgggtggatttcctctttgctgttctcgtgatagtgagtgagttctcatgagatctgatggtttaaaagtgtatggcacttcccccttctccctctctctcctgctgctatgtgaagaaagtgcttgttttcccttccgccgtgatcgtaagtttccggagaccttccagtcatgcttcctgttaaacctgcagaactgtgagtcaattaaacctcttttttttcataaattacccactctcaggtagttctttatagcagtgtgagaacagtcttccacctgtgcatggtcttctaaatttttaggaatacgttgaagctttctgaaacaacatatgtgtacagcttaattccagtttttccttttaagatttttgcttagtttcttatttgccccagttgttatcatcatcttaggccactatggtgttaaaaattcataactgattgttttcaacaaatgccgctggtgaaagtgctgagtggagtctgagccaggttgaagaaaaacaagccatggaatgggggttttcagagaatgtcagacatggcacattacgacagttgtctgagcatagttttttgggaagctccaaatgtattttgccctttccagtggctgctaggctgctggtttttactgggatcaaggagctgttggttttcagtgctactatggagctgagagataaggatggggatagggcaacttaaaatgccacaaaaatcactgttcttattgaggtttagttatttttcgtgaccaaatgcttctcagattgttgcaggatttcttgaaaaataatctcaagagttctgaggaaaatgattttgcccattattgccgttgtttttactgcttttgtggaggagcagctttccaggggtatggctctgctattcctgctagaagcacagaaataggaaggaggtgctgagtaagtagaagtattgcttgacatgtcttttacttcttttgataagtagatgttaattttgatgtagttgaattcatgaatttcttcttttatggttagaagtttctgcatcctatcttgaaaaaaatcattgccaactccaaggtcattcagttttttaaaatgctttcttttagaagctttatagttttaacttttaggtttctatctgtgatccttcttgatgtattatctgtataatgtgagatagggtcaatattattttttcccatgtgaataacctttttttcctagcatcttgtcttgaaaagaccttctctccattggattgtttcaatacctctgttgaagctgtacatgtgggggttatatttgaatctctgttcttttcaattgatcaaatgtcaattctttctttaatagcacatgttctggatttctatagctttataatacgtctagaaattgggtagtgaaagtcttccctccaactttttcttttttatcgaggttatttggctattttatgttttttttattgctatatacattttttaaatcacctggatttggatagagattgtgttgattttaagtatcagtttgggaagttttgatatcttaatgttagtagtactgatctttcaatacacaaatatggtatgtttatttacatctttaatttttatcagtgatgttttatagttttcagtgtaaggtcttacaaatattttattgtatctgtcctttaataatgcatgttttttagtgctattgttaacagtatttttaaatttttattttttaatttgtggttgcatatatacagaaatacagttgacttttgtatatagtgtctgtacactatgactccaaacttactcattctgtagaatgagttgatttttgcagattagttggaatttcaagtaatcatgacatttgcaaatgaagataattttactttttccttcccaatatgtatgcctttattattattattaactttattttccctctctttttacactggctagaacttccattacaatgttgaataaaagtggtgagggcagactcccagatttgtttgaatgttagggagatgatactcagttctgtaccattatgtatgatgttacttatagatttttcatatgtattctttatcagactgaggactttttttttcctcatcaattttttttttctgcaagtaggcctgcaggatacatgtgaagtattagagtctagttaatgatgagttagttgctagtgaggtaggggaaattaaaagaacaagtatatctgcaggccgaactggataggatgaacaaaggccatatgataggaatatagacaagctgggctggatgaagaaacctgacttctctttgtggctctgccaccaacttcctattaaaccttaaagaaggcactttattttatttatttatttatttatttatttatttatttatttatttatttgagacggagcttcgctcttgtcgcccaggctggagtgcagtggcgccatctcagctcactccaacttctgcctcccaggttcaagcaattctcctgcctcagcctcccaagtagctgggattataggctcccgccaccatgcctggctagtttttgtatttttagtagagaagaggtttcaccatgttggccaggctggtctcaaactcctgaactcaggtgatccacctgccttggcctcccaaagtgctgggattacaggcataagccactgcgctctgccatggcactttattttttacctagcactaaaagatatagctgagagccaggttggtatcagaaagaatttggtagagttgcaaaagtgattttaaaatttgaaaaataagaaatgtgagaagagattgataaggctagacttcctttatctgctatgaaaaaggctgagatttaaattttttgatactactttcagttcactgcaccaagacaaccattcatctgtctctgggtaccttcacatcccttttctccaaaaccacacgcccttggtttctttagctatattgcaggtcttgagatcaggtaatgctgtgttccccagctctacttttaagtaattattttgctaaagtatcttcacctgaatcatctgggatgacttctgtttccttccaggaccttcacctcactgatacaactggcactgatacaccctggcagtgtgtctcctcaacacataggtgtgctctggggtctttgtaggcttaaccattgtgcctaggcctgacatcgaagtaggtagttaggtctttgcctgtcaccacagacatcccattatatctatggcactctgaattacagcttaggaaaataattttaactactttgaatgtcatttgactccattccttagggtcatgcaggattttttcatttttatgagtcccttctgagaacacagatagccttatgagggacagttgccttcagttgacagccttgtgtgggggttgtctagtcagcgataccatcagttttgcaagactgtggttgtgacagtataggcgtccaggtgaaattgaagggggaagggaccaagtgtgctagcatcgaaatggggagtgggatgctaatgatacacttttcttgttgtcagttttactgggaacagccctgtggaaatttaaatcctttcccctaaaatttctttgaagtcccaaaaggcttatgttcttaaggttatttctgttcccaggctaatgcttttcctaaatttgttcaattctggattatctttttatctcagtaggcaaaatctattctgtattcattgacctggatataaaattcagccccttctccaatttccatattcattagacctcactgcctttaaggcaaaaagtagacttccctgaaggtacaagtccaggtgggaaatatggaggagacaaaggaggcatttccatgacagtgtgcaacaacttccaattgagcattagactgtgttcttaacatgctctttatttaccccataccagggcatttgcctgtatgtttatgccccctctcaatcctaaaatcctaacccccaaggtgatggtatcaggaagtggggccttttgagaggtgaataggtcatgagggtggagtctgcatgagtgggattagtgtccctttaaaagagacctaagcaagcacatttgcctcttcctccatgtgaagatccagtgaaatgacaccttctatgaccaggaagtagaccctcaccggacattgaatctgctggcaccttgatcttgggttctccaacctccagaactgtgagaaataaatgtctgttgttcataagcctcccagtttatggtgctttgttagagcagcccaaacagactaagatagcatttcatggacagcatttagtccattgcatgccctggtattataccatcttgtggatccttcccttcctttctattgtgtggcccttctctctcccttcctttcagagcgaatacagagtgagagagcctttggagccagacatctgggctccagtcttggttttatcactgattcactgtatggcttacctaaattacttaaactttctaatatcaatcgtcccattcataaaatgggcatagcaaaacgatccatttcataaacttgctatgcatatttgaggtgtgctgtggtttgctgcccacagggcttctcagaaccaaggtactcatttcaccgctgctgggagtgttggctgctgctggtccacatctgagccccttccgaggtattgtctctgacacaagaagatctctgccatggttatactctccccaggggctgcctgtactcaaagactggttgatgtaaagtttgagagtcttgttcttttaccttaaattggggcaatccagctccagaacttcttgtgaggccaactgaggcttccgttacaactatctcatagtccagcttctcactctgctaatcctgcctcctttaatccctgacaagcattcttcagtaaacctcttgaaaacttctgtctgagagtctgtttccaatcagaaagaaagtgggtaaaagaatttccaatgcatactgggtacccaagaaattattattattgctttgaaggtaagataatttatttcaaggtattttccaggatatggatctatctatatatctatctatctggagatatatatatatatatatttggagttatatctatatctatatctatatatatctggagttatatatatctctctatatagatatctgtctggagatatatatagatatctatatatatctgtatctatctatctgtctgtttatctatctatagctatctatctggagatctggagagatatctatatatatatagctatctccagatagatagatagatagctatatatacatatagatatagatatataaagctacataaggaattctaattaatagtttgaaccatgagtagtgagaataaaattattctaaattttgacaagggaaattgttattgttttattttttaagatgttattttactggagcatattctaattagtctcctccaataaaagcagaatctttttatttagtaattgactctcatctgatactcttgggtactataattttgttgtttctgtatatttgagtattatcaataatccaaaactgatagaggtgctgatagtttatatttctggaaggctagaagataacctgtgaaaagctgatgttttatgattttatagaccgaaagagaagttaatgccacagaggttaagatcttattcactgatagagtgtaaactactcttatatctaatttagcagtctttttaggcatttctttcccgacttttatcaatctcaatttcttatttatactttgactttgcatttgtcttctctacttgttactttactagtgagttaaataaaacttggtcagatgctcactactatgtataagagaatgatgtttttcatgggaatgtgtttctgtttaagtattattagtttataaagggtagcattattatgggaaggcatccaaggtttcatgggggcaactggaaaagagaagtcagcattttgaagttagccaaaccctatcatgctaaattcaaactttgggtgtggttttgaagtatgtgtatttgctagggttgccataacaaagtaccacacattgagtggtttaaacaaccaaaatgtattgtctcacagttctggaggctgaaagtctatgatcaaaatgtcggcagggttggttctctctgagggctgtgagggagaatctctcccctagctgctggtggttgctggcaatcttcagtgttccttggctcatagaaccatcacccagatctctgccttcatcttcacatggctttctccctatgtgtgtgtctgggtccaaatctcccctttttataaagacacagtcatattaggttaggggcctgtcctaatgacctcagcttaacttgatgacctctgtaaagaccctatcttaaaatacggttaccttctgaggtactaggaattgggacttcaacatgggaactttggggtgacacagttcagcccataacagcatgattattttttctccattctcaaggattactttttccctcaagtgataccataaggagaagaatgtcattaactctggagagaatctcagtgaagtcatcttaccatgttttaaaatgaggtttgttgccacatcccacgccaagcccgtaccagtgttgccttatggatgtggttaggaaagttacacttgggaattaaatcctgtctgagaaatgagttcacaagttctcaggggcattcagctgccaggccatttttacacattaagcaaaaaaaaaaaaaaaaaaaaaaaaaaaaaaaagtcttttgggcattgcatttatttacatgaatataataaatacttccaatggcatttggattgcacatttgcatgtgtttaatatgatggtaaatctgtctgaggaaagtgtgcggtgctttctgattttgtattaggaagatgggttaggcagggaagaagaatgattcctttggcaaccgtggaattatttactgactagaagaggaaatcttctgtttgaataacccctttgaactgcctgacacgtggtggaagtttgtcaaatgtttgttgaatgaacagaagtgtccagggaacttagactgttttgagagcaatcaaaaagcacatatttattcagagatttaccatgtacctagctttggctggtgctgtgggggcccgctgatgtgtgtacgaacaataatagcagcaactatcgattgtgcttactctgtgccaagcatcctgcccaatttttttccactattctctgagttaggcgctatttttattttacgtataaggaaactgaggctaaaagacatcaagctatctgactacataaccattaattggtaaggtaaggtgtgtgcttaacttctgcactccagtgcctagtaaacatgtcctcttgctggtagaagtttgcattcttgttctagagacaggaaatttataattaaggcaattagagaagtagtatagaaaaggtgaattttatagtacgtctggtttgctatgtatatgtgtactgtcagcattttataaaagtgtcaggttgtgaaatggttaagtatataccttctggagttagatgcctccattcaaatcttactcggacctcttcttacctgtgtgttgttagacatggagcttacgtgttctccataagctccatggagaacatctattataaaaaaatgggaaatttattatgaaatagggatcataccttattattgtgagggatacgtaaaatatgtaaaaagattcagtgcctggcaaaatgtattttctgttcaaatgtaagcttctcaaaggcagcagtgattggggtctgttttatttgttcttgtaacctacacatttagaacagtgcttggcataaaatagacattcggtaaatacattgttgaatggatatatttcaatatgtaaaggcctgggcttagtcacattacagacaatgaagtagtcagatgtttgcacatctgtgtggaacagtggttcctagccaggatacacattagaaatacctggagggctttgaatggactcattcttaaaccccatggtaggcaaaggttgagtaccaatgttggagaatcactgtgaaggtaacaaacgtagaataatagttgtatattatgttgaagattcaataccaaaagtgattttttgagtgactcaatgggatgagtttcttaggaaacaaaacacaacctttggttcaatagtaattacatctttcaacatttcaatgtacattaaaataatcaaaaagtactttgagttcatatataatatgaagtaggatttaggctcaaataattacgcacagtttgttccctgacataaatcagaggtgaagtttgtgcggggcttgggacaatttttttattgcgtggactatcctttacattgtaggcagcttgtctaagtcagccaaaaagcactgtgagctgctttgaagacaagcaaagttagtgcccatatggtataagaaaaaagacaacaacacactaggtgattaagaactctcttggggaatcaaaccaagacactgagtaacttcttagacagctggttccttttctagaacaacaggatgagttcaccagtctctaatgtgtcaatctttaggaggtgttctgggtaagagacttcctgattctctggtgcttttctgctctgcaagaagaatcctgattctgttctcacgtgcagcatcacccagagagggagctggcaagatgaggatagatagaaaacgggagccacataaacctacaatcagactgaaactggaaccagaggaaattgagagaaatttgcaaagtgggtaattagaaaagggtatctctggcttatttgcatgttttccataaattttttttttttttttttgagacggagtctcgctgtcgcccaggctggagtgcagtggcacgatctccgctcactgcaggctccgccccctggggttcatgccattctctttcctcagcctcctaagtagctgggactacaggcgcccgccacctcgcccggctaattttttgtatttttagtagagatggggtttcaccgtgttagccaggatggtctcaatctcctgaccttgtgatctgcccgcctcggcctcccaaagtgctgggattacaggcgtgagccaccgtgcccggccttccataaatttttaaatttctatttatgaagagtatatgccacatgtttcattaaacacattgtaaaaatattaacactatcatatgccctttacgaatgtggcaaagggattccattttaatgttgaccacacaaagccgttttgatgtttcttaggcttcttaacactggattctaccttatttgcatttatttttaaagagctgctatgaaggatttctgactctctcaggcaagaatatcactgaaatgtaaggcatgggatataattcaaatcatcctaatcagatttctcaacccttgatctaatcagcaagctgtttttcttagcttcttggtcaagttcattcattaactcagaaagcatttcttgaatatagactgtgtctaccccagggctggaatgtaattaagattagtagatggattgagccctgtcctttaggagtttatagtcttattgaatgaagtgaagaaaataatatgatgctacttaaaatgtataatggcttttatattttaaatatattagaggtctttcaggtaattgatattaactgtgatgttgtattattgaaactgcattataggatattttcttttcatatctatttcacagttaatatcacagttcttttcaaagaagcatttgtgattatagccatctcctatgaagcgttgttgtgaaattaatagaaagaatcattggcatttcatggttttgctgaccgtgggcttgagaggattctgagcagaaggaaagaacaagttgaaaccccattgatttttttttaataggagcaaattgcagcataaaactactgccccctcatcccactcccaaccacacaccaagttctactagactcttaaattcgtcatctaccagcaagataaattcaaatagaaaaataactttcgctaacttatatttgaggtctgagatataataaaactattttcttattttggaagaaaatgtgtatgcatgtatgaattattggagaaaaggattttctcccatggttatttaaaagaatggaaagttctaatcagaagttatttcgtacaccctgttgtacctaaatatattttttctatttgtatgtccttttgtgagggcaattagagttacaaactggcagccactttcatgttttttacttatttttttctcctaattaatgtttatgtgtgtagacataaaaccaaccttaaatttgtatccacaaagagaaataagtgatcaacaaaaaggccttacttgtttctattcccaggctagaaaagagtgtgatttgactgtaatttctttcagggttaaatgtttgtatgtctctttatcatatagccacattatctttcatagacacacgtggcttgcatccttgaatcctaatttgattatttcagcaattggctcctcctggcagtcctaattaggaagagtaaccgggttttggcggtcagagtctacaagttctgatgagttaaactcatttgccctgtggtttctactggtgcctgacagtagcgttttgtttcctctcttaaaaaaatttttttgtatcaaaactgtctgggacagttaatgaaaaaatgaaagatctgtgtttttctcattaaaccaagatttagaaattcttcagccattctaagagtttgcacttgggtgtggtttggtattttttgtaaggacacttaatttaggttgtggtgactgttaaggaatcaaatgtagaacctgtgtattctgactcttcagagatctgattttcttatgaggaaaactgtagctcagagtccccatacagagcccttcaaagccagagaaaatcctaataaaaatgctaaagaagttccttcaacataggtggaggaaaactgttttgagatgaaagatcactgtataagattcttccactgttactttcttattgctcgatgatatggaatatgctttggggtgaggggccaaaattgatgttgctaattatttgccttggtgaaagtgaggaacgagaatattgtgtcatcattaaaggcctccatcttcataatgaccctttcggggattatataaagcaagtaaattgtctgttacccagtgggagcttttgaaagtaggctaccagcaagctcgatgtgatcgcttctaactactgaagacctaccccctatatctgggacttcctgtataggaatacaagaggcttaaaaaaaaaaaaaaaaaaaaaaacccaaaggtctagacacttgctgagctctctgacatacttggtaattgattaatggttgcacaatcctggattcttactggcttctactcagtgtttcctcaggcttgggggctactgttcatcttgctcaactttacaaattattttttggagggagtttgcagaggtcgctgagcaggatgaaaagattacctgcccttcagggttcaagaaagcttttaaattctgttcctattccttcccgtttatatggggcaagtttcttttcctttggggactcatttgtgatgggagtcaccacagatctggccatcactgctttccttttctccattccactgtctggagctttgttcctctgtgtagtccaaggggttgagaagtctgaggatctgggcctttctggggatccagggtatctgcaggcctcatctcagagatggcagattcttactgcagtgttcaggtcatatgagattagctgaagacagccaaatgaagataaagtaaataatgcaattgctgatgttttctttagagctccccttgatgggctttggaaagttgtggtcccagctgcttaaatgtacatgctcccacagagcaaagtctaagaactttagtgcacagaagagaaccttaggagtgtgtgtaaatgcagcttcctgtgcctcaccctccaactgattcaggactcagagttgcagcatcacaagaccctcctgattctatttcaggtacttctcagaccacacttagatattattataggggaaaagcccctctcccttctagggagtgacttagttcaatcacaaatcagcgctcatgtttaagctctagacccttgtgagacattttttgggaggccattcagaaattgaacttccacggttcctgatgatcccacagatctccctaggtgatctctgctttttttttcttcttcttgctgttcttattctcaccactatgctctaaccgttcttcccttccctttgctcagcaatgatcatatttgctttgctaaagtagcccctcttgtttcatttctttgcagaccaagatcagggctgactatctcaacctctcccaattcataccctcctttctgacgtgaattctgttatgttccactcaacaaatctaaaatctaattagtgtttttaggctttatcttactgtgggtcttggtaagttattgaatgtgcaatttcttggcagatgcaaagcagtcttttcccatttagaacctcaaactcatgtagtcctctgcaggggtaaggaggatagggaaaggatgatattctcgagaggaaagcaaaataacagtgaactttcagctgtaaccagcttggagaatgctttgctggaaaatggaggaatttcagtaggagacctcatgagcccatttttcttgcttttagtcgctggcaatcttaaagttgttcaagtatggtggctgcccaaaccctaggtctttttccataaatgaagagtcaagacctttgctctttccctctactctgaatagaggattatattttaatttttggttctgaagcactatttccccacagtggtccccttgacctccctgtcttttgggacctgccaccctctttggacaccatgcactttagagaggtatattccaatactttggtaaagattttcagatgtggaagaggctaactcaggcattgtttctaccccatgggaaattttgagctctgtatgagattctgatgttggtttttctttgtttttgtttttgtttttcttcttgctgcaggaaagcaatctcccgggcaggcctccagcatctggctcctgcacatcccctcagccttcctgtggcaaatggtccagccaaggagcccagagcgactttggactggagtgtaggtgttggccttttcatttaaacatcacttcagtgcatgttttgtgtctctcattctcaggattcctctagttacaaggaagacttgcttaataattttcaacattgcctgctgacctgtcctcagataccttagctgtagctccattttcaaactcctatgaacatcactcctttatatgaagtcagatgtgttcaagactaagataaaagcttcctgaatcatttgaagtattactgcagctgtaagattaaaaagtacctcgtgcgcagtctttattggtttctgccaagttgacgatgaattgagcttacccttagtgcaacatctcgcaatctaagttttgatttcctcagcttgagctgagtttttctgggtgctttttttcccagaggattacaggcacttcatgtcattctattgcttttccttcctcccttaaccaaaggcagatgggtctggcatcagtaggttgggtatatgagctgatgttaacattttaaccataacacactcacaaaaactattaacttgacttgaagattatagtctgaaactctttagttgattaaacacatttattgagagtcttcagtgagtcgagttcttggccgagtaactgtttctaactgtagacccaaaggctttgtcccttcctgaagcaatatgaggaaaaggtatcaagggagagaagggcttccctgaagttctgccagccttccctgatgatgaaccttgtttagcacttttagttgagtctgaatagaagggataatccatgttctttttctccatatgaaagagaaaggtggggtgggggaaaggtaacccatgccatgatttgatatcctctgtattatagcatttcttcctctcctctcagcacacacttattaatatccttattttacatcttggatgcataccaatgtaaatgctgcccacatttatgaagtgcctggcaaaagactggatgtgcttgaactacagcttctcccttggtggagatattgttaccctgagagtgttcagatgctgcctgagcctgttgaattggtgtatagaaagaatattcctttcctggagtttacttctttattccaggacagctatttaataaactcttaacccacaatagagtatatttgcaccagtgtttgcataattaaaaacaattaaatgcataaacataaataaaacctaagagaggtatgcatggagcaatgatgagagtgtattatgtatcaaggaaccgaaagagttggtttgatattcacgatgttccaaacaaccctgtagtctgcagcagcagggccttctttgaggtgagacattccaggggtagtttaatcatttagaggcgaacattcattaaatcccttctctgcccttttgtgtgacattaggtaagtcactgatttctttcagcttcaacgtcctcatctgtagatggggataatcatggccctatttcatggacattgttaggatcgaatgtgacaataagtgaaaaagttttttttgtaaactgtgcagccagcagatttatttgttaaagtaattgatgaattcattaattcatcaaacatttgttgagttcctgctttgtactagaatctatattggttacttgggattctgaggtgaagaagatacggtttctgccttcaagggtcttagaatcctgtgggcagaaaggaaatcaacacgaaaatacagggaaatgaggacgtcactggaatgcaacaaaaggacattccattcccatttgatgttggaaatagttatcagaaaatgctttttaaaagaagtgtcctgcctgagccagagcttggcacaaggtattattttctgattcctatagagaggtatgtactctaatatttcatcaaaatggtatttttggccagtggtgggaggctgcagtacagaatgagggaaaaacaaataggaatgaaggctgggtttgtgcctagtgatcttttatccctccctcttctccccttttctttgattttaggtaccccatcttggaggtctgttgaaagtatggcatgacacgaaacacttagctgacatctaacaatggtgggaaaaccgaaagcccttccttgagacagtccatctgagggcttagagatctgatgtgtaaggagttatgagatgttactctggaaaaaaaccaacatctttgtgggctgattttggtgtcagcaaacagaaagcaaaccgtgaccaacacactacactcatttattacaatcgtgtaaagcatttgtttcagaaaagaggaaaaagccgattgttaaaaatatttcagtgactttttctttggctaaaactagattacttgtattactttagtatgctcttctgttcaaggagccagccagggatttctttgttctgtttaaggtgcaaaaacagtcacctctctgtgccattccctctcctccactctcttgtttgattccctcatcttctaccattagtctactcttctggactcaatgtatggaaatgagcaatctttatttaattcagtattactatttattgagcaatgaaaagggttggagcctctttgattctttcaaataaaaaggaaggtggcaggagcttataaaaaaggtagggggaactccagtctcttgcctttgataaggtagagggccccaatagtgctaagttgtgcttctgaaggtcttgaccacagtggcagatggggtccagcagggacgacgagggtcctgttgttccctttccccacttgactcttgggtggaaattctctctgctctgtaacactttggctcaggggaatcaatgggggtcatctcaaaggcgtctactactatgattctctggcttctgttactctattcttcttccttcatctgtaaggaaaaagattaaaaaaaacgttcatggtgtgtctgaagttgcaaagtcagagtgaacctggagttaggatcttagtccccaagtttctacttattgtggaatcccaaaagggccgtgttctgacactagcctatgtgccaaagtcatctgaagggacacaagtatttcctaaatatactttggcaaaaggctttgaggagaagtctgtttgtggggtgcctgagatacaggtgagcactgatttagtgcgcatagactataggcacctgcacttcttggccaggagggtgctgttatagcagacagtttttatgctttgggtacattaacttaatacttctctttaagcattccatttttatgttctcatttccttgtttgtgatatatacagtctctctctcttagttttaggttgtttctcaaaatcccaaacattctctcctgctgtgttttactcaaatggcttattatgacttttaggattctctgtcccacatgggctcattctttgaagatttttcggcaatagatatttactgaggctgcctgtgcacagtcattttcctccgtgcatgtcagggatagaacctgcagtggtgtgtggagagtatctggatcagtcttcagtatgatgcctgagtcttctattgacagcagtggacactgggctctacccagtatgaaaattatttcctctagagattttctcttttgctgtctgccaagccatgctcatcttttcaatcaaactgattctatgtatctgatgtagtctttgctttgtatcctcacaacacctctctgttggtagtgcattgtcttacaaaccttagaaccaaattagtgctttttgtttgactttcttatttgtggctgtcagatttcaggctgcttaaaaggaggggcaatgttttctgcttgttttctcttcacagtggagagtgcagcatcatagacctagtagctgcttggttactgatgtcaggggatgaattgattacagtttttctgctcaatcagtgagaaggggatatttcgctgggagttgacaggcactcagataatctctagttcctgaaaggcttggtaggcatgactccaaagtctgcttgaaaaataaatggatttatgccgttttaatcccaagtaactgtctttaaatttccttcctaattcaatgcattgtgttagattttaaggcgcacacagtactttggccttcctactcttcacaaggacatcatcttttcacttccacagtgacagcctgcagcagctgccccctctgacactggatgatgcctgtcagccaagccagttggggtaaaacaagttaaattactagaaaggaaggaagtaatgcctaagaaggaaaaaatattctcatctcctgggatggattccaagttcccagtttagagtgaattagtccatttagaagcatgtctgttccacagataatgtgtatcttcttttaaatgtcacatgtctcccttccaatggagacttcatttggacttccagcactcttccctgtttgtagtactgcagcagagagcccaggaagtgtgtctcccatctgtccccaccatttcataatttgtttttgcccattacactgcctaaaacaaccccctgaacagtggtggaaaagccaccaagatctttcttaaagggcacattggttttaaacccagcacccttgattttattttgttttccttcctcattggcaaactttcttcggtcccaagagctgtggaaaacagagcctcaacacaaacaaagccagatcttcagtccgaaccacctttcctttcctttcctttagttgacgatgctaagaaacactttctctgaggcagatagaaacatcacacagttggtgcactgcctcacagtttggttcagggacaagattaaggaaccagagtcttcatgtgggattggtttaaactgggttatgaaactaggtcatcttatctttagaaaccttgaatgaaaagccagaaggaggcagggctgtgtgtgtgcatgcgtgtttgtgcgtgcgtgctcgtccgtgtgcatgttctcatttcagtcctgtttcctgtgagtcctaggagacctggaccttaattttgggcgtcaggcccccctcttcatcaggtctgagtgtcatcacccacagccccacatctttccccactcccagccccatttcgaaaaactgaagtcagattaatcgataaatgagactgtttgttgagcagcgcataaggaactactcactataaatcagtgaagatcccagtcctggtcagccacgtaaatgaagggacaaatcgaccttaatttcagggactctcaccattcctttattttctgagaacgggggagtttttaaatcaaatcaccctggctgccgagggaaatcatggaattctgtaacttcacagacctgtgagaagtgtctcggtctaatcttctgccccgaggcaagtgattatctaaacaaacgctgtccagtagaaatagatatgagctgtaatgatacattttctagtagccacactttaaaaagtgagaagaaataggtaagattatttttaattccatattttgtttaagcaaatatattcaaaatattatttcaacatgtaatcaacataaaaattattagggagatgttttacattcttttctcacactaaatcttcaaaatctgctgtgaattgttcaaagagaagcacatctcagttagtgctaaccacattttaagtcctcagtagccatctgcgtattgtacagcacaaatctaaaacatccaacatggtgtgttatcaattcttgtcctgaagattttcaaggggaggcaatccactctttttcctttttgattttgtaaggacatttacataggatacatatttataattctcattgtttcaaaacatttttataagcaagcgtcttcattttgtgtggagtatttgcttcttgtgtgagcatactctttatctgtgttattcagtctcaaacactcacctcacctttgtctttttgcctgtaaccattactagaatttcggtagcacttgagcaagaaaacatgcctatatctagaaatctgtatttatgtctatttaggtgaatctccactcttagatgaatagatctatcgatgtaaatctatcaatgtaaatatatatatagctatacagacttgtgagtctcagcactcacaagtacagaagaagtgctatctttgtttagaaataggagagttatttttctgtctggcacagatggagactctttgagttgtatactatttgagatggtatttcgagatgcatgtgtagagaagagagaaagatgtttccaggtagggacagtagaatgaacaaaaacgtggcaccaaaaagggaaatgcgaggtatgtttcaagaagagtgacagggagcccagtgtgttggcatatgcctgtaatgcagctactcaggaggctgaggtgggaggattgcttgaatccagcagtttgaggctgcagtgagctgtggtgatgccattgcagtccagcctgggcaacagagcaaggccctgtctcaaaaacaaacaaacaaacaaacaaacacaaacaaaaagagtgacaaggataaaagagtgacaaggataaaagagtgattgatgctgttattggagtctagtatgccaggttgaatttggattttattttataaatagggaaacatctaagcattctgaacaagggagaggcacaatcatggctctcttttggcggaaactaaatttatactaacgttaaataaatcggagagggtgtcagagttcagagcagaagaaaacaagactccgaaattagatgcactgtccagcgtatagtaagtaattgggggtatattcagataatgaaaagaaacctagacaaaaataaaagcaaagggaagaggcctgcatttgctggggtaaatgaggctctgcagcaaatgaaagactcaaatgtataatggcttaatacaagagagtgtctcacctatgtcatagaccaagactattccaggtggttggctgggtagtcaggccctttctcacatagctattcagtgacccatgctgaggatcactctgacatctcaccaagaggattccaaaagcctgacttcccaattgaccagtaagacaaaaaatcatggaggaatgtatgtgggaggatttaatggaacaagtctggaatttctgctctgtttcactgttcagaatttggccacacctaattgcaagagagactggggaaataaagtctaactatgtgtccaggaaaaggagaaataattattttgaggactggctagcagtcttggccacaaagaccaaggagagaaacgtagttaatgctaacatctgtggattgggaggaagaagggaaactagagagtaatagcaacaataataaatataatgaacatctattaacttcttgttttatgcggaacattgggctttatgcatttttatgtttaaacatcattgtagtcctgtaagggaggtacagtgatttttatgtgactgatgagtaaaatagggtctaggaaagtgagaagggccctgagtcatacaactattgggcaataagtctgactccaaagctcacattgattaatatggagctggagacgggttcctgagaattgtaggaagaaaacaaaaatagttcatttgtctactgcattcttgtgctaatgccacccaggctagacaactttatgcaggattcaagagtccccaagactaccctgtcttctgacatcagttgcaagttcgggacccccaagaccacactcagcttcagtaactcactagaaacactcatagaactccctgaaagctgttaatactcacatttgtggtttattacagtcctttccacgtagaatcatggttcactagctaacttctcccagcaaccatgtgctataatatacatggcatagagccaagcagggaagctcattcgaaccttgatgtccagagttttaagtgggggttggtcctgtagacagcgttgactgcccatttggttgacaatagcctctagcccctctgggggtcaagctgataccttatggcccaaggccgccagacaaacaaaaacacttttatcaggcaggactttccatgggcttagagattactttcttggagctgaaagctcattgctttatcagtaggttttgacattttacccactgctacattttggacttcactttctaaagtagttagtgggattttgctgtggtttccctcatattggctgctgttattatgcatctagttccatcttctctggtagatttttctccattgattaacacagaatctcagtgcctggcaccagtgttatcgaataaagaattgttgaataaattaaagaataacaaaatgaaaaggcattattctgtataaatggttataacttagagttggagaaaagttcccagtagtagaatattttaggttgtgtggattgatgtcttcaggataccttgcgaagaagtgcctttctactttttttaaagtgttgtcatcatccatcactatctgaaaacttttagggtctgaacccatagctatgcttctcttgcatctgctgttgtcccacaaggttgactgtgaggtgaagcctattttcccattgacttccttgaaaaaattgaacttgcaacagggaaaaattaccagtagagaagaaaaagttttggtgaacaggtgtccaccctttgatgtagagggcaatgatcctggtcagtgttgctctccctttaggaatggttttgaggcactgggagatgtggatggtgcactcctaccaccagggtctccctgtgcgttgtcctgaagcccttgacatctatatccctagtgactttcacattctcttgtcccttcctgcctcacttctgtggtccaggacttggacccacctttcttggatcctgaagcacctacatcacatgtcacaatacaaattttggttgttcttaccccagaattatttgagtcactaggccctgaaaggaaaatgtgttctatctgaatctgaagaaatacgtttattttaaaagatgggtgacacttggtattttttcccagcaaatgtcatttagtgtatattccttttttttttctcttttcttttgagtcagaatattgatccattgcccagactggagtgcaatggcacaatctcagctcactgcaacctctgcctcctgggtttcaagcaattctcttgcctcaggctcctgagtagctgggattacaggtgcctgccaccatgcctggcaaatttttgtatgtttagtagagatggggtttcaccatgttgtccaggctggtctcaagctcctggcctcaagtgatttgcctgcctcagcctcctgaagcgctgggattacaggcatgagccactgctcctggccatttggtatatatttctgctttgctgtactaagctttgagattcaaagggctatcgtgtggacactgctggagtaggttataataaaagtggctcatgtataagatgggttttcattacatgattattctatagaatttcttattgaagtcatctgctcaggctgctataacaaaatggcagacttgttagcttaaacaacagacttcatttcccacagttctggtggctgggaagtccaaggtcaaggtgctggcagattccagtcctgggtagaatcctcttcctcacttgcagacagctgctttcttgccgtgtgctcacatggctttttccttggtgtgtgcatgaggggaatctcccatgtgtctcttctataaggacactaatcccattatgagggctccacccccatgaactcattacttcccaaagtctcatctccacattctgtcacattgagggtgagggattcaacattggaatttttttttttttttttttttttgagatggagtctcactctgtcgcccaggctggagtgcagtggcatgatcttggctcactgcagcctccacctcccaggttcaagtgattctcctgcctcagcctcctgaatagctgggattaacaggcgcccaccaccacacccagctaatttttgtatttttttagttgagatgaggtttcaccatgttggccaggctggtctcaaactcctgacttcaagtgttctgcccacctcggcctcccaaagtgctgggattacaggtgtgagccaccgtgtctggccaacatatgatttttgaggagacacagtttagtccatagtatcccccataaaaaataattacatgcccatgtacatctgatgaataaaataaaaacaagagtaattttcctgtaagccatggagacttagtcttgtttctttatggttaatctaatacaatactttccctaacagctcagagctccttttaagcaaatgagcaaaatatacaattaatatataaatctataatttccaagatagagtcccataagaaggaatatggaattctattcatcgtacgattaaaaaaaaaaaaaaacagtttgcttccccctttccccaataccgcactacacatttctggaaaatagggttgttgctcatcaggtcatacattctagcagctctgttccccatccaaagtatatgaatatttttagaagcaataacatttagtttgaaaaattgagaagtaattgggtgaagaccttactgaattagtaagatgtgaattagcagaaacgtattatgctttgagtacacagggacttagttttaagaagcctctgcccttagaaatataatttacctattactggtataactgtgttttcaaactgtctttacttaaaatactttaatgctaccatcctcctttttagctaatttgttaagcttattcactaagcaaagtcaaattttaatataattttagtctcagttgtcatgacatttgcagtggtgggcctggtgaataaggtttgacatcgaactatttagaggtgttttttcctcatttgttgaatatgtttcaaaaatgtccacctccatggataaagcagctataaacctaatgtttattttagttatagctcaaagtttttccaaacacctttctccctttttagaatttcgggagaatcaactctagcagtacttttagtggtcaaatgagaaatgtttagactccttggtttcactaactttcttgtatcccaaatctaaatttgaaatagttttccttatccctggaaaaaaaaaattgatgtcaggtgggtcttttccttgcaggagaatgccgtgaatggagaacacctgtggctggagaccaacgtctcgggagacctctgctaccttggagaggagaactgccaagtcagatttgcagtgagtgtgcgctccgtcttgctgggggaaggcctgtggatctgaatgaatagaggggtcaccttgcctaaatttccaaggggaggtttgaacgagcctgtccttgtgagatggaaaactttccggatgttttcaaggtttgcagagagtttctcaagttaacatggctttcaggttgtcgctcgtaatggttttagggttcacttatgcaggccaggccttggtgtcatgtgttactttataatgatgcccagggtaggttgttgtgtgttggtggggggcagagggtaaatgtgtacgaggtagtgtctccttatggaggagttgttggtgtggggccaaggcctgtgtgtggaggaaggggctctgtctgtagggaagtggccacagtgggggctttactggtgggtgaaggtggaaagagagggaaacacctgtgctgggaatgggtgtaggctaacaaataatccagactaagttctggaggatacgattctagaaataatataaacaatcaacagtcaggtcaattggagttaacttttgttgtttaaaatttgctttgtgtccctatttagaacaatctatttagagggttaaaattctctttatgttgtgaggtaagtgtggttgccaagtagtgcattgtggagatatcaaaaccacagtgttgagaaattgaacttaaagtttgtgtgtagttttaaatgattggtccaaacagacagtaatgggaagcttaggatagtaaagaagagataaaagatgtattccttcttatttggggaaattagcaccagaatttatagaatgcttttttcttttttaaaaaaatatttgtttattatgtgaaagaaatatttgcagcaagatgtagggccttgaaattgcagatgaatatgtgtttgttaataaccaatatggaataaatcgagtttccatcaaagcttatagaaggatatgtatagcccccaacgattttaaccaggctgcctaaaagcacaaagtcccagaaccaagaccttttttgttgctttagctgttttaactccttgtttataaatttcatttggagagttttgagagttctggggagaacagggcctgtttaagtgaagttgggaatcaatgtcagggaaagacccagatgaacaggctctggattggaagtcgggaaacctggagctgaatctcagtgttactgctcagtgtgtgacattgagaactcgtgacctttgggccttggctaccttctaaaacagagagtaggattaaattcttttttattaatttatttttgtttctagacctgtaattaatcatttgcttctcttctaattttgttgtaaatttaattgacttaaatatcaggatttcaactttatgcatatgtatttttaattaaagtataattgcatggaattggattgaattaacgaaatccatgagaagctcagctgtttggactaaaatgctgtaaataatgaattaacattagtgtcttggttaattgcgtaaacactggtcctgggatgtaagataataaaaaatggaaaaaatgaaagccagtattacttacatatatacttttgaacaatttctactgatggactatgattttatacagagtcatcccttatttccaaattgctccctttaatccctttctgttactttttaggggatggctacctctcttgacaaatatatgaacagatacgtatatcctctttaaaccttgtatcagtaaatagcattgctatccactgaatgattattacttgttcactaatacctttaggccaggaaaagcaacaaggagaataaaggaaattttaggtagaagtaggaagaaacagagttgagaacgttcccagtttccttctgaagcttcctcataatttcataccaggtacttggccctattaactcatattacaaaacgtctgaaagatgaagaactctcctccaaaaaaatgttggttaaatgaaggaataaatcagtgaggaagctgaagacctaactgctgtaagtttcttgaagctcagtttctttacctataaagtgggggaaacactgttttgagggtttggtgagatgatacatagaaagggcttacttggctcagcaactgacctaatgaattaaaggcaaaaaaagaaaaaaaagaaaaaacccaggaaggacaaggacaggaaatttacaaaagaactaccaattgccaatagatatctgaagaatacaaaggcatcccaattaaaacaactcaggagtcaacttcatgtgcctattaaattagcaaagatttataaaatggtaatagttgctgctggttggtttaggctgaaatgggcaggctcatcatcagctgccaggagtgtaagtagatacactgtccttcacaaaattggcagtgtgtactgaaagcactgaaaatcctctcagtctctctccccacctcgcactgtgaggcgcatgtcatctctgggcatcccattttgagagagacattggcaagcagcagaggacccagagtggggtgcccaagttggtttaggggatggaagcttgttgtaaagaaatgttaggttacatgggctacagctgagtattaggagcgaaggcagagagatgtcttccagtatttgaagagttaatttgaagaaaagagaagtgacttgctatctgttgttagaaatggaaaagtcatagaggtagaatccactgactctaactttataacaataaacaaacattacctgggaaacctaacaatgcacactcctgtttccctctttgctccaaatgctgattcagtatgcttggagttggacttgagagtctccgattttttttttttttttttttttttggatgtagtcttgctcggctgcccaggctggagtgcagtggtgtgatctcggctcactgcaacctccgcctcccgggttcaagaaattctcctgcctcagcctcctgagtagctggggttacaggtgcaagtcaccacacccagctgatttttgtatttttagtagagacggggtttcaccaggttgaccaggctggtctcaaactcctgacctcaggggatccacccgcctcggcctcccaaattgctgggattacaggcatgagctaccacacctggctgggagtctgtgattttaacgagcacctcaaataattctgatgcagatgggtcgcaaacctaactttgagaaataccgtatgataagaaagaactttgtcagcctgagcttcccagcaagcgaacaaggtgcctggagagattgactggtgggatgtgtgtttgtggataacgtgggtggccatgtttcaaggatgctgtagttggggactctcagctgctttgggcaagaggtcacagagatctccaggcgagtctttagtttaaatgctctgtttgcagttttcttagaacaacagtcttttttgggaaaaaagtatgcataagcagatcatgtatttatattctaatttcttttaatgaaccacctttgaagaaagcctacctgttggggctgggactaaattaccataaccaggtactacctgcaggctcctaaacaaagtacaggcagagtgctcaggggaggagtgaatccatcatctacgatgtgcctttcactccttccctattttagcaaagcaaatgtcacaagtagaagttaagagaaggaagaagtcagtgtgggttgaagcagacagaggcagcttcatggaaatggggttcgagctcagttttgaaagatgggtaagatttacataagtgattttgaagaaggagaacatttcgggcagggaagaggaacatgagcagactcagaggtggggcaagctctgtacaaacgaggtggcaatcatgagccgtgcatgagcatgtgtcagagaaaaatggaagtaagaatggagttaggttttttgaaacaaaacttggagtgcatattgtaaatactggtgggcttaggaagcatgactatagaatacattgtctaaaccaagacacttttgagggtgaaagtggctgctgttaataatgatgccgtaacattagggataaaccagaactgcatcaccctagcttatgggacattagggcatctatgtaaaactaaaactgtcctgcaaagccgggacctcctgctgccatgtggattgatatttggggactgatattggagggtactgaaagccaggcaatgacttccaaaaccctagaacagctgtaggagagtttgttcccaagcttcagggctaaaactaaaccacgtgaccttttcctgttctacagctctctggtggcaacatttaatactgtagaatacctgtgagcagatacgtaatggaattaaatttgttcccaaattggcaacagttcccaaattagcaactgtttctttttctggtctagataaaatataaaaggatgcaaaagtaatgaaattgaagtagaaagatcactgtttcccaacctgattatgggcactggaaacctgaaataaaattccagccagaatcactgtcgtttggtgacatttatttttatgtacatttattcatttattcattcatttattctgtcagtgtttgtgagctgggttgagtacccagtgcctcaccgtttagcgggcacagccagatagaaactgttctcatgctctggggctaggctatacaaacatgtttagccaaatatttgtacctaaaggagctcacccctccagtagtaatccctggagtccataccatcgtgcacctactcagacttgaaagaaacttgcctacattgatatgcaaattatacacccaccgtggtcacacagacctgaataggcacagatgggtagcatgggtggtcagaaggaaatagactttgtgtggactgacctgggtttgaaaacctgctgttccatttatgtactgagtaaagttgggacatatcactttgcctttttttgcctcagtttcctgatttaaagtattgctactgagatagaccacagcgattcttatttctggatgagcattatagtcaattatgccattttaccttttaatcttacctttgaagtgttggttcccattctggatgtaccacatcaggatctctagggagtgggactcagcctgatgtcaaaaacaaacaaccagatctacagatgattctcttcactgtcagggtagagagacagtgatccacttcagaaacagagtgtcaggaccaaaaaccgtggcctggttctcacacctggtgtgtagtggctgtgatgggctaaatagtgtactccaaaagatatgtcgaagtcctgacgcctcaggacttcagtacctcagaatgtaacttgatttggacatagggttgttgcagatgtaattaattaggatgagttcatctggagtagagtgggccctaatccagcatgacatgtgccgttataagagaagacacacgctgggcgcggtggctcatgcctgtaatcccagcactttgggaggccgaggcaggtggatcacctgaggtcgggagttcaagaccagcctgactaacatggagaaaccccatctctactaaaaatagaaaattagccggggtagtgatgcatgcctgcaatcccggcggcattacaggaggctgaggcaggagaatcgcttgaacccaggaggcggaggttgcggtaagccgagatcgtgccattgcactccagcctgggcaaaaagagcgaaactccctctcaaaaaaaaaaaaaaaaaaaaaaaaaaaaaaagacacacagagacacacacacagagaagaaggccatgtggtgatgggggcaggaattagagtgaggcagctgcaagccaaggccctccgaggatcgtggctctcctcagaagctaagagacaggcatgaaattcattctccctccaagccttcaaaagggtgttcaaccttgttgaaaccttgatttcagacttctagcctctaggagtgtgagagaatacatttctgttgttttaagctacccagtttgggttccccacagaacacccattgccattgagtgggatcttagtattcagtggaaaagtgtttgagaaatgctcacacaatgtttgcagttttcctaggactcatactcatcatctctgatccataacaacaaccttttggggtggtcatatcgggctgttcacttctacctaaagataaagaagagtcagagaggcttactcactatccagagctttatggcttctttgctttcttagggcagtgctaggaacctaatatagtagccattctataagtcgagttaccttatctagccatgcagataccgcagttacataggctcactgacacgtatgcacacaggtgcgtctacagcaggcttgagtgtttaggttgagtggtatgtggttgaggtgtaagtgagcagacaggcaggttggtgtcagaagctgggagctgcagggaacagagtaggtagatggtgaggtgagtgagcgtgtatgttgtgtaagaggaaaaatggaactgtcagacttcaggatgctgttaccagatatatcttctctatttttaaatgtgagcatgccaccctctttttgtggaccagctaataggtactgctttgcttttgttattgttttgttcttgtattttgctttagtcttttcctcgtagataatgtttggtgaaaatggcttaaccctacctgtgacaccctgccttaattctaagttttcttctaatgttgcttgcaatttgccaaatacagttttactgagaaagtgaatgaattgagttagagaggccatgtgatatgagagttggaggattggagggcaagagcttcacagatccagagacaaaaagatctagataaaaatgcaagttctgctctgcctttctgagcctcagtttcctctgtaaaatagtggtgattaaatctacctctcagaatcagtagagggataaaatcagttaacaaatgtttgtattcattttcctcctcttctgtacctactatggttcaatgtcatggagctgaacaagctaattagcagatttggttggactttggcttaacaaggccttatatttgggatgattccaacactaagactcttatggcttcacctgtcattttgctgctgtgtgtagcatccatattcttaccaagtcatgactgcggacaactgagtgggacaaatcaaagtaacccattctgtgatctcatctcacaagctgtgtcttcttattggtgaatcagaagcctcatcattgtctgtaacggggtatcacaatatttgctcacaggaatgctggtcatgtccttagattcttggaagaaactttcaagaagagtacaagggtcatagctttctgccctatttgaaggaaactttcagctttctgctgtttaaaaatgaaaatgattttgagcccagttacaccttgtctgtttcatctcaggaagaatgagcaccaggcagcagcttgtgaaaatgctggttcccatgcatctgtgtgtgtgggtgagaagatgaggcaatcagagcccgacatgcattactggggactttctggccatctgcgtattcaggtctagctggtgtgtaacatggagcaccagcattggacttagaatgcaccaagatctgcctgcatgttgctcctgctctgtcagcctcaaatgccagttgtctggcacagcagactcatgatctgcaccccagatggcagtttggctgagctgggtgcaggctgtcagagggaaccacgtgtgtggcaataaagcccaggaggcaaagcccgctctctgagttgtttgggtgccagccattctctgccaggggcctttttcaccattaggatattgaggatctaatgaatcaagatgactcatggaaagtgtggccatcaacaaaaataagaaaagaattttcacagacacactgtctgctactgagttcctagtcagtggatatgagagagggagagagtggggtgctctcagtggcagaagtaatgtcaccctttaggtgtctggcctgatagctcagcatttccatgagatcgttcacgtgcacacttagtgtctggcacatggtagaccctcaggacatgttagccattgttactatgacaactgtcatggggatcgttataatttggtaccaagtgctgtctgtatattaaaggagaatctagtgctgatactgctcacttcatgtaatggggatagtgatagtatatgtaggctatgaagccaagggatctttaggattctgtcacttctaggtgaccctggatcaatagtaccattgtctatttgcacagcccattttcttttgacccaaaattgtgttctggagaacactaaactcaaaagaaaacaatatacggcattatacattaaaaggagctcatgaccataaattttgaaaacactgaatgactttaatatgcaaataggtcctgtgaagctcaacgaagcatataaggtatgcaggatttcctactttttttttgagtggatgggaggattgtggaacccataatttccccacagaacacccattgccattttgtaggatcttaggagtcagtggaaaagtatttgagaaatgctcacacaatgctttgcagttttcctaggactcatactcgtctctgatccataacaacaacattttgaagtagtcacattgggttgggttgttcacttctacctaaagataaaggaaaaaaagagtcacagaggcttactcactctctagagctttatgacttttttctatctttgtgcagttcttttgcctttatactaaactttcattaagccaaaatgcatgtgtcttattttattcttagagtttgaacctctgagaataattgtcatcttttctgtcatgacaattttagattgaggctgcatttgcgtgtttgtgtaagggtgtgtgtttctgtgaagcagttctgttgttattggatattgtatggtcctgttacctagtaataaaaataatttgcatctgatttagcataaggcttacatgttacctaggcaatgcccaggtgtacagaaatggtttctcttcttgcaatgttttccaggggcagggacccacagtactggggtttaaccagtattcctgttgcttagaggcactcaatcttgatggaagcattatttgcattatcggttactccaaaaccactactggcccccaaagttggtattgtctctgtttgttaggagcttgttgttgttgttccctgccacattgatgaggtggatacatattcagaaggtgatgctttaaaaacacgaggaaatggaaaatcctgcattgatgccttcatttaagggggtgcaggtaatgtgttgatgaagcgtgtgagctttggaatcagatgacctggttttgaatcctgatttccaggctttgagttgtgtgacactggtccttgttttaacctcgttaagcctaagttttacatctggaaaatgggattatactgcttcttgtggttgttgtgaaaattaaaagagttaatgcatatataacagcaggctggcaaatcacaggcactcaataaatattgaccactataatcattcctccttgaatgaaagtggttccaagaaacagagccaaaagagacaactcagagtactaggtttggagagtcttagcatcacctactacctctgtttcctcgaggaaagttaaggactgagcttgtgaggtgaaacaactagcctagctgacagtcaggctctccctcccctcttgctccttcaccattctgtcaaccttttacagcacacaccacttactagctatcatacttttaaaaattgctcgcttatttatctgtctccaacactacagcataagctccatttagctcaggaactctgcccttgttgtcctctcctgtattccccacactgaggataagtgattgaactgaatagttaccctgtgttacttaacattgaatgaatgaatgagttcaatgaggtgcttgttgagagagagacacatacacacacagacacctgtcaccagatcaaccctgccatttaagtattgttatatttataatccaggacgtctgaattcctgcctcctttttaagactctttagagggagatttaacacatgcaggtagctgacttgtgtaaggttttatgccctgtttagccagtgccatgccttttgcagtgcattttatttcattctcgtggagaacagagactgctttttgccatcttggcacagggggtcatgtgtggttgtcattagtcagttcccctagggatctcatgagaacagatcatatgaagcaatcacgttaaatatcatatttcttatctatcctcatcagtcttggtcccccaggttaccactagcaaagaaaagaggaaaacagtaagctgtaacacatagagatggctttgggttagaaagacttccactcttagctagtctttcttgggcaagttgcacagtctcatagggtctcagttcccttagctgggtaagtcgtacctacttggcatggcagaagtgagctctgtttacagtgtgggtaatgtgtatattacacagctagcctcctggcaaatctctgtgggtatgatgtcctcattaaaaaatgaaatgggcgggtgtgtatgtgtcagtgaaaacattaccaactggaggtacagtgttgagtaaacaatgactgagatgtctgtgggtcttcctggactagattggctggaagactgccttaattatgtcaccaaatagcttggaatgtgaaaaatggcagtgaaaggataactaacttaccacagcttgatatcgcttcttaactagaaatacagtattccatatcaaagcaaatatctctaaatttttggttagaaatattaagctgtgaactttaagaaaataattctatttccacaaagtaaactgataatggaaacatgtcaggattcataatacaagtaagatggtgtttatggtactgtcacaccagcaaggactgaaaaaggcaaagtgtttgggatttcctagtttatactaaggctcaaatctctgctgtacccgtgatatgctacctcagaactagagaaagccaccaagacatagaaacaccattttctattaacttgttttgttatgacttctgtaatatgtctagcccatcttcactcaagtctgtctgcttgaaatttgtgaatgcacatgggtgtgtatgtgtgtagggctctaatggtatgaatttctacttattagtgtctgtgtacctgtaattatatttatatccatatttgcgtgcatatcaatccttcaattactctactataagacacctggcaactttgacctgctggcacaaataataaccttgaagagcgtgtaaaaatatgacaaggaacagccacaaaaccacctgtaaagagccaaaatcaggaagattgcatctgatgagttgaaactagtgaccggctgtggttgtatactgacttctaagctgagaagcatagaaaaacaaatggggaaaaagaaataagagaaaagagaagcaggcaaattttaaagaagcagaaacaagaaacaagggcaacaaagtacagagaacttcaataataagaatgatgaaatatgaagtgtccttgggtaaaatgagagccagggtgggaaacagaattatggatttttaaggatttcttcaagttcattaggctggaaccctttttaatgtatcatgagcatgagggaagaggcagaaggaatacctgagctgcccagtaatctagatggaggggcacagtgagtatcattccccatgactctccgcctggcaactctgagggcatcagtttgttagtatcatttgattagacttgtgcaaacccattcaaacttatcaggcccttcgccatgcttgttataaagactggctgcaatatttgttttatatctcaataactgtgcctgaattgtaagaagatttccaaaagatggtggcagtacgcgatagtcacccaaatgaattccaaggtgtagacttctcctaagattcacgtcgtagctttctgtttttttgtttgtttgtgtgtttgttttagagacagaattctgccatgtcacccaggttggaatgtggcgatgtgatcctggctcactgcagcctcaaactcctgggcttaagtgatcctactgcctcagcctcctgagtatcagggaccacaggcttgctgtagatttctgttgaagcctatcagagaaactttgtgcctatcactttcttctcattaaaaagaagtattaaatccactaacataagtcacatttaaccatttaagagtgtgatttggtacaaattttagtttaagggtaaactgttgagatacagacatgtacctttttcctcccttaaaaagaatcctgtactgttctgactgtagtttttaccaaacttaatccagtgctcaaaacacgatggatgtatcattctttgtaaccagtcatgaacgttagctttgaattaacgcaatcctagcaatttggttcttaccaaattgtttctcctatgagccccgattggctgcttctcaggaagaggaaaggttttttgtgtgtctttctagttcttatattcagctcacagtcttttttttcccttggctttctgctgtaagattttggttttctttcccttcagatgaaaaatataaaatacactggctatctgggaaatagacaactttttctttctggttcaaacaacaacacacaggcactgctcttctttctccctgtaggtctctcgggaggtcatggaattgagcctgcctaggtggggttcagcctagtatctagaatctacctgcacatctgaggttactcaggggaggtgctaggaacatcaacataaacacttcatatgcagaatgcttctgataatgtgtttctcagaacagaacaaaacacgctgttcgaagagcatcaagtgagttttcctgcggtactcgagaggcaattccaaccataatagagcatgagactgtcaggtatgctgtcagcccagcatacacatgaacagcaaagctgcccaaggggtaggattgaagccctcctgagctgctgatgattctactgaaatacttaaggacaaaatataaggaattcacactgaccttagtggaggctggtgtggggctgggaagagggctgtgtgctctcagtcactcttgtgcctctgcctttcctttttgttccattcttgtcactccagttcaggcccccatcacctcatacgggaaattatcactgtgacccttgaatttcttattctctttcaggaaaaaaagccagtgtcttaaccacgacctgcaacacagcatgatctggcctgctgttatcatctgacctcatctctactccccaacactggcccccagccactccttagcatcctgacatcctcatgcctctgagctttgcatggctgtgccctttgcctagaatgtttttccgccagatatccacgtggtgaactctctcacttcctttgggtgtttgtcaaaatattcagtgaaaccttccctggtccacctgtctacaacttcaattttctgctactcttgatgtttcttatctccctttctctctttaattttctttttagtacttatttctgtcaatatattatatactaatctctcttgtttgttgtctgtctctcacaggagagtataatttctatgagatcaaaacaatttttcagggctgggcacggtgtctgatgcctgtaatccctggttctgtctgttttctctccactcctgcaactgttcccaaataaatattccaaggtttaactaacctgtagacacaggtggcatcacatgagccgcagtaatacagatgcaactgtttttaactctacgcagtctatgtaagacctcagtcttctgcaaaatagcccttctatcagatagtcctgtgggtccccagaagatatctgatttgtgctcacaaaaatattatagttgttcagctataattgtcatgcagcctctatgctttctttttctttttcctttccttttttttctttctttctttctttttttttttttttttttttgagatggagtcttgctctgtcacccagcctggagtgcagtggcacagtctcagttcactgcaacctccacctcccaggttcaagtgattctcatgcctcagcctcccgggtagctgggattacaggcgcccgccaccatgcccagctaattttttgtatttttagtagagacaggcttttgacacgttggccaggctggtcttgaactcccagcctcatgtaatcttcctgcctcggtctcccaaagttctgggattacaggcgtgaatcactgcacccagccgcactattttttccctattgtgggcagagggcttccattcctcaaacagtctgagggcacctcattactgttgcttttgggattgcttattacgagaatgtctatgtcccggtgggggttttgtctcctaatgtttcctaagccaccaattctccagaccggggctgattgagggttaagtggggagggagccctatgtcagaagccctttctcctttcttccctccccctttcctttcagaataactgtgtcaggcagtgttcttggttctcagtgctggaatatagcggcatggaaacacacagagaaatctccacctctctgtaactctgtaattttgaaccccatggcttctggggcgtagttctgtttccccttctcatgaagctcctcatagacagctcctctggcttcttaacacagccagtgtacctacttcccaggtttgagggctgccagcaacccccagacacaccgttcaaacctccacactcaaccaccagccctgagcccagtgactcctgtacatagacacccaggagcccaggaattgtcccgcagtggacatgccaaagcaggtctccatgccttttcagaggcgtcggtgcctactacgtaaagagacttcagatctttttcctgctggaatgcctttgatttttttgaatatacatattttaagcccaaattaaagaatttgctttctctgctagaccctttttactggttcagcctcagattttgccctcctctaggtgacagcttttcttgtctgggctgttgttgagcatgtcgccatgtgtggctctctcctgtgaatggccttttctaccaagttcctcttgtctcctcaagtagcttgccagctcttgcaaggacagaagcttcctcctgtttatatcctgtacagcactcacatagtcttatacacatagtgatggttaaaataattggtggactgaatttccataaatatattctggaaaagtcagcagtaacagattgtttcagccatatggaatcttctcttatgtaggataactcaaaccatcatgattccagatacccagcatctacagattcaggagtattggtgtatatctgagcattgcatgagtattttggtgtatcctttgtaagagtctccaacccaacttctagttgttcctactgcttttcttccagatattctgagatacttttggcaccatcccttatcaagggtgttggttgttgggggctatctcagaaggtttcagcctttaccaagtccttgtctgtccacagatcacattgcacaaacacatggagtctttacaaatgaaggcctgccctccaacatgggccaacactactcagggtctgggctgggaccttttaacatggagtgaggtctctctgcaattgaacctctaaggagaggtctgagtttccactcgggtcacagactcctccggacatgtggcatctttgctccttggtctggaatcatgagatcctgttgtcatagacagaatgagtgatatactgaggataaaagaagtgtgctggggccgggcgcggtggctcacgcctgtaatcccagcactttgggaggccaaggcaggtggatcacgagatcaggagatcgagaccatcccggctaacacagtgaaaccccgtctctactaaaaatacaaaaaattagccgggcgtggtggcgggcacctgtagtcccagctacttgggaggctgaggcaggagaatggcgtgaacccgggaggcagagcttgcagtgagccgagatcccgccactgcactccaaccccgggcaacaaagtgagactctgtctcgaaaaaaaaaaaaaaaaaaaggagtgtgctggaacttcagccggccaccctcctggcttgtccaaaatgttctatattcctttgaagaaaaagggaagcctgcatgagtgatggtggaggtcgggctttggccctgaaatcatattaatggaactttcagataatgtcattcttcatttttcctaatgccaatttatagattgcatcccagactccccagagaagtagaatttgccaaatatgcttgtcatttcttctaattaggtttttaaataaatcaaagaactcttgttttcatttaccttggattatacagcaacaatcttgttgtgtatgttgccagagagacaatgcctactgagaggacaccagattcctgacattctaagagcttaggaaggttcctcccctccactttcctaagcattccattagccccgccattgaagaggaggagaggacagtcctgcctgggctgcatggcgcctccttcctacccatctccaagatgctgctgtggaccgggctttgtggtctaaaagggaaggagaagggggaggaggagagcactctcctggcctctcttgcagtttcccctttgcttgattttcagccttccctcggtttctagtcctcggggtgaatcttcccatctaggaggctaaggggtagagaaaccatgggggagaaagctgggaggcagctgggggtaggcctggcccagcaacctcctctgtccttctccttggcttctcaccatgtggcccccctctggccctttccccagcatgccccatctgcccccttatgcactcacagtattgttggtttctgcctgaagcccctttcctggctgtcatccctttgctcactgtggcctcatagctggtgattccttgcattacgtctgggaattctggagtgaggtgccatgagctcagactttgccctggtgtttttggtcctgcagcagcctctggcctctgagctcctctgagatggggagactaagaaccggttgccatgctggctcttttcctactgccttccccatgtcccatctctggtgattccacctgtcgaggtgggcaagctcagtgggagctcttaggaccgcagtagaagctatgtagtcagcaggcagtgcagttggccccactgcaagaagaaataaagcttgccgtgtgcctcattcagaaggggacagccagccttgttgtacctgcttcctgggtgtcaaacttctgacaattgggaatgacagatatttaattttacttaccttgggcagcaaaaaggccccaatccttttatagatcatgggcctgtgaaagtagctaaccccaggccctgaaggacccacccctcttctcctttcctcccctctcctctcccttctctcctaccctttcccgtcttttccccttccctctttttcatctttatttttcatcatctttcccatccttcctttcctgtttttctccatcaaactctctcaactcccaccagatattcattgttacttagcagaaatcacatatcttgctcaaaggaagaaaaaaaatagctttcttggtacatatagatcagggacttaggcaagggaggtagttgggtgggataggattcaatattaatctctttattagggacaattgtatactctctaccactgcctgccactgatgcctctgtcctcctcaatccccattccctgctccagtggtctaaagctgtgacagtttttctcccttgcctgctatgagctgaagattggtggagagctgtcactactttcaatgccagcagggcctgcagcatgggaaatatgtaggatgtgttttctcttataaccactgtatggctgctggtgagatcatgcccaccatcctaaaacctagcatatatattattgtgttgttatttaagtaaatgttggtcatgtttttattagaacagtgtaatataatggactgtgatctatactgtattccatattgtcttagtttaaacggatatgttcccccctctgcccaccccgtaccacacacctacaaataagtttcttttgaataccaacaccagcaaaatcaggaaacccttagtaagggtgcttaggtgctgtttgatatttaaggcagtaagctcaactggcctttaaattcattgatgagagcaaattattgttttttaaataattttaatttttaaacatgtttcatgttctaggcaatatttgtttaaattatgtttttgtgctaggttctataacaactgtgtcccaatgtaaggaataagaggtaacctactgaatgcttcttttttgagatggagtctcgctctgtcgcccaggctggagtgcagtggcgcgatctcggctcactgcaagctctgcctcccgggttcacgccgttctcctgcctcagcctcctgagtagctgggactacaggtgcccaccaccatgcctggctaatttttttgtatttttagtagagacgagctttcactgtgttagccaggatggtctcgatctcctgaccttgtgatccgcccgcctcagcctcccagagtgctgggattacaggcatgagccactgctcccggcccctactgaatgcttttaagtgacttttcttggtttaatttatcacctttcgtagagaagtaagcactggctcatataagttatttgggaaaaagtgaatatttgtagtatttagaatgtccagattcctgcatcttacctttgtgtatagctgggaacttaaaaatgaaaaattgcaacctaactaagcacaaaattctaggtgttttgggcaatttctgtccggaagcttattatccaactacttcaaataactttaaccagttgaaatgtagtcatacaccgtgaagtcagtgattaaaatttccgatttgctaaaacagtttccctcaattaaggaactaaaaatctatttacttttctactatggcaaaagacctgggacctttattcagaatttatttacttaattttacatatgattgtaaactgtaattatctgatttctcagattaaaagctgttgagaagctgccatttaggaaattgagagcaacaaaagacagcaacactgactcaaaaggagctctacccaaacagaaggacaggaaagagaaaaatgactgttctttgtacagtgcatcatgttgtagtctttatgaagaaaaatttagaatatggtttatatattctgcctcaaaaggcacataagttcataatatattttaagaggatcttttaaaaatcaatatagttcagttaaaatcagttttagaacttacagcactcgactccatatattatcatctgcggaacgttgcacttcagtttttccatatgaatgatgttagtgcatttacatgacgttccagaaggctgagagatagcatatcttaatgcaccagttctcaaattcttctagcccagatcccttgtgcaaaagatgttttgactcagaatcctgatttgtaaaacaaaggaggaggcattgcatttcattgaatgcatgaggcttcctgagttttctccgcatcttccttccatcttcagtgactttcgtaacagactaagaaatccctggaactccatagaacttaatgcagagcgtagtgtcaagcacgaagctagactaggacaggagttattggcaaggagggaggcttttcaggcatccttaaatcacagcctgtaagtggttgcctacctgtggtaatattgcattgcttatccacaatgtaatttactaggagtttcatgggaaatgaatagactaaaatcaactccagtttcctttgtgtcgctataactctgattagcaatgtgactcaaatgccccatgcattttccacaggtggtgccaaagcagtgattcgcaccaggatatccataggaaacagaagggaaaccatgatttgcttatgggtgctctaccctgtagagcaaaatagaattttttgattgtccttttgattgctactgctgtgttactacgattactactgtatgttttcttgttcctccccctccttctttttctcttcttcttttcttttttagtagtagaacaagacactgttcagtagtgtagctagatgctttggtttcttttatcattgttatgtgcaaaagcaattgtcaaatgtatttcatgtgctacaccatgttcttccctcaggaagaggaaatccgagagtgataaaagcatctgcaagcagaataaaggaatctcagtcagtggatttcttctacaagtttcatggcagcggtactgcagtgttttaggttctttgttggtggctgataatgtgtaaataccccatgttgaatgaatgcagctgtccaagacctatgaggctgcattttctttcctaatcctacccctccaaagtggtggtttgcagctcttcaaatctctggccgcagcaatgctttatttcttctcacctacctgacacagttgactcaaaaattatacctcagcaggggaaaccactcctcggaaggggaaggttgccagcaatctctaagaggacaggaactcaggacctttcacacttggatgctttgatagcccatctgacagacaggcttagttatagtacatttctttcaggctcaaacacagaaattattcatacaaatcctccttccagtctgtcctttatagagagggctgaactttcctatcttagatcctgcatgacactggcagtcatgaaatgtagattctgctcattcatctctctccatgcagtccattttttatcattagagaaaaagataaactttaaaaagttttatttcattataattttaaactaatactgactgtcagagaggccgaattgtgtaatgcttataagcatgagctctgaagccagaccacttggccctgctgtgccttaattcactgaccttgggcagttttctcatcagtgaaatggaattaagaatagggcctgtttcatagggttgtgagggttaagtgaactaccatttgtgaagtgcttataagaacagatagcaaatactatattcctattagcagcgtttcctgcttttgttgctattcttattattgtttcctgggcgtaaaagctgaacttgccttcctttacttctggaagatttgggcagaaaccgaagtaacttagtctagactcatgcctgggatagaagcctaaaatgactggcccctggaaatctagactctttggcaatagggaaagaatgcctgttttcaacttagatctgagtttggatgttggtcttgccccttagctacttgagtgataatgtagaaaatattttaaaatggaagagaataatgcctatattgtaaggttctgaaacttagaaatgacagaacaaagagccagttcttgttatatgctcaaaatattggagctattattattattatttgaagagacaatctagcccaccctaaatcatgcagatgtggagctacttggtgagtgcagagactgttgataaagtttgtcagtttattcaatatttaagatgaagttttaaatttgctttgtaatagaaataattacaatgtttgctgtatttatgtatttattatatatgcccactttaatactagggaactcttcagaacagactgttaacatttcttttttgtcttttgaattgaatattgtagaaatcagctctcaggaggaagtgtgcagtctgtaaaatcgtcgtccacaccgcctgcattgagcagctagaaaaggtaagagcgcgccccctgctgcagttttgttacattgcaagtatttggtcttcagaggcccggtgtaaatttccagttccaactttttgaaaacaatgcccttaaaaaaaagctggaagtccaacattattaccagattactaatggaaagacaatgtttaagggtcgttcactctcttgtttgctgaagtgtaatttgatatcattttacgttgactcttgggaaaaggaagaacacagttagatggaaaagcctggtgtgcactgattctcttattatatcatctcagttcaagcattactatccacccataggctgttccacaagctgtttaagaaggaagaagttctataagctgtttataattgttgttcacatatatctgacttgtgtggtttacgtcttcctaaagtgcctgcaagggagcgagccacgctggaagccggctctcactctgctggggcagtgctcctcctgttgctgctcaaatgtgtgggtggggctggaagtgacatcccggtggtggtgtgcctccagaatcagtggattcggcaaagtccatttatttgtcatttaggggatgggaaaggctccaatagtgagttgcctgccatcctctttcctttcacacttcccactacattttaatgtgtgtgtttctctgtgtattatctatgttcttgagctgtcatgggtaaatgcattgaaatattttagtcccccatgacattcatgtagtttcactgacatgaccagttgatcctagctgatatcttgtggcaatgactaccaacatgttatcttaatattttcttttctgccccaacttcacttactcatctctgccttcattcttttgctcctttcactttatcgagtagctaaccgaaatgtcaatgtgcctactaggagacctccacatctaaaagaaaagcagtgctgaatccttttataaagaataactctgggctgggtgtggtggctcatgcctgtaatcccagcactttgggaggccaagatgggtggatcacgaggtcaggagatggagaccatcctggctaacacggtgaaaccccgtctctactaaaaatacaaaaaattagccagatgtggtggcacgcacctgtagtcccagctactcgggaggctgaggcaggagaattgcttgaatccaggaggcggaggttgcagtgagctgagatcacaccactgcactccagactgggtgacagaatgagactccatctcaaaaaaaaaaaaaaagaataactctgttgtctttgaataattgtcataatactaaaaaaactcaagtttatattttctacttttacaatcagaaacccagctgggtagtttaagctgccagtatctttcctctggctctttcttatctcagtttctcaaatttatggtgtaagagcattatcgtttaaagatacttagatttgatttgtgagaatgaaggaaaggggttggagatatagaatcacctgggatctctgttgattatctaatgtgatgatttcaaaagactaagaagagtattattccttgttctttggaggttttgcttttcagtctcaatatctgtcactgtttttttttttttcaggtaattcagtctagtctgatgcttatctctaatataatatacttttctttttgaatgacagattaatttcagatgtaaaccaacatttcgagaaggaggctcaaggtcaccaagagaagtgagtatttcagagcttgatttcaagtatcacctttgatttctcattgattcagtggattcatagatattcaccagggaataaaaaataaattctatctctttctgttgcatgccaattttttgttaacacatcaataagcacaatcaataaaatcttcaagtcttttcaacatgtgcacactggactttattctcataaaatgtactggggagtttaaggtcttaccaaatgaaccagagactagaggaaggtggtagtgatagaattgaaggggtaagaaagaaatagacttttattacttatttatttggagacagagtgtcgctctgttgccatgtgttctggttgattttaagtgcatttttcaattttgagtgggtataagccattcatggggcagcacagtaactggttattcctatgagccctggagtcagacggtctgctttcaaaaccagccttgatgtgtgtgatcttgggcgtctcacctaagctctctaaatctcagtgttttcatttgttaagtaaaaaataaatacatcataagctagaactatattcagttctcagtccctgaccctccagtctggtcgtgaagataaacaggtaaagaggaagttagaatgaagagttgttactgatgtgttagtgggaagcagaggtatgacaagaggagacagcacttatttgttcacattttatttagcagagacagcaagcacagttcaggcaagaaccctcctgtgttattctggacagttaagctccaggcccaaaattgcactccctaatcagtgaaacaaaagcctgcaatgaacagaacctgtcctcctagaatgtagttcagcctgcccagcagtcactcactgcctcccaaacattagcatcttatacggtatcctccttaagacaaagtctggtaaaaatgatttctgataagcatactttctcagggagacgaggttcagttccacttacagatttaccccttggaaacctccccagctggtctactcctcagatcagctctgtgtagtaacaaataggaaagagaggagaggggtcagagaaggggcttcctggaagaggcggcaattaagctgagaccttaaggagctaactaagttaagtgagaggagggtggttaggaggtgagtggcaagagccttccggatagaaagaagagcacacaagtccaagtgagagagggtgtactgagtaagacatgagatctgagatagcaagagctggaccctgaaggtccttgtaagccatgctgcaagttgagtgttttatcatcaggatagttgggaggtgagcattaaactactttaagccaaatattgttcaggctgcagcgtggaggaaataccatgcagttcaagagttggaggcatagagacaactttcagaagccatgctagtaatctaggcaagaaataatggtgacgtgaactaagaataacgttggtagatatgagtttgaaggaaacaaaattgacaggatgtagtaattgattggattttggacacaagaggagcccagactaaaccaagctactgctaagtgcgcgcacgcgcgcgcacacacacacacacaaacacacatacacacacacacacacctgaaaaactgattagatgttggaaaatgagttgatttgaggatgggctggggaggtaatgagtttagttgtagaactgtgaagtgtgaggtatccctgttgtcctcaactggagatgcccaatagaaggttgagtgggtatatgagtttggagcttatgaggaagactgggctggaggtcaggcattgtgagtcatcagcctatttacacagtaatgaaagctgtgggaatagatgaacgtggagagtggaaataggagatatctgagaatcacaaacatttaaagagagttgatgaaaaaagacaacatgaatatgaatgctataattgctagtgacaatgcaaaaggattgggagaacatgtggaaagagagtaggttgggatggaggttgtagaaagagaaaacatagttgtccccatcagttgtcttctcccattgtgtttgtgcagcatggcagcaataggaaggttgtgggccatgcgcagggtgaggaaagcaggagaagaatgatagggctgtggtgcctcagtgccacccagagtgcagacagtgtgggccagaaggtaattcagtggtgactcaattgaaggaggtgctttatttaggaaactagaaggggttgtttcaagttaagatggagtttatgactttccaaccaggggattcatatacccacctttagcttcctgccctccaatatgtatctctctcaattgataggtcaatgtggaggcaggggaagagagaaagagagacaattttaatcgtgcaatttttctaatacaagatgcttttggttttcattagtctgtaccacttctctgaagctagaccttccataagggttttggatattctcccttgtcttcttatcaaggacttgaaattcctttcttttatatattttcatcccctcatttctagataatttctatcagcataaacacactctaataatttctatctttaaaaaaacccaaaaacattccttagccacaaactgtgtcttacctactgctctaattctcagttttgtggtcactgccaagcttccagaaagtgttaactatataaattattttcggtatgtcactttctagtcattgtaacctgttctgatctgatatctactctacccatttactgaaattgcttcttttttcagtgttgcctatgatctcctatatgctaaatgtattaggtattatttatttttctgttctttccttatccagtctctcaaaaatattcaagatactacatattccatcctttttggaatgctctcctctcttggcttctcacatcaccctttcctaattttcttcttgtttcatcagatggcccttcctattctttttcattgcttcctcccccaacctctgcaaatccctccgagcttagttcttttctatgttctcttccgtctgcccactcctgttagaggagcttatccagtctcatggcttcaaataccatgtgggctgacaactcctaactttacatttccagtctgcccttcttggagttccacttggcatgtcttttgaatgtatcacagtcatctcaaatataatacatcaaacactagactatttccatcaccataaaaatgattttaagaaaatcgtatgcacctcaggaaatgagatggctgttaatctggcttctcaactgagaaaactggggagtcatgtttattccttctctcatagactccccacatctaattcatttgcctgtcctgtcaattttatttataaaatatatttcaaatccatccaactgtctccaattctgttatcagcaccttaaactaagacactgtgacctctcccctttgaccaatgtaatagcttcatgattcttcagttgtcactttcaatccacccatgacttaaaggagtgatctttcaaaatgaaaatcagattattaggttggtgcaaaagtaattgaaagtaatgacaaaaaccacagttacttttgagccagcctaatataattttccctggcttaaaactctccagtggtttccataactcttagagcaaaagcaaaccctctgtcttggcatgaaaaggtccacattgtctggcccctgcctgcccttccagccacctccagctcccacatgaactttctttccatttatgaggcatataccaagatattccccacctttggatatttgtgtatttcactgctgtactgaaaatctctttgcgtgactgtttcttacagttaggcctcagttcaaatatcatccccctcagccattgtcttagtctgtttaggctgttgtaatgaaataccatggactgggtggcttataagcaacaaaaattatttctcacagttctgcaagctggaagtccaagatcaatgtaccagcgtggtccaattctagtgagggccatctttggggttgcagactgccaccttctcattgtattctcatgtggaggaaagagggtgagagagctttctgtggtctcttttataaggagcctgattgcatccatgaagagtctactctcattacttgatcacctttcaaacaccttacctcctattaccattgcgttggggtttaggatttcaacataaaaattttgaggggacacaaaccccagtcctttgcagaggtcttcctttacaaccacctttaaatacatagcatattgttctttatcaaagtgtcttgttctttcttttcagggcactttgtataccataataatttatgcatattactgtttgcttgtctaaagaatatctcccttctttagtgtaaattttgggagatcactcctagattttgtcctaaattaattgcaccaaaacacagagtatgtcactgatggatatctgctgactgaatgcatttacaaaggtattcatttctctcaaaatgtttatgaactcttagtctaaaaggacattttgaagatgaaacttatgactcactgactatgacccatttgatattcttaattaaaaattaagaattcttactactactaattcagatgtttatttagtaaatgaaagaacatttgctttagaattagtttgaccctagttcacattatacctctgcttcgtttccactaagtggtaagagtctctggagcacagattgttggtcactatgccctggcatttgcatagtgcctgacatgtgacaagttttaaataaatatttgttggagtcatctaagttgaatctttctggatctcctttttcttagtcataagccataacggactgggttatgatttctaaggtcctttcaaactctatgaaatatatatatatatatatacatatatatataaaattttttatttctataggtttttgaggaacaggtggtatttgcttacgtgactaaattctttagtggtgatttgtgagattttggtgcacgcatcacctgagcagtatttaccgaacccaatttgtagtcttttatcccagttcaactggctgtttgaaaatagccaagcaattgtattgtgtatttttgctaacaatactgaatataagccctgaaataatgcattaccaatattttaacacctgtaagtaatagccctttccttgcccagtacttgaagttgtttatgaataattcagaagttattgacgagcaataaaaaggttttatggtgttagaagccttgctttgctatcttaacaacaatatatcaacagtcacatttgcagtgttaaggatcctgaatccaatgtcagttcagcaacttaggagctcttaataatggtcaaaagaaaagagtgtgagaaattaaagcacttgggatatgaggattagaataaatgattctatagtaactttttttccttatcgatgaaggcaattgatgatcctcccctcctccatggtaactatgtgatttaatcgtcaaagaaattaggtggataattccattcaattcaacacacatatattggatgtttgctttgttcaaactataattaagcagcagtagaataaatttatattgggcctaaaaagaactctgaacagaaggatgctggacatctcaaatcgcagagctgtagtttggagacaattactcattttcttctacgatagtgattttgtataagttagtttatcaatccatgccttagttttcggcttattttctaggaaggatgatattaaaaatatttaataaatggtagagccatagagagtaatatttaaataataatttttaaatgttcttttttattccctgactaaactatatgatattctacatctgcttaccaaattatatacagtagtcccctcttatccatgattttgctttccaaggtttcaattacccaaggtcaaccacagtccaaaaatattaaatggaaaatcccagaaataaacaattcgtaagttttaaattgcatgctgttctgagtagcacgacgaaatcttgtgccatcctgctctgtcctgggatatgaatcacccctctgtccagcatatccactacctgcccattcatcacttagtagttttctcagttatgagactgaagaatcgttgtatatgtaaagtttggtactatccctagtttcagtcacccactgggaatcttagaacatacctcctgggaagaagggataactgtgtgttgcagtgcaaatgatgaagtcagtgttaagatttctaaataattgttgatttatggacagtgttggctgactcttttgagtagagctgttacttgctaaatgatcccatgagtcagccatgatttcacacaggtaattgcatcaaatgtttccaacatgtttcttcttaaattgatagtcattaggtgatttataatctcaataattacagatttttttctgaccatcaatgatattgttccttttccctcggcttctgctacactaacagcaattatattacatttttctattctgtatgatactgtctgacatttttatatattcaatatttctactactgactgtcattgaaatcatttgttggtgtgtcatgttgaatagcgtgagccctgttttgcagaacagaggaaaggcacagtgacacaatggtaagggcacagattctgctgccaccctgtctgggtttggaccctcactttgacctttacattttgagtaaccacttctatgcattagtttccttatctgtaaaatgagaatgatgttgaccattcaagtcaagccctctgataatgtgccctactgtaatgcgaattgggatatgctgcagttggcagctggctctggttctccctaacccttattcctaagcaggcagtggactaaggttctcatcttatcggttgagtaggcagatgctaaaggtgtcagcagtagcctcagctgcaaagtaaagaggtagagggtccagtgccttcatcctcagtagaatttttgcactgaactgatgggatagatactgataactgggcaggttattctagaattgccgtcactttcttgaaagccacagccagccacaggacccagaattgtccatccaggtggatatttacgattgtacatacaaccaccaccagctgggcccagcccagcattctgagattctttgggggaaccagtaatattgctcagacagcatgatttgttttcagaagagagagatcattggaataggatcctggagacctattatgtcagaaattaacattataattgcttaataatgaggaggtagaagtggtctctaatgttgaggtgatgcaagggaggagtcagagagatggtaggggcactaaactgcaatttcccaatcaacatatatttcaatatttcaacaactcataggattttactgatatattccaactaagtggcatctctactcatgaaaattctcatgaagattagaagaattattacttataaaatattttttaaagcgcatggctcacagtactcaacaagtgttagctattataattagcttctttcttaggacaatctaagcttgtgtctttgttttattaaactgtggtagtaggaaaagtgagacaaacattagactaaattgtgggaccattgtgcttatttatatctgattatagttaaaagaccattgttcctccagggtctttgtttagttttagtttaagtggatttgacattattaagagaaatagaggtggcatttcagtattgataatgctaatgcttctcagtggtttcttgtcactctgaatttcatgccttgatatataaccttttttccctctacactgatctattttctgtccatctgtacgtactaatagaacagtgccttgcatgtaggaaaattttgaataattgaatatatattcaagtggtttttaaagagaaaataagggttatggctagaccctacaatagacatgttagaattagataaagtgtgttttcccagaaaagggcaaaagaaaacaatgagtactttaggggtattggtgtcagagggatgaattgtttgtaagttattagggcttgcctgcattcctagtcctgaggatgactttcttgtaatgtatcctgagaaccagtggtgaatggcgctgcttgactctgccccaggagtgcttgtctacttgggaggaagaggactttctgtgtttcctacagtctgagacaaagatagaccttgaaagctaatctgtaatagttcaaggtgcccaaggatggtttaaacacaataccattgcaaaaacatcattgatatgcttgtatctcttgtccttgacatctcttgccttcagcttttctctttcttcactctatctagtgaataattctcacgtctatgtcttgtattaggagatctctttctgagagtttgatctacattatctctagctagaatgtttggtatagtgtctgcctgccacagataaagcactacatacctatttgttaaattgaacctggatattgttgtttcagcttctccccttcacctttccacttttgtttgggtatttcttttacctgcctcagttacctcccagctcaaggtcctctactgtgttcacaaatctgcagagtgtttgactattaagacagtagagtaactgcaatctcgtgtggccacttgccactaggaagacgtggagggagggcatgagaagtggaatctacagatatgaaagatctttggggatggagaagtaacttaatttgtccacgtagattcatgtttattgttaaacaagtcatacccataaatatttgtttctgggctcatctgggcttagatgatggtttatataaatcaatagtattaccacattaaaaaatgaatcttgagatttgcaaattaaaacatactcaatcaagtgcagtagctcatgcctgtagttcccactattcaggaggctgagatgggtgaattgcttgagcagaggagttcgaggctgcagtgaactatgattataccactgcactccagtgtgggtgacagagcaagaccctgtctatagaaataaatttttaaaaatattcatttaattttgttttcccacagaattttgtacgtcatcactgggtgcacaggcgtcggcaggaggggaaatgtaagcagtgtggtaaggtaagagcccagccacctcatggcctcgcaggaggctccccaggcctctgcaagcaactgaggtagatgagtcctgtccccaaatccagtgttcactgcatcagttcctttctgaaagaccttacttgtccaggtctccttaagaggcattgtagttgttctagaactcactgcatgaggcaatggtgttaataaaaagaattagcacatttttaagatacctggatgcattcttacagtgaatttcattgatgatttttgaaaacatgactgttttgtgaaaatgccttcatgaagacaactggctcatcgtactttggccaatcgcagcaaatcaatgggtttgagcaacactacgtttgctaatataaaattgtgtttgggcggaactgtttaggacaacatggtcagaagctagaaatgtgttgctcccttgggacattatccagttcatggaagagatgccctttttatttgtggttatttatatctacctcctctgtcatcatggctggttataggtccctcaggatgcagtgccacttggaaaagtgagctggagcaaggggtgggggtgttgtgattgtatactattaaatgccatagattccatgtgtcattgaccccaacagatttgggttacagctttttccaatgtacaaagatctactttaaggatgacagggtcctctgggagggttaaactggtggcgaatatcactataagtatgtatagtgtggttcaccaccaatttaaatgacattaatagtaagctgatggtcatcagtaaagggaagttttgatttggcagacagcaagataatttggggggaatatcttcctaaataattaattattcctctgtttgtttattcatgtgactcctttgggtcaagcattggtgtgagctgcccagtgcagcatttttgacagtagagcaatgcaaggaaatattggctgcctgagatatggttgtggagggtgagggagggagacttggaaaaaattgcattaattttgctgttttgcccaatgcctgggaagaaaatatgctgtaaccattggttatgaaggtcttctctggaaggctacacaccttagcctccagggcataggcctccattgtaaccagtattttgttctccagttcaaccctgtggctctcagttggttctcttttatcctgtaaagaggatgaacaaaacagggtgaaagcagggtgaaataaaacaaagtaaacaaggccgaagggggaagtggaaagatttgtactgattcttattggccatcctacatgtcctggggaaaaggaggtcacacctctactctcacatgacctttctctcttgggtccatcaacctcttccaaggtgttgccttggggcttatggattttcttttacttcaagaatcatcgactgtaactttcccataagtgtgcatgtgtgtgtgtgtgcatgcatgtgagggtaacagtatgctgcagccgggcaggcatagccattttttgggtcagagatgtaaagagtagtaagaatctggatgaataggtccttcactttggaaaaatatcttcactggagcccagtagctggcaccacctcaataatgtaagccataatggagtgggagggattttattaaaagaaaatcaataaacattttatactttgagacaagtgttccctagtgccatattgcactctcttctggcctcttgttggcatggtcaactgaacaggaagaactgggcttcctccaccctgagttgctgtgtgtcctttcctgccagtgttctcagccagccatcatgccatgagcacagctcgctgcacgtccgtcgtcagtggggaagtcagtgatccagcttgtcacatcatgtttcaaaaatattgcactattatagtcatctcttgtgtttataatgcagcttctccatgaattcttcaagactcaaacaattatgggatgggtgggattgtctccttgccacataataaattacccttccttggattccagcttccaccctggacaggaaagctatggctctatttccatttacagattaagtaatgaaaattcactccaaacattggtgctatacataattttcatcagtagtgttgtaccttcttattcatattcatagacttttttttttttttttttttttttttgagacggagtctcgctgtgtctcccaggttggagtgcagtggcgcgatctccactcactgcaagctccgcctcccaggttcatgccattctcctgcctcagcctcccaagtagctgggactacaggcgcccgccaacacgcccggctaattttttgtatttttagtagaaacagggtttcaccgtgttagccaagatggtctcgatctcctgacctcgtgatccgcccgtctcggcctcccaaagtgctaggattataggcatgagccaccgcgcccggcccatattcatagacttttaaacctcactccatcccccatacacacacacacacacacacacacacacacacacacacacactattccataatttactcattgggatggagtgaagaataattgcttcacttagcaaaacttttttttttttttccaactgatggcttgcaaactttacagattttttaggaagtgtttatggttaaagagtgtttgtggtttccatttctgcttttaaaataaacaataaaatgatgtttggactgattttctcttgccttaaatatgtgtttggctgagtgtgtgtggcatttaacagagatcagatgagataactcatgatttaattgctcagttcctttaacgttagccgaatgcctcaggctactaggtttataacccttctgtggtttttcattgtcattcatagtccttgattacataagagtcagggtcaaggcagaaaagagccaaaatgctcaagttcaaattatgtaatttgatgagagtttaatgaggagaatatttaaaatgtgtgaaaagcatgggggatggtgggtggaaccacaagaaaaaatggagaacactgtgactaatgtcagagagctgtggtcaagctaagcctgaagaggtgaggagatggagaggaccccttcccaggagctgcaactttcagtcacaagactcagccagcctgtggtgacctagagcctggagaaatagatacccagtagatacccagctccacatatcttcatgttctagtggccaaacccaacagaaaccatagcacaagggattgtttgatgcaatccataaaagccaactctttacaatgagtcattgagtagagaaggatggagagtaaaacttgagaggcagatggaattgatctagcacatattgtttaatgcaaacctgtagtcaatcaatggttggaggcagaatgcatacttttgctgtaaacatgtctctgatcttcactagatctacacattgccttcattcagtcaaaatttatgaaacactgagttgtctatagtgcttcaaaaaatctatattcaaaaaatatagtaatgattatggctattttgactcttcattttttgagggaagcaaacatccaaacctagcattatggtaattgtgaaaatatgtttgtaaatcacaacttaaaagcttatcttttatttcttcatatgtaaaagttataaaaataaacaagctaactttttgaaaatcaaaatttaaaaatttccaacatcaattcttgaagccagttttaaatgcagtatacacattgaatatcccttatctgaaatgccgggaaccagaagttttttggatttagatttttttcagattttggaacatttgcgtatacataagatatcttggggatgggacccaagtctaaatatgaaattcatttatgtttcatgctacacttaaacacaaagcctgaaggtaattttatacaatattttaaataatcttgtgcatgaaacaacgtttttactacgagctatcacatgaggtcaggtgtgaaattttccacttgtggcatcatgttggcactcaaaaggttttgggttttgaagcattttggatttttgattttcagattagggatgttcaacctgtaatacatagttaaactttgtctacattttttatactgttcagttcctgtattaggctgttttcgtgctgtttataaacacatacccgagactgggcaatttacaaaagaaaggggtttattggatttacagttccacgtggctggggaggcttcacaatcatggtggaaggcaaggaggagcaagtcacatcttatgtggatggtgacaggcaaagagagagcttgtgcagggaaactcccatttttaaaaccatcatagctcatgagactcattcactatcacaagaacagtgcaggaaagacccgcccccataattcaatcacctgccaccgggttcctcccatgacatgtaggaattgtgggagttacaattcaagatgagatttgggtggggacacagccaaaccatatcagttccctaaccaaacatgctacattaatatgaattatttgtccataaatagtatgtattttcatatattgtttaaatagcatgctgtgtttattaaatgggaaaacatcaaaactactctttatttttagtaaatattgttaaaaactaacttgagagtgaacttagggtacaatatgtaaattatacacaaaaatgccaaagtgtttaaaactagttcatgggagtgcagttgggatattacatgggtagtgaaagggattacagagtataaaaataatggaaaatactgacttgggcctttcaggaatgtccccttatcaacttaaagcaatgtactctactaatctgaaaatgtgtaccctgggagttaaggttaaggacaaggaagggacgtttaagggtgaggatccatgcactcattgggcaggtttggttatttgcctgtctgtgtgtttgtgcagctatagcaaaggaatcctctcccagtagcctcaggaggattacgagtaggtagagagagggcagtacaagggcaaggaatccaggatgctccataaagcccctgcccacatgactgctggaagcctggcccttctctccttggctgagtatcaagaagggggacaaggacaaccactgttctactctctgctcctatgagttttgactattttagatttctcatactagtggcatcatgtagtgtttgtccttctgtgtcttatttcacttcagtgtaatatcctatagattcgtcctgggagggggaaatggggaattattaggcaaagggcacaaagtttcagttatgcaagccgagtaaggcctagagatctactgtacaccatagtgcctgtaattaacaatactgtgttgaatacttcaaaatttcctgagagggttgtgctgttaagtcttcttaccaccaccaaaaaaaaaaaaacctaataataaataaacagggcaggaaaacatttttggagtaatggatatgcttttgtcatggattgtggtgattcatgggtgaatacttatctccaaactcatcaagttgtgtacatgaagtatgtacagttttttaatgtaaattatacccccaaagaattttttttaaaagaaaagaggatgggggctaaagggtccttgctgcagtccccagttttcatctgtagaaccattttactgctgtcactgctccctgggtctttggtgtggtcactatcctggtcatcgcagcaaatacagtgccctggtcaccctggggccctttgttctttcttcagtagttcccgcccacttgtctaccttcttctggctgctgctgttgggcctgctggtacttgtgaacccagatgacctgcacggggagcagaggcccaaacctcaggccagggtggcaatgaggacacttcctgtcatggtgttcaggtcccaggtacacaagcaaatgacccctttgctccctgatcatgatgggggacatggtcccaaaaagttccaggtacacaaggtcccaatcccaaaaggttccaggtacgcaagcaaatggcctctttgttccctgatcagatggtcctcagagacaaatggcttctgtccttcttcctcacttcctcagcagggctgattctgcttctacatatttaccctcctttttggagaatctggcccaagtcatgtgtctcatgataaatctccggttttgattccagtctttttaagggactgatctcattgcatatttcatatgtttttgctctctctgttgctgaatttgattgaagtataaactagatattagcaagtaaaaacattttatcaaaatgactatttcaaatatagtaatttaggtgtagatgaacaatcagaaaagcaaatctaaacatttttgaaatctttgtgttcttctcctatttagaattactgtcagatagatgagatcatatatgtaaagcagtgtatggtaaatgtgcacctcatatttggatgccaggtgaggagagctagtttcctcatgaaaagcaaatcaattatagactatgtacaaataataaaaaatttagtattttttaagagagaaattagaaatatacagcttctctgccttttaaattaataaggcatataaaactgagaaattataaaaatatatacatacaacataataaatatctctgtataaaatatataattaacatgttatagttatttacatatgtaatgtgtatatatgtatatctatgtgcgtacatatgtatctgtgtgtacatacgtgtgtatatatacatatgtgtgtatatacatacacatatatacacacatatatatgtgtgtgtgtatatatatacatatatgtatatatgtgtatatatacatatatgtgtgtatatatatacacacatatatatacatatatgtgtgtgtatatatatacacacatatatatacatatatatgtgtgtatatatatacacacatatatacacacatatatatgtgtgtgtgtatatatatatatatagttgttcttgccagataagagactgaaaattcataaaagggcaaaaatagaaaaaaaaagaagcattggggaaatgaagaaaataatgacatttaagataaaaattggaggaggaacatgaacaaaatgtatatggagaggaaagaagagacgaagaggtgaaaggtgagaagcaaagggacagaaaggtccagagagccaccagcaaatgagtaagagtatctggagaatgaaaaggaggagttgtgaagccaccaagctgatatttacaagctgagctgtgctcattcctgggacacactgggattccctagggcaggcaggcttggaaaggggtaagggaagcagttcccaaatcctcatttaccgtttgtctctttattaaaacctgaatctgacctgcctgagaacacttttgtgattctttgcgctgacctccctttccaaattgcctttcttcaatccgcttatgacggaaatcattcttttcagtctttgccccaggtgtaaaaccctagggatgtcaaacagacatgaaatattgatgtcagaaaaaaatctcctttaattaaaaaaacaatgaaatgaaatatgatttcaaggaagaaaaagaaatgatataaaattctctcttgttaaagaaaaagcatgttatgtattctttaaattgaccaccacagtgatgagcaaagccagtgcttagtttatttataatccaggcagagaaatatgagctgaatagttagctgagaagcaaaaatcaaggttctgctgattaataattggagctttcactccctatagggcaggattaatccaaaagtacatccacagttgattaaacaagtcaggtaagtctaaaagtaccttcaagttggtttagcagttggttaggaaagttttttattttgatgaaagtctagtaaacaggtgtaattcttctttattagtttcagctggttaaaagcaattttggtttaaacacagcattccattttgatatctactaggcaagtggtattgttgagaggacagttttccttttacatggaaaatgtttcctttttcatggtcttctccaataaaaagataggcatattattaccttttcagatccaaaccattattttagctcagggttcccaagaaacggactcggagttgagatttatgtgtatgaagtttattgagtgatctcagaagtgacaccggtaaggaagtaaaagcaccaggactgggtagagggaggtgttgaactgtggggcagtcacaacagaggccttagccaactccatggggaactggaagagcccttcagagttacccggacttgaccttggccttgacccacaactgggcgagggctgtccttggccgatgtcttcgttcattgcattgctataaagcaatacctgaggctgggtagtttataaagaagagaggattatttggctcacagttctgcaggctgtacaagaagcatggcaccagcatctggtgagggcttcaggaaacttctgctcgtggtgcagggggaaggaggagccctgagtgtagagatcacatggcaagagagaaagaaaaggggtgccagtgtcacccaacaatcagatgtcactggaactaatagagaattcactcattgctgtgaatgcagcaccaagccactcataggggatctgcctccatcacccaaacacctcctaacggttcccacttccaacactggggatcaaatttcagcaggagattctagaggggacagatatccaagctgcatcagctcaagtgactcttttaggctcagggcaattcctgaagatgggagggtgactcatttgaagaccttcagcttccaagactcttctcaactgagggaatgagatgagtggctcaggcctgaagcagagttatctgggtggaaagccacagtattcaatactgtccattcctggtgctactcagagtaccttgttttgtatcgtacatttttagagcagctctttcagggttctgattggtcacatttcctgggaaacatagaagaggaaggatatgggataaactatagcccccatggttgcagctggtcttacatctgctactgatattcatcatctctctcctcaaccacttatcctggattcacctcactctcaactagtgcctctggtctaggtgacctacctggtaggcggaccaagaccgttatctctctgcagtctgattccctggtcttggctgctgcagttgtctatttattattaaaattgttcatagcattacaaagcctgtcccagcggatttcctggttaccagatgtattcttccagcttctgttgtcaggtaacagctagatctgtgcctaatgatcaggatcaattactcctgtcaggatgctggctcctttctgtgcctgctagtctcttaacacaaaaattccaaagtaactgggtgcagcagtagcttaaagtttaagagcttcctgttaagtcccatgacgaagaaattcaccgtcatgggatttagaccctcaaagcccggagctctggggaccagaagcacaaactcccaaagtgggccacagtaggcatagccactgttactttctctcactggtttctgtatttctgtattttgtcatggagacacagcaccatgaaatgatcatagatttagtgagtaaacatactgagtctggtggatggtgctcataggatattttctcaaagctgaagccagtgttatattttcaaaagattattccatctctctgtcaggccttcatcttctggatggtgtaggccgtgatagtccagtggatctcatggtcacatggccgcttctgcacctctatgccataaaataatttccctggtctgacacaatgttgtgcaggatcctatgttcgtgggtcacacatttcgtaagcccttgcatagtggtgctgactgaggccctgaagaagggagaggtaagcccatatcctgaatatgcattgattccagtcaagatgagttgctgccccttctaaagcggaggggcttcagtgtaatcagtttgcctcaaagtagctggttgttctctctgagggatgatgcaatattggattctcagctttggtgtcttttgctggcaggttagaaattcagcagtggcaggagccagctcagttttggtgactggccacccatgctattggacccacatatagcatccatcactccaccaagggtactgcacttacaagcccattgcaccatccatcaatgggatggctcatgacacagtatggtacctgcgttgtgtctaagattttagttcttacaaagggaaagctctctggtaggaattaatgtgcaataatcttcactctttgtacttactttcatatgtccttccttatacctcttccctagacctcctgtttccctccagggccctggccaaccagccttgccatttatcactgcctgtgcatcattatatattctatgtcaagccacctatcttttcacataaatgggatgacaatttgcttcacctgaagttatgcccatgaggaggatttcttattattcctgtctctaggacccactcctgagtaggcttcagtgcagcagtagtttacttttggcctggacgtatataccaagttgatccatgcatgaaccaatctcagcattttcctcctctttgagctcgtcattcagtactcccatttttccagaggtgagttgaatgagagacctggtactgtaataatagtggataatgtgggtgatctgagccacctactcatgcatccctggtactgcttgttccagatctcagatggtcccacttactataacaatggattaaggctgggctcactcaaccttatgatgtagtgatctgacagaactcagctcatgacacctgatgattcatggacaggtatttctccaccagagtacagtaacctgccagaaaatatttttgaaaggtgtatagttccctcttgcagatagcacaaccttgtttcagaatcctagagtctgtgttgattttcctattggtgcttgttataagcatcacagggcatcttttctccttctctaaatttctaatcacatggagtgacagggattctttcattgcaggctggacctgctgcagcactgtttcatgctctgggccccattctaagctggcagcatttaatgtcatccaataaatggatcacattcctaaatgtagaatgtgctgcctccagaacccagaaaggccaaataaagtgctgtgtttcattcttagtggtttaaattatgaaatgcaataattttttctttagattggagaggatattctagcataccttggactactgacccctagaagcttcattgacatgggggacccctgactcttcatagggcttatgtcccacctttcttctcaccaggacctctgatgtaccttccacttcttgctcatctgctttaatgtgatgctgctgatatggtggaccaaatgatgttctacagaatgttcacacagttcgggttcctttgcattagatctggataacattcagaagagttgaaagccctggtacatgcctgtaaaaatgtactgttaaccctgaaagcacttgcaaatagttttgaattctcctttcagagagggatggaaaaaattcatttgccaaatgtcatgtacttaaggctgaaatattctaaatttggcacagtggctgcaaatagagtgtactgggttaaatttgtgatattcaggcaccattctccagtctttggttttatgggatctcagctggtgaattaaatggggatatgttggagtacaccacctctgcctcctgcttcctttagtctttaagggtggcacttagataattttggaaatgtaaacacaataccatcgtcagagctttcaaaattaagataaatttaatgcctattacttcttaagaatgtgacattgattttgatttagttatggctagaaggatggtttgaagctttcacttgggcttcctcttacacaacagaccaagaaaccagtcttggggttgtgccagtttccaagtctgttcactccacttacacaattgaggacaaaggaaattaatactgatggatttgtggaaccagtagactctctgaaaaccagccctggtctaggactcctgctttttttttttttttttttttgagaacgagtttcgctcttgttgcccaggctggagtgcaatggcgcaatctcagctcaccacaacctccgcctcctgggttcaagcaattctcctgcctcagtggcccaagtagctgggattatgggcatgcgtcaccacgcccgagtaattttgtatttttagtagcgacagggtttctccatgttggtcagtctggtcttgaacacccggcctcaggtgatctgcccacctcggcctcccaaagtgctgggattacaggcatgagccactgcccctggttagactcctgctttttttttgtttaactgggcctcacgtttgtttgtttgtttgtttgtttgtttatttatttgagacagagtcttgttttgtcacccaggctggagttcagtggcatgatctcggctcactacagcctctgctccctgggttcaagcaattctcctgcctcagcctcctgagtagctgggactacaggcgtgtgccaccacgcccagctaatttttttgtatttttagtggagacggggtttcaccatgttggccaggatggtctcgatctcctgacctcgtgatctgcccgccttggcctcccaaaatgctgggattacaggtgtgagccaccatgcccggcctgtatctttattttaataggggaccattagatacctggtgctgcttcatacccagggtatacatgtcaacttgtacagttgtccattagtctttagaatatttggacatttctctctctcctcagcatacaactacccaagttaatggatgtaggtccttttagttaaagaccagaaaagtgttaccatagactcttgctgtgttattgtaagattcttctcctggggacttaccctctccttcaatcaatggattctgtctttgaaaactagcttaggtcgagaaacagagcaaaagattatgactttttattgcaacatctgccctcatctctcttgatcatccattcttgatgtcttctgattctattaattgaggaatgtctcttttatccgataatccatctttcttgtagggatgtcatgctatgttaaccatttccatagctctctaggtcaagtccccttgcaacttcaatcttacagtaagtgcacccactttgttttgatggtttagtgctattattttagaattctatattccagttactgtcagagtgcccaatctgtaaggtgtttcctagcatcaggtctaacctacgagggagagccacctctgaacttcccaacaatgttggtgctcttctcaccagcacatttcttattgctttggtaaatggagtgtcctttgggcctctggcagatcatagtcagctgatgggcttttcagctgtacctaatatagcagctttagcctgcctagttctgagatttggtttgcttcttcctctgtcacagcaattcaggcatttttactttacttaacatggttcattttttttttgttcaaattttcaagaggcaccctggtgttatcatcttctagggttcttgataatgtgttaaatcctctagtatagattagtgctcccacaatgggaaattctcctttatccaactctaagttctgccctttttcatccttcaccctcaggatccagtcccccactctctcccattcctgctagtacatagtgattaggtcctgcagctagttcttttgagatgtagtttttttcactcttagcagcctcttcaccttccctgatcaggcacattgctctgcaaagattattagatcatttgagatactactgggaagagtagatgtagtaaaaccccaaagtgaagtcaaaactatttctagagagcagactcttttctccctctaaggcatatattacatgctaatgtcaccttgacataaattcatgaagcaaggaggggcacaatctgagtaattctgggaaattttaaagtctccttctcagttgtctgggaactagtatagcaaaatagtctatgtttacacaaaaaggaagtgtagataattctaccagcagaagagcattttctgcaatcaacgagctaaggctaaagagtaaagacaattatttcctgtaatgtcacaccatcggcaagattatatgttaggtggcttaactgatttgtcattggtaactctgttaacatcaatcctatctttcaaaaatatttaaactattttaactagtctttttttcaaaaaaaaccctgctttgtgaatattattagcattaaaatgataatttttattggtaagtttattatgagttaatcagaggtggaaattaattttcatggatcagcattgtcataatgatagctagttgccttactaaggtaatactttcataaaagaaaccttcctggtgttctaggacaaagatataaacccaacaggtaaaggttcatatatgattttggccttattgaatatagcactaactatctgaaaaaaatatttttgtcctaatatcaggatagtcatagcaatatgaaatataaatattatagctaaaaatagttaatgtaaattaaaatgtacatcagttgccattgttataggtgtctatctcaattccaaggtcttgggttaagttgtctgtttccacgaaggcatctgcttctgaaatgaagatatcgtggaagctatgccttagttgtttcatacagcatgacacatttgtggtaagagttgttaagttgtactgagaatcttgtgccttaaatttttgatgtttttccccagaagactgaatgatctatagcttgcagcaggagccttcagataaatgaatggaaaaagcaaaacctttctcaggatgatgggggtgattggctttgattaataatatattgtgattaccaacaatattagaatggaggaatttagaatacagaggggtaaaaaaatgtcaatctatggacataaatccttgattcctctggaacgggaaaatattatagacagtaagggcactgaaaaactttcagagtcttttattaatgccataaaagatattgtaattaaatccaagagacatgcatttagatttttcaaagatgattctaataaagtaactatctagattcagctaatttgcaacactgtcagaaattataaagatcttgtttactataatccaatatagatgaatatatatgtttacattttgaagatcttgaatatttataacaattttaagactagtaaaatttgtatagaaaatttaggaaatttagaaaacttaggttttctatgggtaaataaaccctagttttgcaaagtctagaatattatgctaccatttttacactgtgagaaaactatggaaaaggcatattatcaaaccagcctaattttcaaggtttcacattagtcacattaccaggcaagggtacacatatcagcagaaaactaggctgaataatttgttgaaggaaaaagccaataatttgtgtatgtattagggagttgggttatggtgggttttgctggttaaaaactgaaggctacactctggataagacagatatagtccgtaagtcagtagatagttggttaaaacaaatgccactttttatcactgaaaaaagttttcagttaggttggtgtgggtctgtacctgggtcacgtgaaggtctcagttgcttatctgcttccactggtggaatgcccaaacatcacagttgtttgtcaacttcggagggttggaagcaattatgttgaaacaccacaaccagtttgaggtcttcaagcaaagtgaaaatggaaaaattgtcttgacactagtgtgtaccaaatcactatgttattgctatcccatagaatacctttatatgtggtccaacagtttgattttaaaattttcatcttattttgctagaaacttaactttgccattaattaaatgtatgataaacattttagagatgaaatataaaatacataaaagtactttttttttttcaaaaatcataggaagtatttgtgtagaaatgtttggagttctgtgttttaagataaatattaacgaaagcaaattgagtcagtcttattttataattccatgggtttgtcctttgtaatactttgtgagccttggacacgctagtggatatggagaggtttattttgttgtttaaagttttggaggtaggaggaatatcaactcttgtgttggatcaaatcagatcaaatagggaatcagcctatggtcagaatattctctcaccccaaacaaagttaaatacagaaataatgaaataaattcagcttatcttaagtcaagccctttttttttctggtttcagccaaggctgtaaaactgagtgccctctggtacctgccctagatgacagaagaagtcagaaggcaacaaaactttagtactcagaataaatctggtttaaactttattccaaaggctcaatttgattgaaaaatcccaaagaacaaaaaaagaccttattcctcaatgttcttggtatttttaatcctgaagtcagttggatccaaagcatctggcctcccatccctattttcctctttgacggtactgaactaaacagctcttaaaaatcacagagtcggttgaacttcagtcagggcatctgtcagtaccatattagcagatttgggccaacatttaaaaatgagtaattgggaatctggttcattttggcatgctgagagcctggccagagtcttcctatagcaggtggtttaatgggaacttggtccatgaaggctctgatgtgctctatttatgtctctgtgttagatgataagcccgaagctatggttgctgtgagtctgccagacaagaatctaaaacaaagcacagagttgattaccaccaggctcattgccaagggccctgccacaatactgcataagtgtagtgcccagtgccccaattgtgattggccttattgtttgtttctagtatcggtctggctgttagtaccacagtgtattgtatctattctctcccaaaaaccagagggctaatacttagtagcgaggtggggctagatacactcaccctatatcattgagtagagcatcacttagtcacatattagacaccagaaagctttctcggcgagatggtggaagagattcttgttcatagatcttggcaataaaagcactccttagctttatataaacacacattaaatacataagtaggtaaagtgttataaagagttttaaatgcatggcctcatttgatgcttataaccacttagtgttataggagaggtttgtattattattcccattttctcatgaaagaggaagttagaagagttaagtgatttgcctaagatcactcagccaacaagaagatccaagaatggttctgagctttgccgtctctcctcagcttttgtttcatgcacagccatctgatatctaagtggagagaatggtggcctggtgattgcatttaagacttaataatgatacatttaaaactgtaacatttagcagacctctagttgtggctactactgctgtcttgccacaaattctactgtattgatttttatccatgccgcattttaatattgtggacttaaaaatgaacatcggaatcctaccatctttgcagtggctgtaggggttagtttttttgcctggaaggatgctgtgaggaaacattttcaggtggcttgggtaaggcttataatgtctggatagcgtgaagtttgtaattagatcatgacagaatagcagcaactttttgttcaattaatcagaaaatatcatggcatgcctatgatgttcaaagaactatgccagtttgctaagaactagacaaggactgactgccttcaaagaacttacagttccattgagagataatacatgtgcacacaaaataaccagccacatagggcagctatttataatggcaagggtaggtacgaggcaaggcaagcctgtacaaggagaggtcacagtgagttgaggttattttggaagactcttgtagattttttagtggaagcaaaatttagatactgtatatgaaatgggggtaggtttctagatggtatgttgggagtgaagaaacagccaaaaataaataaataaatagaactataaaagaataaaacatattgtggatatgagtagacctgtctcactgcggacaggaatttataatgcaaaggagtggaagatagatgtcagaaaattggtgggaagattatggatggccctgaatacctgcatgaagagcttgttctgttaatctgtaaggaaagaagtgtcattcaagtattttgaatgggaggcagaaacttagaaagcatcatttcaccgggtggcagtgcccaggatagagtgaggaataaagggagaaacagactatcagtggagggacaagttagaaaatggagcaaaaatccggatgggaggtgaccctcagcagagcgtgataccggactggacagaggcactcgggtctcaccccggcttctgctgctcttttccttcccacacagtagccacaaggtgtcgctgtagcctttttttgctccctgaaaaatggcttgggggatgatgaggagcttttcaaatggctgcaatgtgaagtcatttctgcagttttggtgccatcttatttcatattgaacagtttagcatcatcttggaaaatacctgcatacctcaccctttggcccactagactctgtgtcctcttgtaagctgttctgtttaggcggttgcaactctcaggtgttggggactgtgggggttgttgctggccctgtagtagtaaacacatggacatcaaaattcagcacttaagtccgtgtgtgtgtgtgtgtgtgtgtgtgtgtgtgtgtgtgtgtgtcagaagcactttttttcttcttgggaaaagatactgtcattgacagaggaagaaatagcaggagtccttatctgggaggagaggaacatatcaggggtcctcaagaccaccccaggttcagtgattcactaggaggacacacaggactcagtgtatagtgctaatatctatagtttattacaacacaaggatgcaaagtaaaatcaacaaagggaagggctcatggcacaaagtctggaggaggccaggcacaagcttccaagagtcctctcccaggagagtcacacaggatgtgcctaattcctccagcaaagtactgtgaaacacatgtggaaggaatactggactcagtgtccagggtttttattgaggccttttcacataagcacttttcacataatcacataagagttgcaactgcctaaacagaacagcttacaagaggacacagagtctagtgggccgaagggttaggtatgcaggtctctgcattgcacataataaaattccagacttccagaaggacaaaatgtacattggtgcaaaaagtttcttttctgtctttttttttttttttttaattttaatatagagataaggtcttactgtgttgcctaggctggtcacaaactccagggctcaagcaatctgcctacctcagcatcccaaagtcctggaattacaggcatgagccaccatgcccagtctgtgcaaacagtttaggcccaatgagactctcttaactgtgctgtcaattggagaaaccctcctgcaatccgagttcccagatgccaaccaagggccaaccttgcaagcagcctttctttatttttttttaaattttttattttattattttttttgagatggagtcttgctctatccctcaggctagggggcagtagcacgattttggctcactgccacttccgactcttggattcaagaaattctcctgactcagcctcccgagtagctgggattacaggcgcctgccaccaagcccagctgacttctctatttttagtacagacggggtttccccatgttggtcaggctgctcttgaactcctgacctcaggcaatctgcctgcctcagcctcccaaagtgctgggattacaggcgtgagccaccacacccagctgcaagcagcctttttaaggagtctgatttgctatgttaactcttttctgcacagggagtgaaaataccgcttaggtttttgagaaggaggtattgatggatacatttttcaaaacccaggagagtctgacgttaaggtcatgtctctggaagtggtagttcaggttggagcaaaagtagtgaaaccagtcctggttgtctgtccacatacagaagactggagaggtagaagagaactgggatggtgtgttaggaaatcaagagaggagagaaggccgggcgagatggctcacgcctataatcctagcactttgggaggccgaggtgagcagatcatgaggtcaggagattgagaccatcctggctaacacggtgaaaccctgtctctactaaaaaaatacaaaaaattagccaggcgtggtggcaggcgcctgtagtcccagctactcgggaggctcaggcaggagaatggtgtgaacccgggaggcggagcttgcagtgagacgagattgggtcactgcactccagcctgggctacagaccaagatcccgtctcaaaaaaaaaacaaaaacaaaaacgagagaggttcaaaaggaggaaatgctcggtagtatataaagtactgcagatgggcagggattatgggcgctgaaaaatgccattgggacataatttaataatgtggtaattgattttcaacttaaaattatctgtacacattaagccagacttacttagccagtgccttgaatagctttcctgcctatcacatctttctgttttcttttgatcaccttacaaaagctctgttttaacattttttattgtggctttgaattttttgtttgggtttagatttcacaggcagagggaaatggatgagctttgggaaggctaaaaaaattctttgtgcaatactacatacttctctctggccattatttagggacagcagcagccgaaaatcacctcttctgttctggatggaaaagtaattcagtttgttcctttaagaggattaggtttaccatttcattgatttcatcgttgcttcctggtaaagaataaaaattaaaagctgcttgttttgagtggagacatctcaaggggcttatgaaagtgtctgaatttactactacaccgttggacttctcccagacccggagttccagttattgtctctctgatatttcatttctttttttttttctgggttctcggatgctaaagttgtatagaccctctgagatgaatgattattgttagacaagaccatgtgaaccaataatggcttttcctttggttataataaaaacatatcagaacaacatttattttttcaaaaagctctttttgtgtggctgactttgagtagtaggtggtctaggaaataccagcacctcctctctctctcacttgaaatgcttcaggattagaaaatcattgcaggcagaaagtggagagtgtggtgctcaatgtggcctttgcaattctacttacctccagtggtgggtgacagtcctggccttctggccttattcacgtcattgcacttcaggagggcaaatgtgcgctgtaactgaggtggttttaaattatctgtctcttgttctaatatcccagggcttccagcaaaagttctccttccacagtaaagagattgtggctatcagctgttcctggtgcaagcaggcggtaagattgggatgaaataaagcaatgtgggctcatgttttgtcgaaatacacttgtgtcattatttgagtttctccctggaagtagaaggcattcctaatttaatgtattgcttttctcatataggatccttggaggaagaaagacagactgaaactatagaacaatagcatagatgagctgggatacactagagagataaattaacttctatattttatgtacattaaagcttggggtcaaagactagaaaatcctcccctaattctaacactgggtctagagttgaggacttctcacacctagaccacattttccctccagtacctctgtattgttgagaactcctctggtatgaaggtacaacattagaagcaaagcaacgtatgacctaagaggtccctccaacacaggtggacaggaatcctggctcttctggttttaatgtttaatgtgcatgactttttattttggggctaagtgtgaggataagaagagtggttcttgtatgcttttttaggtttggatgttgtctgtacactcattgaaatgtagctctttcttacatttgaacatatatatactcattaggatctgatggtaatgtccctatttatttttctttaatctaccttttttcccactttatttagagcgtaattcctcggtctgtaccagatgctacattttcttatttgtttgtacatgtgtacctgtgtacctgttctttcttttaccacataacatatagtctaacccaggtgttggcagactacagctcgtaggccaagtctggctgccatctatttttgtaaataaaatttcactggaatgcagccatgcccagttatttatatattgtctgtggctgttttttttcatttatgtattgtctatagacactttcatgctacaatggcaaggatgagtaattgcaacagaggtggatgatcccataagcctaaaatatttattccctgtgcctttatagaaaaagtttgctgatgcctgctgtaatttctcaatgtccctattcttttgaataagttggaatatataaccccttcattgcacaggggacctgcaaagaaaaggctgtggtgtcttggtgaggttaaaggtttgcagaaaactcctgccactacacacatcacgctaaactagccacacaggccatggggctggaacagatgcatttagttgaaacatatgaaatggacattttgtgggtcaaaaccatttatattttggcagttccatatagttcaacttaataatatctctagcctcctacatgtcagaagaacctgctgtcactagatagagactcggtggtctggaaagctcagtgtcgctgcatcacaatcctgtgacattttttattcctggcattttcatttactttcagttagttgttacacaaataatcatttcacttctgttcaagaatgtgtgcacaaatataaggccatcctagttattgaatgaaactctgtaccagcaaggcaatatctccatttgtggtcctggggtccccagtgctgctatctttgctcctggttcttctaatctggtgagaccccactggtggggcagccttctgggcagcggtgtgctcagatcggctgcatctgctcctgccctgtgcagctaccaggctgtggtgcgatggtctatccagattcaattaatttggaaactcaatcccactttacaatgaacatgtgtgctctctttctattaatctgtagtccaactgaatcactacaaaggacaactttcacctgaccattgtggtagagctttggtcagttccacttatctttgaatttcccagtttcccaccttgtagaaggtgatttttgtaaggataataggtacaaaagatttgaacacaaattacagcggttgatatgttttcacagtccaggtgaaccccttctaggatatttgatgtcagacaagcaaataaatatgtgaccctttatggtacaggagaaagaatatggggtttgggacctggatttccagggttggggttttgattccatcatttaaaaactgtgcaatcttggatgtacctctgagtctctagagtggagattacttaagtattcattgagagacttgacataggcagtctctgcgatccctaatgttttagaaatgcagtggtcatacatttgagggtttatttgaattgccaagaaaaaaaagcaatttttaaagaaggtattcaaatgttaataatatttatctggtatatttgtttgcagatcaccaataactggtggcaggcagaattattaattattttaccagtattttatatacaattgcttgattaatgattagccactggatcacagcagatcttgaagacatgtagaaatgaaaacaaaaacctctctaatgttatgtaatgtaattagggtggacatatttgccagtttttttggagacggtcctaatttgtgtttgtgttttcaacataattattatcagtgatactttttacttttaacattgttccagttaaaatgataaataatatagttacgtgaagtataatctaagaagaaactgaggttgaatttttaaaatcactgtgattaaaatttaaggcctataattattgcataatgttgattttagttttctttttcagaaaaataaatgttattacacatcactatcactttatagtcacacaaaagatggttgaaaacttgactggcctaaggtcaccagtctgagtgtcactgttggggtatacagttaagaccctaatactgtggtattgttatgatcgttagcctacatttacttcctttcaaaagcaaaaatcactttagacttgccaagagtaatagggtcattgaattttttttttagcagtccagacaaacccaacagaagcaatctctttgtactttgttacttctgggattttcaactctgtagaagagacatcatgcttcttttctgccttctctaaaccggaaagacaacctgggaggatttatatctatgataggaaaaggaaaggcaggtggtaggcattgcctttctgcctgttcatttccttcttaacgttatcttagatcaaccaagtccatggccagcacaggtcaagggaagtgtatgtgaacattttgtgcaaaatcaggattaatagaaccctccaagactctaaaacttttaagtaaatattccatgcaacgattagaaagttttagcaggcttcatcctgctagactgatttcttgttatcaatgttataagtttgtaaaccggaataaatctgaagtctggtctctaagctcctggggctggctgggtggtgatgaggaaagcatgtcctcagtcctcagtgtgtgcccatgtgtgcatgtgtgcatgcatatgtatttttgtgcatgtaatgagtgtgtgtgtgtgtgtgtgtgtgtgtgtgtgtgtgcgtgtgtacatatttatcccttcttgctgcagcattactctttgaccagaattgtttactggcttatttttctcttcagtttcacaataaggtgacctgcttcatgctgcatcacattgaagaaccctgctccctgggggctcatgctgctgttattgtcccgcccacttggatcattaaggtgaagaaacctcaggtaactgccaggactctggtgctgctgggccagtgcagagaaaaatgaactgctgcttcgtgcttttctccccagactagtctttgggttcctatgacctcagttcactcatccccaaggccctgtgcttagcttcctcagttcatcccattggcccatctctttcccactttgggctctctcatggaaccagcctccccatcctaatgaattcaaagttctagagcaggaatgttgcctcctcattcatgtgctaatgatattctctttgataggtgctcttccaagtttcattgagtactagtggtgggtatagctgatgcttatacaactctgttctcttccagcctgggcattcccagagggtcagtgtgagggcaaactgttcaggcttcatggtttggttaagattcctgccacttccaacctggaaggcagaccatgaatcatgaccttcctgaatacacaggcctgcttagagagtgacatttgtttttttcttaaggcaaagtagaatttattctcttaatatctaatctcattctgtgttctccccagtgcacttcctgtccttgtgagtatccacctcagtattcagggaaaccttagtggtttcttgacaaggtcgtaatctttgaaataaaatgtttctgcctttgtactatacatccttgacagttagcttcaagttatgggatggcagatttttaatgctatgggaagagagactatacctcccttagggtgcaggtactgtaggaagacttatcaaatgcaatacctttaaatgatatggtggtcctacttcctgtggtctccagactcatcatgtgattcattctcattgactcaggtttatttaaaaactggtggatcagggatactgttttgctttctgtgttttatataaagtttagactctgttgatgagtaatgtttacgaataaaattatagtctatggaagcccttgggatatttttttccagaggcaagtatagtgtctacatattaaaaaatgaggagcctagtgcttcattttatattttagaaccaaatgccaagatatgttaaatgagttacccaaggtgataaaacaaattatatatagtattactatttgaaattcaagtgtactgaattccagtttttatttttaaatctctttaacatttctactttaaaattttttttttctaaaatttggtaatctctccaaggctttacattaaacattcattcagttaaatccacatctttccattgaaaacctcgattgtatcaggaaggctaataggcattgcgataaaatacgtgatccttactcttaagagtcttgttatgaagtgggggggagggcttcatgaagaagatgggatttgttctgctttgtaaaaatgggtgagatttaggtctgtggagtagagagagagtagcaggcaggagaatggcacacaggcatgagtactgtgtccaaaattatatccgtggaactgtgagtctagtttgaccaaagtgcagggtttatgcagagggtgtgtgggagatgaacatacaattgctcaggcctgactgtggaggaattttttttttttttaataaccgtgaactttatcctgaagtagcagcagagttccttttaagcaaaggaatgatagagtaaaaaaaaaaaaatatatatatatatatatatatatagtattttagaaagaaacaagtagcaagagtgtgtaaaatagcctagtggtatgggaatttggaagtccgcagacacactagttaggaaaatcaggggataataccagtttgtagggaaattgcaaagtttactcttctaaaccttaagaaaccctttttgttatggaaattttcaagcaaatgaagaaaaaggttataatgaatcctctagccatcaacttttctgccattctttttcatgtgtctcctgctacttcatattttcattttatgaattacctttttcttttgagattcacatgcagctgtgagaagcaatacagagaaatcacttgcacccttccaaaatttcttctcatggtaacatcttgcggtattacagtacaaaatcacaaccaggatattgaccttgattcagtcaagatacagaacattccatccccaggagcatccctggtggtcccttgtcaggagtcatatccatttcctcctggcctcaccccatctaccccatcttcctggaagtggaatccccctactttttctttaactagagtattttaaaacaaacattagacagcataccacttagtctgtaaacacttcattatgcttctgtaaaagatagcattaaaaaaatccaaatgccattatctcagtcatgttaataatcccttaaaattttttcctgttgtctaaaatatatctttttttactgtttttcaagtcaggatccaaagttcacaactgccttttgttgacgtagtttttaagcttcccttagtatagaacaataccccctgttatttgtcaggccacttacccgttgatgaaattgggtccctttacccataggatttcccatattttgattttggctgattcttaccatgtttccaaattatttctcttattgcccatatttcttgtaaactaatatttagacccagagactcaattatatttaggtttaatttttttttttttttttttttttttttttggtaaaagggatacactggcagtacattgccatcacaggaagaggatatcagccatttcactctcagtgatgctaagatcaatcagtgggttcaggaactgtcatcctaatctgtctatcataaagttcaccatcagcttgtcatctattgttatctatcaaagagttttgccaaagtctattattgcattaggggttgccaaggagtcgttttccaattttcactctttttagctatgatttttagaaaagagacctttccttcatcccaacaaatacatgacaaacgtttgagtatttgcctttatttgtaagttttcagaataataagctgatgccttagcaacccttataggatgtagtagtggttgtttttttggagagtatcattacgaaattacttaattatgtttttatgtattatgtgtttttccaatacgttgtcatcattcttcttcctatgtttatattgtttcatctccaaccattggaacctcttccacatggtgtctgtcttcacatttgttatgagccatgaggttttgagagcttccttggttttaggaacaataccatgtcccaggatcatttaatgcatttcctgtccatacctggaatcagagtcttggttctttctctagagtcttggttacttttaatgggatatgggatttatagctcatagtctggatgcacagtccaaattcattattcaacatgtgcctttttattaccgtctatgattcaggacaatgtagtaataataatagtaagaagagctaacatttatatgtgttaggaaagttttcagtattttacattcagtatcttattttatcatcatagtatcctatgagcaggtatcctgttattcttactctatatctgaggattgtgaggcacagagaagtcaaataaattacccagggtcatatagttattaaatagtttgagatgggacttggacccaggaattttgattccaaaaaacaagctcttattggtatgccacactgcctcactatctttctgtagccagccttgctgaatcagatgttttaaaaattttagtagtcttttctttagtgggcttcaaagccatcaagtaagttaaccaatgaaccatagtctatttaaaagctgaggtatggtgagcttgtggggacaatgcagcagtggttaagagctttctgacttttgagccaataccacctgggcccgtaataaccttgctgtagccacgtaactaatttgtgtaataccgaacaattaaactcttctattgaaactcttcgacaccaatgttaaattctatagacataaaaaaaccacgaggaagaaaacaaggagaaaagtcattgtgtctctgatctgttcatagatgacagtaaaaactatagtttgtagtgtgtggatcatgggtggcaagttttagccatgatttggaggtcaatatattagagaattcatttaagacattgggaagtgactaacggaaaatttggaacataggtggagaatagcagagtaaaatgtttttccaaatttgaggatacacacacacacacacacacacacacacacacacacacatacatacatatacacatatatgtatatgtatctatattctatcatactgcttcaaaataaataatagagaagatgttcttaattgaattcagttcatgttaatttaactacattcagagatgctattgtatacagtaggaggtccaaagatgaatccaccgtgatccatttccacaaagagtatactcaatagtggggaatatagctagaactatctaagtcactgggcagagtgtttgtggattttgaaaaattcagctgtgtgtaaatccttaataaaagagtgcctcctactatctcggaaggtttgctttttggtcagtatgcatctttgggagaaacacacaaaggatggtgagaggaaggggccagacaggttggttgaatcagccatggtcagcatccaaggtggcctatctatccaaggtggagagtggtcagtgctacctaagatgtataaacacagtgtgaatatgaagcagtacggagcattttcggtcatggggatcagggtaagctaaatagaaaatatgccatttgtggtaggccttaaaggatgtaggcagtgtcagtgaaacacgggttgagaaggacagtaaaagttgatagaactaactgagaacagttaagatggatctttaaataaagtcagctttatttgggatatttgtgtctaaacaagtgactctagagaggaggagtaaaggaaatctatttgagggtatcatggtcaggagacatggtttataaagagttggaattaaaccgcatatttcatttttactccacgagcaactgtggaattggcagctctgtgaaaccttgatgctaaagggagtgagggctgcttgggtaatttgctaggtttcatcacctcattatttagagagatgaagaagttattttgtagaaataaaaaggtaatggaagatagatgattttaaataactcaaatgaaaaccccaaatttaagaatcaagcctggatctgttgatatatttgaagtccaagttatatttaaagttacaaatgtcagtgtttctctttcggactgaaaatattactagacaatattttgattggacaggcaagttaaagatggtcaaataccagtgcatatacttggagctgagggattgagacttacgtgaattttctgtggggtcaagttgtagaagaccacagttgggaaagcttttacaaaacttatgtatcatgagatgacatcatttgaaaaaatattttgtacttggtcccctaaattttccaaactgtcacttttttgtaactttctcatgaatctcactgggctgctcctatcttctaaaaagaatataaaatggatcctccattctctttccttaatacagcctgttgtgacttcatagtactgagtgggaacaagctggtttctttgaaagaatgatagtgctcaatcttttattgtttcgtttgtagtaacatgagtaatatataaatatgctccctgtaaaaattaaacatctcagataagagagtctcctttcaccagcatttaaaatgataagcatctccgctgtctcttcctatgatatatgcagagtttttactgtgcgtttacatgcatggaaatgcacccacagaagaaatacagaaccacttcgagtgtaagggtgtgtgtttttaataaataattcttcacataatgctttaaaacttgcctttcttagtaaaaaaagattcttggggaaaagtctgttattatatgtagacttaactcattttttaaattgctgtatgtatcccatgctgtggatatatcctagtttattgatccatctgcctactggtggatatttatattgtttctaatgttctacttataaacaatgctgcattcatttcttcatagccctgtatgagctttcttcataatagtccccctttttttggtttatctcttctggttagataatcttcttaaaatactgggaacccatgaaatgtaatagctaattttgtgcaacgaccaataatatcctgtaaattagcctcaaaattgcctgaaccatttcctttggtgaattctaaagcttcattagtacttgtgatttagtcaaataggcctggttggagctgttgggaccctgtctgtaacttttggaataagttttctttatccttctgccttcccatcctcagagcagcctttgttccctggcacaatgggagcccagcagagtaagaatgcgctttaatagactaagtccattactctctctcctactgtctaccagagttttgtccagtatatgatgggggggagactttatttgggatgacaaagaagagcgaacagatctcttctcttgggatctgttattataaccagtcatttgtgatcttataacctggaaaaatccctgaagattaataagaggtagttaagtttcagtcacagttgagtgatttacccgtaactatttcttaatagcccagcaaggagtcataagcatgatcaggattttattgataggattatttctgtggcaaggtacaattatcctggtatgaagtacaggaaaacaaaaagcctttttatttaggtctttaacaaaagagcaggcacagaatgtctagggggcgactgctgttggaatcagaagaatgcaaaaatccaagtgagggtacatacagcatttcactgtgtttttagtgttgatcttgcaaagcgaatgcttttatcaccgagttagctgcccttgatataatagagatgatttgttttggaacatagcacaagtgttacaggtttcttgcatatatcaccaacaaattctacacagtaacttcttgacataattttaacattctcgaaaagcgtgctcttttgtttaactctctcaacaacactgacccaggcaggataagcgatcctgtagattatcaagagtaggtgatttatttcatcatggtcaaaacatatacaaaatctgccttcaaacccatctgttcctagaggtagagatagatacatatttatacaaaatagagatatgtatttatacaaaaatagaagggagccatgggattttgaggtatgctgtgaaattcctactatttatcttttgtgtttgactatccgtagggctgtaagcttactcagagctcacatagatgcgtccaggtactgtaagtcaacgactgtgcttggtctctgccctgttcttgttctgtgaagtgaagaaggcctcagatgcatttggtttggtgaggctagaagcacttgtatttgctacctctgtgttacaaaaaaaaaaaaaaaaaaaaagcccgttttgtgtgtctgttccctataagaattgagttctttgcctgctctgttttcagacatcaagccttactttaatgtgtttttctaactctgtgctccccatacgtgcttgatcatcaaaatcacctgaaatactgtgagttctacgatcagacaagtttaggaaacaatcttagcctgatgcgttagatctgtctcatggagtttaattgctgacatcctgtcaaggacctaggtccatagcatgttcctgcaagcacttggtgtctggcattgctcttggcagtaaatgaattaaaactacaaaaaagttaggaggcaagcattcacttcccaaggatcctttcccaaatcaggagaggctcagtaaatgctgtgaattataggaatatttgttcattatttcaacaatgattcgagtgtacactatgtgccaggaatttgtgctcggtgttggggacacacagctgagaatgaggcattatttagaatgagctaacatttactgaagtgctcatggtgggatgaatacccagctaactgcttcatgtacctttgctggttataacttcataactgtcccatgaggtgggtagtgtcaccatcattttaaaattaagaaactgttatttcagaagtttgactgacttggccaaggtcactgatctcacaacagggagattcagagtccataccagacgtatattcctgtctctgttcatcttctgcttaacacaatctatgtgtctcctcactttcctctttctactgccatcactctgtgatagagttgcctggtaaacttttaaaaagtatccttgcctgggctttaccccaaacagatgaaagaatagttgatggggcccgggcacgagcatttttcaaaactctctgggtgatgccaatgtgtagagatggttgagaagcatttagagcattgttaattgacaccaaatacatactgttcctgccagcctcgtggtttctagcattcttcttagatcatttggctgattaaatgattaatgattccaaatcacttttcttcccttttaaacaaacagaaatctatcaaaatataacaaatactttcataatgcgaaatattcctcagtgagggacatgataaaagacccatttaactgagaatttagaaactcgaagatctattttcagggggaagtagagtcaacagtgagtgatgaggaatgacctggggtctagagcacccatgagctcctcgatctctcttttcctggtgtgactctgagatcctgagatcttttaatctgatgggaaagaaaaccttgggacagatggtagttcttgaaaatttccctcatccccggtgaacacaggtcatgtatcaacttattttttttcccaaatccaagtcaaagtaaaataaaagctaaataggagcttactaatttggatgacttagtatatgtactttatactaaagattattttgaatgctcaaagaaaaaagaatacattaaaaagtagaatagacatttgcatttcttgaggctgtttgacaactttactcaaacaatgcatgcatatatacttatataaacttttaatttaagaattctgtgtttcttgctgccaacactttgttaaacatctattatatggtcagtaatatcttgccttttaaagatagcagtctaattaatcattgactctccactaattaaatctgtttttatcttgtcttcaatcagtgggttgtgactgatccctatgacaggttcttctcaaaacatctgtatcaaatattaagagaaaatggttagttgaagtaatcacaatattgtggtctataaagtttctagaaagagaaagacaaggaaagtaaatttgggggtcactgtatttcaacaagtttgaggcacttttataagaagaaaaaaatcaaggctaccaggggagggaaaactttttaaaccattaggtctttagacagagaaagaaagaacaatgacttccatcccactctcatagtgatttaaggtgagtattatctttgcattttacatgtcagacaactgataggacagttggatcataaatttcgagtagggtcaagagtcactttatgactattactagaaaagatcattaccaaaagagtaaactaagaaaaaaaaaacaaaaaagaaaaataaaaacatgaaaaatggcctccttttttacatttccacataggtgatctccatacgaggagatgaacttgaacttggttgggcgggagacgaacctggttgggcgggagactggagcccctcagagaatttgggattcttccatttttactgggagggttggcaggtataacatgtgttgttatgtgagtccatgagagcctctggggttcttactccctgcctctccgtgtggtggagagtcagtcgcttactctgaagcactcgactgatttctgtctgtggcttatccatgaacagtggcttggaagtgtgaaagcatgagaagcatgcagtggaacagcatgcgctgccgtcatcttctacttggttctgcatgggaaagctcctgggctggctgcctctgagctcaggcatttctctctctccctacagaactccctgaaggcttcaaatcggaagaagaagagaacaagctttaaaagaaaagccagtaaaagagggatggaagtaagtgtttcagagttttattctgaggaatttccactttctttccatagtctactctgtcctatgagatctggtccaagttgatttttctgatctatcttctactactgctttctcctcactacactctaaccacaataggattctttctgttcttttaaaaaaacaaacactcaaaactaacctctgcgcttgcctggaaatgttatccccaagatgatgatgatgaagatccaagctaatatttctggaatatttggagtttacagagtaaaataaaaagcctggcttaattctctggagcaaatgataacttgagatactttcttccaagccttacatggaagtcgtgttaagagtcagccctgggaaacaaaatgtattattgggtggttttccacctcccttgccttggggttgcctttcaagccatggatgtgtatcctaacagtgctgattgcttctttcagcaggaaaacaaaggtcgtccttttgtgataaaacccatctcttctcctctcatgaaacccttgcttgtatttgtgaatcccaagagtggaggcaaccaggtgagtaatttttcatgattttcaacttagaagttttgataatttcttgacgacacaactctcactgccaattaaaatagtaccactaggatcccaagctttggaagacaccggtttctcaggaacaaggttattgtttctctgatagctttacacattacagggctgggcaaaacctagatgttctataatttatctgtctgcttccatataagactataacaaaggcacttaagaaacctaactactgactttttccttacagattttcaagaaaggatattctagaatttctcttagttcgtatgtttcaggattcctcaattcttatagttaggaggcccttcatcaacttctttttatttctttctattgcaatttagatacaaccactttcatccctatcctcagagaagaaaaaaggatgattcatgagccatgataatccctaccaaataccaccaacattatagaaaatatcaacttcttaaggtttcacttggtcctagcccaaatccaatagtacagatacttatctcatttgagaataaagaaattgacttagaaaagttaagtctaaaggcatgcctaaagtgacactggtctataaaggacagaatttgttcttgaatcctggtctttgtctcttcatccgattatcttcccactctctgaggcttcttatcaatactcttctatgggctttaattttctgttattttcttctgagtttggatgagaaaatattttctttatccacgaagtatatattttacattttgagacaagattccttcaagttttacaataaacaactggagatttgaaaccctttagtcatcccatataaggaaggtaagttgtataaataggattgacccactggtccaagatgatgttcttattactaaagacaatgggcattgtccagaatgtattaattacaataaaacttctcttatgggagcttatgatttaaatgaaatattattcttcctttcatctctgccttcaaaattctcaaaaacttgatatggtaaaaatgtgtattaacattttggagaacaaggaaaagaaatttgtgtaagcaaagaaaccatttgttttcaagtcctgcatttttgagttgctgagagatctttatggagtaatgatggcaattctaagacatcattagaggaggacctagacatgggtttccttgaaatgaggtttaattttccctgaacaatacccactctcttgggctagtatccctatgttctatcaaaggttagagatgcagttgggaaccctgaaacatggaaatgtaattagttccatgattttggccacctgagcaccacatatcaattagtttcaaatatattttgtcatgacagtccacatataagatgcatttattaaatcattataagctctctttcctagggcgcacagaggctagtaagttatctatttctttaaggagctgatgatccagttaagacatagcctgttcctattccagtctatgtgtaaattattaatgacggggacttcagagattatctaatattgcttcctatttcactaaatagaaaagggaggtcaaggaagcttaaaatgaattttctaaagacatcttgtaaatgacacaaaaggaacaaatggaaaataatttaagcaacattaactgcatgtgacttctaaattgagtggctcagactgcagtgctatgatatttcagaggtaagcagtgacttgggagtgataaggaaatggtgtcatggacatggctgaaatcaaagatgggtactacttagttatgcagaggagagaagactggaaggtctgtccttttcctgctctttactgtggcagattcctgttcagcaaattcttgttcatccttcgaggctcagtggtgcctttctgaaccatttctcgagatcaatcatcctgtccactatgccccgatagcccttggtacacacttgcatgatatgaacagtaacataactgctctatgtgcgtcttcactgttggggtacaggtccaccattgaatctgtgatttctagaacacggcacatagttaaataattgtataataggattagaagaacagatgtcatgatgccgattattcattttgaggacaatatgatgagtggtgcatgcatattaagttattggaaatgtgattaaagattagaatgatcctatggaatcacgtcttcaagaaacaggatacttcaggttgaagactttggatttatgcaatggaaactagtttttttgctgtttaaaatattttagtttaaaaaatcttttggcttttgaacagaggaataatatggtggaatttaatgtgcgtatgattcagatgggaattgtgctaaaatgcagattctgcttcagtaagtcggggtgggccctaagatgctgcattcgtaataagctcgcaggtgctgagactgctgctcagagaaccatactatggttagcaggggcttactgtgataaatagaaaaatagatactttttgttaaatcttgagttttgccttttaataatttacttattccactcacctgcttttagatataaaggattcctatctccttctgtctttgaaacttaggctttagactttttttttctttttttttaaaaaatttttaacttgcttagtcttctaagtaaattactggacaatattgccacctactggcaagaaaaatagctttttctctttatataatattttacttgtgtaagaaaaacattttgaaggaatgtattgggatgaaccgtgtaaggactgcttctatgtctctcttttaagaaatcccatattttaaaactctttaattttttttctaaattgatacattctttttgtacatacttatggagtacatatgctattttgatacatttatggcatgtataatgagcaagttagtgtatttagcacatctatcacctcaaacatttatcatttctttgtgtttgaaatatgtcaaatcttctagctattttgaaatgtgcaatatactgttgttaagtatagtcaccccactgtgcaaacactagaacctatttcttctatgtaattgtatgtttttactcactgtccaacgtctggtcatcccccacacccaccacacccttcccagtctttggtaactatcattctactctctacctctgtcagatccactttcttagctctactacatatgagtgagaacatgtcaatttttgtctttctgtgccaggtttatttcacttaacataatgacctccagttctatctttgttgctgcaaatgacaggatttcattcttttttatggtcaaatagtattttattatgtatatataccacagtttctttatccattcttccactgatgaacacctaggttgttaaatctcttcttttaaacttagcagtaattgtctctttgtttttccaacactcttaaggtagcgatgacactgggtgttttgcaaagctgtagagcttggtagcactgctgctattattttattgggatttgacttatttgaggaatcagggaccaaaatttcaactttttttattttattttattttattttattttattttattttattttattttattttattttattttatatttttgagacggagtcttgctctgtcacccaggctggagtgcagtgacacgatctcagctcactgcaacctccacctcccaggttcaagcaattctcttggctcagcctcccaagtagctgggattacaggcatgtgtcaccacaccaggctaatttctgtatttttagtagagacggggtttcactatgttggccaggctggtctggaatgcctgacctcaggtgatctgcccgccttggcctcccaaagtgctgggattatagcactgtgcccagccaaaaatttcaactttgaatacctccttcggtggaaagagatagtaagtgtaacataaagtttactccagtgcaatcccctcctatgtgtggaaactttcgagtactagagaaatacgtcccctcccttacacttctgtttgccttaatgtcaaaacttagatttttctttgaggtcctggactcattagcatctttctgagttttatagaatcctgtgatatctctcagtgtttcctgctttcacactgtctctccctcacgttctctcatgactttctcttccagtgacctagactttaacttcagggtaaagcaatgttctgacctctaggatgattctatctgatcatccctgagagccaagggatccagaccctggctttgcacactgttcgatgtggaatcctggggtagaagtatggcaggagttggatccttggattacaggtcccagggtctttatcagtagggtgatcgaggaagaggtgtccagtctgtggacagacacatggcagctgagtttacaccaccatctgggaatcggctttctcagactagggccacccctcctaagtcaggggccagtcacatcaaggtggggagaaggggaagacagaaagagtaaataacttcagatgagaaatttgagtcccaaaactgtttctaaataattggacaagcaactttaatgaagtagttacttttttgcagtactggaaacttctcaacctagtgataattcaaggatcattatgtttagataaaagtgcaggctccctaaggtttagagtaggcagggaagagggcagagggaagtcagtagacgaggacacttgtcaaaatgcagcctcaacatcttcttgtccagctagcctcaacagatggaattaaaacaaccaaatgatgaacctatggaaagtcctatttctgaaatcatagtattggtgggaggattgggcagctaagacccaaactagctcctgtgataggtctggttccttagtctgtagccagagcgatgcataaaaaatgtcagtctgggagaaaaaaaagctggtctgaatctcttaatgaagacttttcagtgactccttgttttctataaattaaagcctaagcctctcagcatacattatttaaaccacagctcacttcagctgtctcctctctcgcaactccctgtctcatggttcagaaaagtgaacagaatgtagctttttcatgggatgtcttgctgtttcacaccttttgtgcctttaccctgaaggttcttcatctattcgaggtggaaagaaatagttaagtctactcatttttcaagacacatttcagatattttacttacaacgccttctaatctctcaacttgggcttaagagtgtttcctctgggcactcatcctccttagcagacgtctgtatcagagaagttcccatctttggtgaattaatttattttgtattgctctccttccagtaagttctgagatcccgacggtacacatggacagagtaggggcctaatacgtatttatcaaataaatgaggcattctatttggattgtttgaagcagtttgaaataataatttcttaagcccttcctctcattaatgtatttttctcaggcctttcttattgtctgggcagttgttctttctataatctagataatgcctgcatgatataaaccaagacttagtaacatagcagagtttcaacctacactagagttatggtgctttgatgaagattgatgagctatttgaaccgacccgttcttgattgcttctccacacccccaacaattgtcattatgttttcctttatgaataatgcatggaacttccttctgagaacaagatcatctctgtcttgttcatctctgtattctcctacctaaaactgtgcctgtcacatagtaggtgaatgaatgaatcttgttcaatccagtcactttttgggaatttgtattctcctgttgcactccctccctagtacttgctgcttggaagaataatgttcttttactccttaggaatacccattcttataatatctaaaaaagttctgtggccagtgaggtatatctacagtagcatgcatggattgggattggcatataagctgtttttttttttcatttagagaaaattagactcttgcacaaaagttgcagtttttatgtttggcattatagcatgtgataactatgagagtgctggagagttgttagtaagtgacagatgtctaaatgagcagatttaatcctactattgaggaagaaatgaattacccttctcctggtgaattaatatttgtcaaaccattcagttacatttaataaattatctctattaaagctttaaagttacttaacccagaggtaacagcagagttaatagaattcatttaagtgtgtgagttagatctttgtttctccacacactaggtggagcattttttcaacgctttcttttagatacttacatttttggtaataaataccatattttgaaaagaagattactttttaaaagatgtaatcatatcatgcctgaatgtcaatttcaacagggtagccatgcctggctatgcaagttatctttacacaattgcaggcatgttattccaatagactgcaatagaaatgtcacctctgtggccactcggaccttttagagaaattcaagtttaaggaaaacaacctctcaatgctttttatttttattttttggaagatgttagttacctattaatatttgcataatggagaggctgaagctgagctgtgcactctactatagcacaggtggaaaggagtaattaacatcaacaattcaaactactctaggaatctaaaactgaacaaagaactttctagcaagtcagttggaaatgttttataaattagttggtcattaaaataactcctgtgttacctattaaacataaaagattattcgagataatcccaaacacacttcatagcaaggctcagcgtgagaagagggaaaatgatctagtatttagtgtgtatacagatctaagtctatgtttgaatttgataggaagcacaatatgtcatttggtgaaactcaaggattcgttgtaattattagatagaacgtgattcctaaaattatagcaagcacatgataaggcagaacttttaaattataggtttggctggtacatgcaacaaaagacctgcattggcctatgtaacaacaggagtaacaatgtgataattataagctatactttagagctcacattctcaagtgtaatttaatgagtagattaactggctgcaaaaaagaaaaggattaacggtaacaaaggtctgttttgtgccgcatactgtgctagatacgtgactgttagtgattcacttaattctcatactcaccctggaaggtggacatcctttctattttatatactgcatttctgcaaggttataaatgctcatgattactcagaacactgaagttagtttgacctcaaatctcatactatgtccagtatactgggatgactcttaaatgcagcttattagatatacaaacctaggcatattttaagaaagagcaattacgatatctactaaaacaacaatattatgagcaacaaactcggctcaactggtcaaatattatttgctatgggtgataaaatggggcatcctactgatttttaaagctcttttggtattgcttgataaaaagatccttcttgcatttctttttcttttttttttttgagacagagtctcgctctttcacccaggccgaagtgtagtggcgctatttcggctcactgcaagctccgcctcctgggttcatgcccttctcctgcctcagcctcccgagtagctgggactacaggtgcccgccaccgtgcccggctaattttttgtgtttttagtagagacggggtttcactgtgttcgccaggatggtctcaatctcctgaccttgtgatctgcccgcctcggcctcccaaggtgctgggattacaggcatgagccaccgtgcccggccccttcttgcatttcttgtttgctcaatccaatttaaaaatgatctctaaagtgaccttatgtctgctgtaatgatgatctctataaatgtcacagttacttaaaatgccccaaaaatgttcacgtgacagagaagtgtttggcttaaacaaaccagtataggcatggagattgaaaatgtcaaagtaagctgtgatcttactaaggaagttttatatatgtataaaataactgggagcctgggatacttttgcttcagttagaaaaaactatttctataaaattatattaatacttagctaatactgcccatattttatattatacagacaataatctgtacaataaagtgaaaattaatgtcaaattacataggctgactaataacttttctatatggattttcatacattaatgatagtaaaataaatattattcattaagggcttactgcattttaaacactgtgatgtacttctcaaaaattatggcttttaatccttgcaacaagtctgcaaactgggtattcttgtctctgtgttaaagaaaaggagggctgagctaaatgaaatgaagaaacttgcccagagttacacaggttagataaacatctaaactgacattcaacctatggctatccatgaccaaagcccgtgattttaactactcttctatactgcttataattagatattattttatttatttattcatcattcattcactcacttattattttttgagacagggtttcactcctgtcactcaggctggagtgcaatggtgtgatctcggctcactgcacactccgcctcctcagctgggactaaagacatgtgtcaccacacctggctgatgtttgtattttttgtagagacgggattttgtcatgttgcctaggctggtctcaaactcctgggctcaagtgatccacctgcgtcagccttccaaggtgctgggattacaggcgtgtgccaccgtgccctgtgtattattttaaataaaagtatttattttttaaatgagcagttattcttgggaaatttcttcctattattgcctttttgtgtatttattttttacagggaaccaaagtcctgcagatgttcatgtggtacctgaatccacggcaagtctttgatctttctcaggaagggccaaaagatgcgtaagtctggaaatattctccatggtccatatgtattttaggcaagtgagaattttctgcttcattatctgattaccttgtgaggtatatcctgaccatctgtcatctaccttctcacctgtactctccttcctttaaaacttcatccaaagttctctcctactctttattggcttagttcccttcgaaacatatcttctcagctattaactcaggatacgtctagtgtgtttgttacttacgtatgtgtaactgtaggttattctctgcaaatctgtgaattgagaaaggactcattgtttttctatttcttcatgtacaactttggagatgcacattaatggaatgtaaatgtatgtctgtggagggtggagccatgtttgtttatgaatatttgaactgaaaagagagagtgtgtgtgtgtgtgtgcgcgcgcttgtgtgtgagagagagagaatcaattgattatacctgaggactctgcacaaatgtggggaagacatattaattcctgctcaatcccgtttctgagcttctcagaaatctcattctctgcttttgttagaagtgtttaaaataaagtctagattgtaggtgacccatatcctgcttctctcctttggtggagaggcacacagtggaaaagaccaaggacacttctgctgttctctggttctccgttttaaattcatgtactaggatagttcagatgttatctgataaatgttagaacacaagggtaccacttattttttaataagtaacaatatcagaggaaaaggtgatttctagagaaatagtattcttgtataaaatggataaattacttattttaagcatgcagattaggaaatatgaaaattaatttgttattttcttaacgtatgaatttcttcaccagttgagtttgctgcaagattcttcctctctctgtcccataatacatatatatatatttatttatttttattttctgtacttgattatgctaaggcaaatctgctatcctgggatgtgccattttaggagcttatttttcttaagattttatcactttagttagaccctagagagacacttcagaggtcaccgtaaagaacatggtaggacaggaaatattttcagaaaaaaaccatattttgtgatttaaataggtgatattttctagattacagcctctagcaacttcacctaagcaaaagatttagcaggggcagtgtcaatgcattttcctgagatccaagaggaaagacaaaattatcttatttcaagcagagaagtttgaaataaataaaaatcagtcaatcttcccactttgggttggaggtgtaagtggtgtgtaactgagctgagagaaagactagatggaattgtagatgtgatacctgtgttcacatctgagagtgcggaagcctccccgtctcgctgaaaaagatttcttaggattaagagtagaaagtataagttagaagaagtaaatacatccagggaaaactaataaatataaagaggggatatataaggactactgattatcaattaatgatgattttcttggggaaaggggaagaggaaatgatgggaaaagaaaaagaaggaagtcaaaactaacgaggaaaataatgttgacatataatagaagttatgggaaataaaactaggacatcctaaaatcccttaaattccaacgttgaattattcattcaaaaataatgtctgatgcctacacctgttccactggtgggagtcattcttcctgtggttacttgggacctatgatagcattgtcatcctcatgattacacattttctccagcggacaccacccctacctacccatgttgtcctctgctttctctctgctctagccagtgaaatgttcttttgtttactttttcttctatttcctctacaggcttgaattgtataggaaagtaccaaatctgcgaattctggcctgtggtggggatggaacggtaggtccctgagagagaatccagttctctgccaattctatctttcttattgttttcttgtggcacttctttttattcgttgctcagtctttctaatcccctaacacatgtatatctctcatgtgaatcatagcccctaagagtaacaagggactttgttattgtccttatgaatacatacttgatccttctaatgtgtgcttcactccttcaactatgctgtattcttttgtgtgccatgaagtagggatgtggtcaaatccttaaaatgaagattatagatagataaattccttttaaaatataagctgaactgtttccatttattcttaataatttggccacagtagggagaaatacgtggacacaattgaattattatgtttttttttttactagtgggaataaaactcagaatattgagtgttgttttgccttaaagattattaattggtcctatttatgttcttttttgttgacatactttacctgtatatggggtatgtgtgatattttgttatatgcatagaatgtataatgatcaagtcaaggtttggaggtatccattacctaggctatcatttctatgtgttgggaacatttcaagttctcttttctagctactttgaaatatataatacattgttgctaactgtactcaccctactctgccattgaacattagaacttattccttctgactgtatgtttgtattcatttatgaaaaaaaggtggaattgggctgaaggttaatatcatggatatattttctcctgtttattatgcctcatcggttttctccatttggcctctacttatggtgatatatttaacaaagtaaagaattgagaatcatgacatttagattgtgttgtctggttctttttcttccggatttggaatctgatctcataggatctacgaatgtattatgaactatctttagcttttctctaatttccctaattagaatgttttattctcaaaggtagcaacaaaatcttcgaatactatctctcttagcacataagcacttaatgtagggttggatacacattatataccaataaatgcaatgagaatgaaatagaactgtgatttttattggtctctcagatactgtgtggagagtaaaaacaatgttcagttgggaaaaatagtctttatctttcttcaaggttcatattacacattattagtttataaaattcattataatgtcttacagcaaagaagccaaacctatttaacttttttaaacccaacgtttttcaaaattatttggccatggaatttttttcccccacacaataccaatttcaattgattttagtgttctagggagatcaatttaagggatatggtagggcaaaatttcccaactttctttagtaagaattacatccaaatgaaccctctgaggatggatatactgtgttcttcctaactcaagcatcccccagcttagttatctttaatgaaagggtaaactcactgtgactctttaccatacccatagttatcttccttattttagcatctacttgccttctcatatgacttcagcatctcactcacatcttttctccttttctaaacctcagtgacaaaaacagataagttgaggatgtcgtccttcctctttcttaactcaaatccacataagctatgcataacatccccagatcttggacttctttgttgccttgggtgctccacctcccaggcctccctttctccatggaaactcccattccacctctccctccctcattctctctcctttcttcttccttttcttttctttctttcttttttttttttttttttttttttttttttttgagacggagtctcactctgttgcccaggctggagtgcagtggcacaatctcagctcactgcaacctctgcctcccaggttcaagtgattctcttgcctcagcctcccgagtagttgggactacaggcacgtgccaccacagcgggctaatttttgtatttttagtagagacgatgtttcaccgtgttagccaggatggtctcgatctcctgacctcgtgatccacctgcctcggcctcccaaagtgctgggattacaggtgtgaaccaccctgcctgcccgttttccttctttactcagcagatatgtggaggaagcactgtgctaggtcatgtagtattgagatattctctgcaattagatgaatatttgaaagtatgggattccaatgaataaaagataaagaggaaagagagccaagtccacacacttgtgaaatgtataattatgggtccggagccaaagtccaaaaggaaaataaatgaaaaaatagaagaataggacagccaccagtctgttctgtcaagtaaacaaaccaaaaaaggagtttcaagaaagaggcagtagttacatttttaaggagagactgaaaagttaccattgaatatggaatttcaagaaagcagtttcaatagagtatgtggggcaaaacccagaatgatgagtaagtgaaagttggtacaatcttaataaattcctaatggccagatccgattacagtttcgaatgtctgtgatctctctgatgccattgtcagcctcctgacatgtagactacctacttctcctatttttcatatccagtcttttcaagcaactcttcattaatgatagcataactatgagtattccataagggtaactaatttttttaatgtggtaggtaccttttcctcttagggacattatctatattttaacatctgtttttacctcctctgatgtaattcacaaatgtactagtcatttacacttgggtgccccatggccacttgcattcagcatgcctaaaataaaagtagtacgtttaccctagagttggcacatttaaactaattatttttgtcagtggtaacatctgtagttaaaatacttagaatcaaaactttgcttatcttgtaccttatgtaaacccaagttttatttaatttaccttgttaggataagatgttttgtgaaaaacatggggtatatgaaatgtttgtcatggtatgtgattgattttttttgttttgttagtttagaaaatgaaacttttaattgtgggcggaggcagagtttatatagaggaaacagcctgaggaattcatgaagaaaactgctggctttaggcaagtggagtataattctgaattcaggtatatatttgacacaaggtattcagcctttcgttagtgagcacatctgtcactgtagaagctggcagaatgctgccagtaaagtgacaaagcttagggagaaatcagaaattgaatatttttcactgactgggatgaggctatattaccccataaccgtattagtttaaattaagagtattatttaaggtatagaaagtattatttaaggtatagaaagtttgcattactttggaaaaaagttcttaggcttcaatattagctactttaattgtatattatttaaaaaatacatgaaaggccaggtgtggtggctcacgcctataatcccagcactttgggaggccgaggtgagcacatcacttgaggtcaggagtttgagatcagcttggccaatctgatgaaacaccatctctattaaaaatataaaaattagtcgggcatggtggtgcacacctgtaatcccagctacttgggaggttgaggcaggagaatcacttgaacccagaaggtggaggtggcagtgagctgagattgtgctactgcactccagcctgggtgacacagtgagactctgtctcaagaaagaaaaaaatatgagaaagcagagggaaacattccccaataatgcacttggaagtggaggtgaaagaggtggttctgctctcatttctgtgacctttggcaggttccttaacctcttttgagaccttctgaatctacaaagaaatgcattcagatctctaaggttcttatagctgtagcattataataatataggctattgttcaagggaactttaatgcaagccacatttgtacaattttgaattttctagaaggtacttttaaaaaggtaaaaagcaggtgaaattagtttataatatattttatttatctaaaatagtatcatttcaatatgtgttaatttataaacattgttaagatattttatgttctatttgtacagtcttcaaaatctagcatatattttatacttacagcacatccaatttggattagctatattcgagtgctggatcaccacatgtggccaatggctgctgcgttggacagtgcaggtgtagtctctttgttactggcttgcacagttcagaggctgtcacatagttacagctgtcagatggtctgatcccattttcagatctcttggctgcaataaattcagctcactcaagaatgatctcaaaccttcatgtttataaatgagaaatagcctgtctttggtcatgtgataaatttgtattttctcacttccttggccacgttgacacctattcaactcctaatggctgtcaccctgctgaaatattgacgagcacatgaactgatctcctgaggctcacgtactctcattatggttccttaaggtgtgtgacccatggtccctatctatctggctcctgactttggtgaacttggctggatctgcaagtccacctttaaccattttaattatttccaaaaggcctgacattaaattgactccagccatccacttcatgcttatttcttgttctattggcttttctagatgaaaaagcatcccaaatggtagacatccccatgccctgactcaccacagccaatgcaaagaaggaagtattattttcctttaattgatagggacaatccctcatcctaagcccctttcctcattcatcctcagcctagttatatttcatcctctctcactgagtaagcacacagtgtaccttcagtgtggattctatattgtttcaagaaaaggtcatattctgatttttatcttgatttcttttgggctaattttaagcacatttcttttaacacatgttggctttattaagtgcaaacatacattaaaatatcaaaaggaagaattattgtgcacatattcaaaagggtcccccagtcatccaatactgtgtggtcattttctttcagagctcagcaaaactcttgttttcctttgatttccaaacgtgagtgtccttcgctttttggcctgcatgtactacaaggcagcgcaacgtgcatctgttctcttggaagaaaatatcagtttgctgtcatctccacccttcagccaccccttatgttagtatactgcagaatgaaaatattgctcaaaatgcacttggtaaacattcagtgacaactaatgctaaaaacggacagatggtggcagcattgaccagctgctgctgtgcatggctgctcagggacaaagcggaggacctggtgttctcaatctgtcagccctgcttttcctaggaaggaaggaaagaactttgcaagctggaaaatcattaggcccaatcaggataactttcttcagttctggtggaaaatataccaagtgcaataagttgcagttaattaaataatttaattgaaagggtgctaggtgagctggtggagatgatttgggaaaatacgaaagccgtggcagagttcctgcccatagaacctttcaatgtgcagtctggacttcaggtggaaacgggttccggattactgtaaagacagagcttccagtaacagctttaagatcttttgtaaagtttttctctaaggacaaagacacagattgtttcccaagatttttaatgtctcctgctattgtaagtgtgtatttgtttccattttgttttttatagccccttttttactgcagggaacctctgcttttactgttctttacagtctgcaaaagaaacgctttctgatttgatggcagctgaaggtggggctgatttgcaaactcagggctcaactttaagtggagaaatgggaagagggcatttttcttctaggaaactgggcctttattgaggaaggttggaaagaggtagcaaaatctagctgagtcatagtagctaatgttagtttagcatttcctgtttgtcaggcactagctaagcaatgtctacacatgagttgatgaaacaactctaaaagtcaggcattattattactcttgctgtacagatgtgaggggagcttagagagattaaatgacttgcctaaactcacccagccaatttgtggtggagctgagctccctgccgctcagctcggtgccccacacttctgcgctgtgctgtcttccgggaatgctggctgttggggaatgctgatagagctgctggctgaaaaaaactattcaggagctgtggaggggcgatatagacccacctcagccagagaactattagcctaatattggttgtctgtgggagaatttcaagacaaaacaaaatctgtgctgtgaaaggcaggaggcctttgatgactccaagggtgatggaatgatgaaatgcaagattttctgcttatattcaggagacaatgacatatttgatcatttggctacagaaaaaaggagaaagaatctatttatccggttcataaagcaaattgattgatgagaggcgaagcacctttacattcacacactgtgtacttgtccttttctgcatagaccaagggtaaaaggagaagagatggtgagaaatccaggcaccctgtgggctctgcctttgtgaggaatcgtagctcagtatcacgagaactcctgacaaccttctctgagaaaacaattaggaacacagcctagaagatttgaatgagggctgttagaagacgcagcatcagctggatgcagtggctcatgcctgtaatcccagcactttggcgggcggatcactttgagctcaggagtttgggggcagcctgggcaatacggcaaaagccgcccccatctctacaaaaaatgcaaaaattagcctggtgtggtgacttgcacctgtggtcccagctgctcgcgtggcggaggctggagaatcgcttgagcccacgaggtagacgcttcagtgagctgagattgcaccactccagactggacaacagagtgaaactctgtctcaaaaaagacaaaaaaaacaacaacacagcatcgattcatagaagttgtgggatacgtcacgtacttcagagtcatttggaaattgtttgtgttccatgggcagtgaattaaccccctaacgttccatctgttttagtattagcattcctcctgcactgtggaattgtttcttctttgcaagctcatcttcacaggaagttgttttatttaatttttacttttctatctctgaatccctttggtttctagtaatattgaattgttttcaggactttcagatgagagctgggtttttctatagattcctatggctccaccctggggagatggcaggggtatgtcactgggcttttgggaagtcgggttgagcacttaccagagtgaggctttctgggcttctttcagccatagtacgtcccacctttctgtgggccatgacctcagactggttttcacattccttcctcctctcttcctccctgctatgaaagagccgtgctccaggacagcttgctgtcagtagggcacacacttttatttctccattatcaggcaagccaaaatcccagcttcctctgctatttgcaagaccaggagccaagctgatccaagcctttaccccagctctgccactttgtattttttttctggcccattgaagctgcgtcttttttttttttctttctttttttcttttctatcattgttgtgtctgagtgaaatgggatattgaaagtgtaaactcatagcattttctttacccagaaaagagagacatatttcaagtgagcataagaaaaatgtctaatttaaatctgcctgaaagaaaacgggctgacttgggagcacaaatcataaaggagaggttgaatgattgtctcttagagaagttttaaggagaatgccttcttccttctttggaaggggtggtgaattagatttctactgagttctctggtgggtctgtgagtctggctctattcagggctgttgtttctgcagttggtgatcccagatgggtgggctttttctgagtatttatgtcctttttatggcctttaagaccccttcttgcagtttattagaactatctacttttactgtgtttaatctgtgcttttagcagtgcagaaacaatgtcaagcacaaacatcagaactaatttagcatcaggcatttttatttggacttcagtagccagctttgttggtattgcacgtaaaagaagagactaaagaagctctgggtcagaatctaaggatctgtctgggagtaagttccccagtttagggaagtggacagactttttgacatttataggtctggatttttagttaccacattgggtgaaccatgtggtctgcctttttagaagatgaacacaattttagacataattggtagacgagcaagttttacatcctggtaagtcacctttgtggaggagaaagaattttagttggaagtcaggagaaccaacgttaccatgactctgacacttctaatcatttggtcttgagaaaattccatggtttttttgcacctcagtttatcaatctgcaagttcactgaatttgattaagcaatgtttaaggtttcttcatctccacaggttccaaaaatcacatgccactgcttccaggagggtctggccatatccagaagggggttgagttctttatttaagggttccctataccttagcagttaaggggttggccactggcattaggcattcctatttttgaatgccatctatatcgtgtaaactgtgtgatactaaggaggtcacttacctttccaattctctgtttccttatctataagatggaaatgaaaattacattaatatctgtcttacagataatgttttaaagtttaatacaataattcattaaaggactttgctcaggcatggcacatagaaaggcatcggtatgggcctggcacggtggctcacgcctgtaatcccagcactttgggaggccgaggtgggcagatcacaaggtcaggagattgagaccatcctggctaacacggtgaaaccccgtctctactaaaaatacaaaaaattcgcccggcgtggtggcatacgcctgtagtcccggctacttgggaggctgaggcaggagaatggcgtgaacccaggaggtggagcttgcagtgagcggagatcttgccgctgcactccagcctggacgaccgattgagactccatctcaaaaaaaaaaaaaaaaaaagcatcggtatgtccatctttgtgttactgtgaactcctggagagcaatctttctaccttatctgtcacagcctagctcatttatctctttattttgattgcttagttctgggttttatatgaagtagtgttcaataaacaaatgatctagtatttttgagaaacatgactcgtacaaatatagaatgaatacatgtcaaaaaatttgcttagctctttaatgagggagcctgcaagatagtaaagctgatttatcagaactagagaaaaagaattatgtacttcgtatcaaaataatttttctaaatttgatgcaaaactgatcaacgtcctatgagagaataaaactataaactttaaagcaatcatctcttcttgacatttgtgtctctataggacagaaatctatgttaacctacagttacacaattcttaggcctgcgaaacactattttagtatgacattataaggacattcaaactcctttttgccatttcaaattttggtcaatttttctaattagttataagactaaacccaaagtattatttatcttagaaaaagattaaacagggatatgattctagtatataagtatcaatttcctgcctaaacttataataggtactaggtctgtccataattatgttttcataatgtttcattaaggaaaatagagggatattcaggaaaacactatcaatttccaagatgatactatagagggcaaccatttaataagtacttatatgggccatgtaccatgttaagtgctttatgtacattttagtttaattagtaaacaatcgtgtgaggtacgtattattatccccattttgaaaatcaagtaaatgagtctcagtgaggttaaataatttagtcaaggttatgcagccagcatgagtcagaattgaaattcagtcttattctgagttttatattccctcctatgccctgttatactaccaaagtcttaaactctgagaaatttacaagggtgtttctagttaaacgcacgcatgaatgggtttagttttgcttgtgtgatagaacatgtgcaaaatggtcctttttcctttaaccattttgtaactgcctgtgataagcgacctttctgttccctactcactgaatgaaaacatacatgttttaaagaaaaataaaaccattctgtttagctcttggaagcctctgtttctcaaactgttttctttgtaacttatttatctttcttatatctcttctggcccccgatacgcctgtaggtgggctggatcctttccatcctggatgaactgcagctgagccctcagcctcctgtgggggtccttcctctggggactgggaatgacctggctcgaactctcaactggggaggggtaagaactgctctcggggactgcccatatcatcaaacaacaaaccggattccagatccactgatgttctaatggaagaggggggtactgctgctgctgtcccaggcataagttagagttgagaatcaaagtgcccttgagcccttatttgatctggtagcttcttcagtttaaacttaaaatcagctagaagggaaaggaaagcttggtatgagagaaatatagtggttagtacacaggcctgcggctttttgaggtatccactaaaagacagtgggtgagtttggcctcaagtctgcgtgcaaaaggatcatacagacttcagttaatccagactctcagccccagctaggatagcacatctggttcaactttacacaccttacttgggagagttatgactttttttttttagcattttattttgttttgttttgattagtgtcatcagagctttggctgtataggtacttacctgtcctttccacaatgaagccaacttcaggcaagcttgggggaaatcgttctgcagtcactaaacagccatttatttacttacgtatgttatagtactaagatagtaagaaggcgcaatatatatacacacactgtgtatatatacatatgcatacacatatacagccccaccaactttttttttttcttttttgagatgcagtcttgttgtgtcgccaggctaaagtgcagtggtacgatctcagctcagtgcaacctctgcctcccaggttcaagcaattctcctgcctcaaccttctgagtagctgggattacaggtgcccgccaccctgtgcagctaattttttttgtatgtttattagagacagggtttcgccatgttggccaggctggtctcaaactcctgacctcgtgatccaccagcctcagcctcccaaagtgctgggattacaggcttgagttactgcacctggtccccaccaactttttatctgctcatatgagagcattacatgggctgggctctgtgaaaattatattcagatatttagtagatgctagttgacctttgggcaaattaaccttccacaggtctttttttaaagtaggcagtgtagaaataaaaaacgtatttacatggggcaactaaggttatcatcagtgttaacttctcccttccaaatcagagccttgcatatcctattgaggacagtctatcgtgctgtcagtaatggatcttcaaggattaagtagctccctaacagggccattcctcagtgagacttgcttcaggtcacgggaagaatggtgtcttccaaggaggtcagggagaggtgattgagagggagtgttaatagataagcattgtcaatccaatccctccttgattctttccctgcctctccaaacacatttgttttgtgtttcccccaaattcctccagtgagagccatggggagtcctgttttttactctgataacaaagtagccatccagcctccagtatgacccttaatgtgtaccggtgactattggttcttgctgctgacaaaaaatattcctcagctcaaaccagccagaactagtgtttctatgtatcttacttatagtattgtctcaaattctaagtacctcaaggtaaaaaatttgctcttcaaaccttgctaattataaaataaacaatataacggcttggctcttccttgcgtaaaatagcattggcttcactgttctccactctggacagcaatggatatgttctctgattcctcagggctacactgatgaacctgtttctaagatcctgtgtcaagtggaagatgggacagttgtacagctagatcgctggaacctccatgtggaaagaaaccccgacttgcctccagaagaacttgaagatggcgtatgtaaggttagagagttttttgttctgcagaaaggagccctggagcatctgcctgagctacaggaaaaaaaatcctggctggagagtcatgtgctgatgaattcctatgagataatgtgataatatttgagttgatggctactggggctatgtgtataatattaccacctaatgattctgccccatagacctctaaatacctagattccgtacctgcttccaaagctcagggagctcttctctgtcttcaacttctgcactagaaaggcatgtattttgtcttaatcattcatgttaatagcaaataacctatgagaagatgaaaaaatatgtatatttgtaagcattgggcacttgttctttcagtagaaatataacctcctgagatttctggcctgatataaaatatatcttacgttgaagaggtattaactatgccagtgttaccacttgggtgggacttgaagatacctcaataaatgttttgacttcatgttatttaaaaaaaaattgacttttattttagattcaaactgcatatgtgcaagtttgtttcatggatatattatatgatgctgaggtttggggtatgattgatcccatcacccagatagtgagcatgttaaccaacaggttttcaatccttgcccctctccttccctctctactctagtggtccccagtatctattgttgtcatctttatgtccagactttatgttttcttttagtgattgagcttttatttcaaccgaaaagcaaaccaagggatatatgaatagttgtaattagtactgtgagccttcagttggtcctttggttctaaattatggcctcaatttcagataaatttggtaggtttctgagtagccacttccctcatattactttccattttccttctatgattgaatttttaaactctgtatgtgtaagaatctccaggtgtgtttgttaaaatgcagattacaaggcccagtcaccagagattctgattaagtaaatgcaagttaaggcccagacatctgtactttaaatggtatcccaattatagtgaaccatgccatttattgaggctaagattttgtgggtatttccatcttataatagattaagccccatatcattttagatttagatcaaaccaacacccatttattagcatcgtgatcctgatcaatttaattacatatattataatttaatagattttcaagtttctaacttggctaaattagattaaaacatgttttactctgtctttatggttttttcacctaaaccatgatcctgaaattctagtagatttctagtagatatcatgattgctcagctgaattcaagtttataatgtcacaatgttgtttaaacaacaagtgtcatcttgagatacgaagcttttttttaatgtgtttgacttatagaaattggatagaaaacagctaaagtataaagaagagtaccatatggatattgtaagtttcttttcctactaaacttggaatagttagacgtgcaatagaaatccatatttaattctctttccaacagcttaagaaatggaaagacttcttggtgtagccagggaacaccaatccagataattaaagggtttatttaaaatgggtttttaaagagatgtatgggaaactggggcaagttttcctggaaaatataaataacttaaaaacagactaaattgggatatgatttaggtgatggtgaccagatgttctccttagctatcagtagatgttaagacatgggttagaattgtggccaaaagaacataaatggtagaggaggtgaacatgtctgtgcttttggcaggatcaccaacccatgctgtcattactaagaactggtattttgtttaagtgcaggaactggatattctcaaataagaaggctgaagagtaagacatgattttggcattgttctatgtgtttagtttctctctcggtccttcatttagtggagaccatttctaaggctcacttggactctgaatcattacataggctttgaatcaagagcttccatgtggggtcattccttactttcattagagaccaagccaatccaattttcttttttctgcatttatatctgtcttgttccctctcttatttcacttttttcttaatgaaaggaagttctccttctagtgaaacagaaaatcttgctaatcaaggggcatatgaagcactgtaaaaaacatacttttgaaatcttgagggttaaaacacttatctctcagagaagacaggtacagttcaatttgggacacaaaccggataattagctggaaacatttctcgtctttatttactttaatatttaccttccacttgagtcgcagaaggaaaagcgggagaaccagccattcccactctcacattttccgcatgctttcttaattgttctaacatttaactgaagcttaaaatcacattagttttgcagttttaatgcaggatttgaggctgcagagttctcttcattcagcttgcagtggtaacagccagagacccaaaggactctaggaaggaaagttaaagcttccatgtgtatctgtgtggctgtgttttcagatttcatggtcataataaagatataagggttgatagattaaatgagaacttgaataatagtaataggtagttttgttgttgtttttctctctaggccagcaataaccaatgggtcacattgccctattttttatatgacttttgtaaaaaagattgtgtgtgtgtgtgtatatatatatatatatagagagagagagagagagagaaaatgggtgatggataaacaagttaaatattcattttacattacagtattggtttgctgaatataaattcttgaaaaacgcacatccactgattaagttggttagacattatctttacaactggatttactttctaggtttgcttagtgaattcttctctgtaactattgcaaatatatatccttcagcataacaagttcctattattacagcatctataaaaatgattctcatttaataatttgtatttgtgacacatttcttatactatttataattcttgagaaaattacttgattttagctttcactcatgaattaatccaataatttcctgttctttctacataagcaccctccactttgagttgtggctgatctgtctcctagggacttcttcagagataggggtccagctttaggttttattcttctctttctgcctggccacacaaaattttgcctctgtctttgtttatcattgcagctccctctgaatgttttcaataactacttcagccttggatttgatgcccatgtcacactggagttccatgaatccagaggtgaggacaacgtcccatttccatctcccagggaggaagtttctagcaggtgttttgcatgttcccttttgtttgtatatcacttacgcgtttacagtgtgcttcagtgttgtttcattttaaccttcaggatgactctgggagctagacaggacaggaacttcttataaatgggaccctgagacctagttgttcagacaaatgggaccctgagacctagttgtccagggtcttaaagacagtaaagggcaggactagatgtgtgttccaggtcttgggattgttaatctttatgttctactggaagatttgaagtgagtaaaatactaagaagtgatagagactattactgaagtcactaggatattctttagcttcacaaaacactattaaagtgcaatactacacaaccacagccattgaaatatggtagcaaaaacaaaaatgtcccctctgtttgtataaaagaaacaacaggcatcttagaacaatagaggagctataggtagtttaggttgaaagcataggatgtaatggtgatgggattaattaggaaggtactagggatccccactggatgatacagaggtgtgaatgagaccatgtagtgatttcaggtactaaaagagatggagtcaagattaggggaacagaatttttgaaagagaagatgaaataatgatatgctattaaatatttcatcaacattttctcatgccatttagaactgataaagtttatgggtttgacttatgttttgtagtcccgattgatctctctctctctctctttctgtctcattctgtctcttaaactctgttcttattaatatagctatactatatatccatgtctatgcctgtatctatatctgtacctagtgccttctgaatatatataaccagaaccatgctaggatgtagattgttaagagacttgtgagataaagtcataaatgagaagtactttacttttttccctccaggttatgtaagaaaggaagtggtgtttagaatttttgcatactttggaatttgaaataacagagcactaaaagctagaattcagattttcagattctggtaataacatgaaaattctgatcatgcacttatgcactagaagtcaagagtgatgctacaggattaaaaaccactagagtataaaatacaagtaaggaacagatctttaaagtctcttactggatccagcaatgttagcagactttgaccttcctggtttcccaaggttttgagaggacaggctctgtaaaggtcaaattctgtgccaagcaggaatgatgctgtttgaagagaaagccatagtttggtattcctctctgattggccagaaaaatcacagctagaaggcatgattgataacagaacctcaaatatcctgagtcagaaacactaccactttccgcctccctgccttagacagttcttggatattaggtattcagagggacttaccttggggccaacatttatgacctgttacccttcttatatttaaggagagttaatttgggaagtacatgggggattttattcttcatttcttaccccattttttatctcatattctttagcaggatccagatcctgggcttcttaataaaataccccaaacttcttaataatacttgtaaagtaacacaattatcacaaatacatggatttccaaaaataggcatgaaaagaggtctaaatgaataagtggccaacaatgagctcattcaatgagctcaatgagctcaagtgagtctcatatttagtctaacttatccggaagtttttctaatgattcacttccttgaactatgatgaagtttctatgcatcagagtgagaagggagcagggagagacccttacatgggaagaccaggcttagaagaaaattcttttggggaaagtgatttttctcttttattttaagctgtaggactattttagagtggaatatgcaaattgttgagtgtatgaacatgtacatttatatgtatgtgattataaaacaattagttaaagatgtcaagcattaatctttgtatagtttattgctaaggcttattgtgttttgatgcagtatgaaatggaattgtaaacatttcccctgcatgtaaatcagagcctttgaggaaaatcagccactgaagggctgttaagggagaatttatgttaattggaaataataggtaaatattcatgcaggtgggatagaggtggtaaaaaaattaaataactataagatattggaaccagattttgctgatacacttagaccagaggtatggacttttcagtagctgttattctgctttttttaaatagtaaattaaaaaattatttgtctatgaaatatataattaagcaaatagcctttttttctttctttttttttttttttactgtttctgttcatttgtattttccccctatttttaactagttagtcaagaaatcttaagctaagctatagaagaaaaaacaggataagcaagaccagatttttaattgtggcaagcttacttattttgtcagtagatagtgagtggctgttctcaaaccaagaaaactcatagtgagactttaaactgttttccaacacaggcactgtctgcggcttcatggatcacttgccataaaatacctaaagggtaacacaaaggctcatgaaagccattgtgaaaaaaataagcttggatagtagaatctatgaggtattagtcaagaaaatgtaatacttttaagttgagaattatgccaatacatctacataaaaataggcaattaatataaatctcattaaaggagaatttttaaaaatttaactatggaaagaatttttagcacagatgtaaatatagcccatcaaatggacacttctcagcataactacatatattgtatttcttttagaaggaataattaaactggcattaattcccaattttatatctactttattccaaacacaaatcaaactcaaaaacatgtttaattacatttggaagctgcatacatagcttacggaagtcatgccctatgaaagtcaaagtaaataatcgcttctccaccttcttccaccttttcctgttatctcagcccgatatccctggaaaccctccaatttttacaaagcatctagagtgcctccatctttaatgtgcttgagaatcacctggagagctcccctccacagatgtatagactccacactcaagtcattctaattcagtagatctggctagggcctaatcatttgcaattctaacaagctctcagctaatgtcagtgatgccggtttggaactacacatttatagtcctggattactgtccctgtagcactgggctactgtactaactggcctggaactgggggaaagatgataaccaaaccatgggatctattggatctgtaggataggagggagctggggaggaagtaggagtgctaatctaagtcgctacctttagtgaggtctccataacaaaactacttttcctctttcacagaagcaaatccagagaaattcaacagtcgttttcgaaataaaatgttctatgcaggggtaggtatacattttatttcataattactacatattacttattgccaattcactgtgtatcataaagttgcaaactacatgagaaataatcacatatacatctcatttatatatgtctatctatggttactgtttcatggctgggcttaagaatgaaagtgaggtgtatttcttaagttagctgtcagaaagagagttggtgttcctcatctctgagcttttaagcaagccccgaggcttcatgttgaacaagagaagatgctattcaaaaagggatgtgagaaacaaacatcaaagccagtgtaagaaatggaggaattgtgtagactgaggatgtctgaagaattttaggtaagaacgtagttttcaccagggtgcgcacattgacgtttggattagaaactggcagaatatggggtgtttttcatggacgcatacgtgaggttaaagggagtgccttctttttccttcttttgtttctcaggcacgttcatagtagtaaatagagaatgaaaaaaaggcatccaaaatatcagtacagtttaaatttatgccaatcgataggaggagtttaaataaaaggcgtttgggagctgcatacgtagtttatggaagtcaaaccctgtgaaactcagagcaaataaggaaatcttagtggaaagactgtatcagcacttaatggacaaggcaagtgttcagaaaaggttgtcaaaataaaccttccaatgaccctcagaattgtctatttttcactctcattctgtgttcttaaatttatagtgaaactgtaaattatagtttggaaacaaagagaaaaatttcaacttgacaactactgcactgctttactttggattctgcagaaagagaacatgtttagaatttttgcatactttggaatccttggaatctaggatatggaagcaaggatttggtatcaccatgtaattacgaatttcttcttctttatttccctgtggtataggcagctttttctgacttcctacagagaagttctagagatctatccaaacatgttaaagttgttgtaagtattgaatatgttgatttatttaatttgaatatgatatgactgccacaaaaaactcccaaatacttagtttatatattgaatcactggactgcatagaactttggagatcattttgtgtagttcattcaacctacacttattatgtgtcaggcactgtcttagttgctggggatgaagataaatgaaaagactagtttcgctcctgaagaaactcacagttcagttttgaagaaggtcacataagtcacttcagaacaataaaactgttattcaaccgtgtgtataatatggttgtggcacaaagggagaagtgataactctgactatggtggggtcaggaagacctttataaaaaaaaatgatgttagctgggtcttgaagcataaatcggtactctccaaacaagtatctttattccaggataatctgaggaggatatttattccaggataatctccattttagaacgaagtgttgatttcattattttgtggtgactcactctcccacctggtcaaggttcctcaccactagatggattttttgtgtatgtgctgtttcttcctgggtctctatatcaggttgcggaaatatactgcttgggggcaagggagagagaaatttatctttctcaaggtgacacattcaaaaatagaataaaattaggtattaagaaaaacattaatgtttccttatagtaaacaagttaaaagaaggaaggaacatgactttgttgcacatagtcgtataagtaaatgacagaatgagaaagagaaaaaagatatatagatggaaaagaagtgatgagaatatagcaatgtttgaatttatcaatgcttgaatttatcttattctaaagaataagaataattttgatgggccaggcgcggtggctcatgcctgtaatcctagctctttgggaggccgaggcagctggattgcctgagctcaggagttcgagagcagcctgggcaaaatggtgaaatcccatctctatcaaaatacaaaaaattaggcaggcgtggtggcatgtgcctgtagtcccagctactcgggaggctgaggcaggagattgcttgaacctgggaggcagaggttgcagtgagccgagaccgcaccactgcactccagcctgggcgacagagcaacactccgtctaaaaaaaaaaaaaagaaaaagaaaaagattaattttgacaagagagaacagaacaaaatatatacatgaaaatagagaaaaatatatgatcttaagctaatgagatatgaagaaatataaggagcatgaaaatataaaaattaaaatgtgtaatcaccagtaaagcatgtataagacatgaatctcctaaatcagttgaaacaagagacaaaggcctttaccgctgctattagcaacacttggcatccctttcagatgtttcagttctcatacaataaaaatataaagcaagtatcttttagtggtggagacgcttgagactgaaatattgccttcttaaagctagatacaagaacacagggcccattgaactatgaggattattatttcaataaaatcgtggctattaaatttaagtagcagcaaccttacattaaacttcccctgtttcttcagctgcctgcagcctagcaaaaattaaactttactgccctttccagtgtgttttgcatttacaggcgcatccacagtacctgccaggagacccagtgcatgctgggtggtggccatatagaatggcagtgtactgtgcaagtcaccggattgatatcaaactctgtaacttcctaactgctagagagttttctctctcatatctcagtccccttgatgatacatgtctcatgcatgggtgactttatagtagagtctaaaagatgcttgcagagaggccaaaatggcagcaaataactaggaaagatgtgatatcagcctatatatgtaatattaaaggtggaatgtttatataaattatatcttatgaggaggaaaaaaatcattataactaggtgtaaacatttgggatttagttaggtctacctttgctaggtatatgactttggggaaatcatttaacctttcagaggagtttgctttcttcatctgtcaaataggtgtaacaagacatgtctttgatgcaatggtttttgaccattgtgctgtgacatagagagacacaaggatacttttgcaatgacatcattctatgttttcctgagtgtgagatgaaaaggatggaaggttagtgagagtgattagatgtctccccaacaacagagcatcttttctttgtcagagggtgaagtcagtgtttctaatgcaatagctagtaatgtctcatagagatataaaatatgtatttgaatattagactgagaaaatacaaaatgacagtaaaaacctacatatagccattatttgttccactttccatattttcttcttgttatttatcagtatatgagcttatacaaaggaacatattttggatgcaaatatgtccctttgtgtgtatttgaagttgggaaaaagttgaaaactgctattctaaaggaattgcacagtttattgcaataatatataaaaaaatctctgtaaagcagtatacagtgtaaggcccacattttcgtatgatttgatgagttcccagaatcactaacatgtttcccagaaggaaaaagtagaaagttaaaaaatgaattctgttctaaatacaataatatttattataatctttctgcaatgcaaccataatgctttatacactattaatatatcacatcctaggttttaagttttagttgcttataacatgcaattttgacatttacaatgtctacttttttattcattggcatagtcatttataactcatttcaagttcttaagtaagttggaagatgtttgcttagtagttgagagtactagaaaaacatctttaatgtctagaattttattactaagttatatttgaaaataatttgtttatttaaaattgtaagatttcttggaaacaattctttgagaatactcatgaaaattaggctgtatggagatcgactgggaaaaaaaatgcaggtgctggagacaacctgaccactagcaaaatcattatacttagattgaaactgatcctaaagaactctttcagaatttgcagggagcttggggatgctttgctcctctctccaaatgagaaggtaatggggaaatcctgtgataagggtataaggaaagcaaatacgagagcaggctttacgcctttgacatcggaaagtctatagtcatgactagagttattctcttttgacttttgtcaccagtgggaaatgagaaaggaacatgaaagacttttccttgatttatcaaaggatgatacccttgcagaaagcgctagcagatcagggaagccatccatgttcgagggttgttgaggccaagctaggctgagacccttgattcccaggtctaaattccaggaagacagtgaatcttagaagtctaaagtctgaatggccaggcgcagtggctcacgcctataatcccagcactttgtgaggccaaggcgggtggatgacctgaggtcaggagttcaagaccagtctggccaacatggtgaaaccccgtctctactaaaaatacaaaaattagctgggcgtggtggcgggcacctgtaatcccagctacttgggaggctgaggcaggagaatcgcttgaacctggcaggctgaggttgcagtgagctgagatcacgccattgcacttcggcctgggtgagtctgtacaagattaagtttctaagaacaaaccacgaatgaagataatactactgtatgatagatatcttttcaaaagtttgcggtacatagactttttaaaaagtcttcaaaatatttgacatttgcaaaataaaaattgtctcaaaaaacgaagaaaataaatcattatatttgtgacttgtttgaatcagataatgatggtggtgaatactactgctttaacttgaggcttttttcttttcattcttttaagtgttcataaatcttttaatgttgacaccatcagtctagataactaataatcatccattgttaagaatgataatatttcctttgattgtgagaccagagaagaaatcattttaatcaaatggaggttttgttcttaccttaagtgcgaacaaaaccaacctctgtaccctgggtccagtaaagctataaccagaatatatttttaatcactgtgaccggcattcacttaagcagagatagggcaaggagaaagagaccatggtgtgtactattgtcaaactagttatctttcataggtttttagacttgtgactacttcaaaaccccttttctgttttcattgtttcagtgtgatggaacagatctcaccccaaagattcaggaactgaagttccagtgtatagtatttttaaatatacccaggtaggctctgtttgtattgtttccttggtttgacgtgaactctgacttgaggttatctgttttcataacagaaaagtttcagatgtaaacaatgaagatcagttatctaaatgggtaattaaagatttctaggtctgataattcattctccgatttggtttatttagtgttctttgtggttggtggttttgtgcgtcatgtggcatgcattgtctgtacttacccatctttaagaaacccaggcacccctcttgactggaacatcttaatttatttctaaattactgttcttcccctcttcctccccatctaagaatgagagaattgaaacactttttttgttctcagtttcctaaaaactgttgaaaaaccatccagtctgattcaagtgcggaattcattcaaaattgttgccagatgatttctttgaaaaataggatgagttagagtattgttttctagccaggatgtcaactctccatggtgctattacgcacttcaggagaaagggatatttaagataactagactcaaaataaacatattatctcagtggcataaattatgttctaggccctgaagccaagattttggaagggatggatctataaccatttatttgcctgccaaacaactcagacacaaaatctgcaaatacattgtatttagactgaatttaattgaaatgagagttgtatgtaaatctgtggctaggaaaacacatcatagtctcctgattattcttggcagtgctcaatatagtcagttacaattttattccagaaatatttacagcttaattgaagtagaaggccttgattctcagaaagcattgtttattactttgctttattattctttctcttgtccttcctctcttgtccttcttcctctcttgtccttcttctgtcttttcttgcttctccctctttccatctgtattcttcttcctctatttctccaatttcttctgtttcccattctctttctaatctcttatctatatttcatctcttcttcactctgtcttccatagttacctttcccttctcctgtgagtacctcttattttgcttatgtattaatggcaaatgcttcccacttcatttccctgtctcttttctactggcatgcatacatcttcctttaagaccaaattctgaaaccacctatagataattcatgatatatcatagaaaacagacatacatgaatcatagtgagaaatatagataacgaacgaggagaaagttggataccacaggatacttttgttgcaaaattatggcccgttttcacagcttggtattttgtagatgataagaagtgcatttccttttctaatggaaggtgtgtaccaagaatggaaaactgtttttatgtttgataaacattgggtctaactacaaactaacacctcatgatagtcatgagaaggatgggacatatttacttctgtctttaatcttctcttgcagatattgtgctggcacaatgccctggggaaacccaggtgatcaccatgatttcgaacctcagcgtcatgatgatggttatattgaagtcattggatttaccatggcctctttggtgagcaatataactgttttattaaaatgaaatgtattttagtcacagagtttattcaattcacaggactttagttaactttttctcctgctttatcaagttacacattttatgaattatagagttgcttaggaaaaacaagaaaaaaaatcatcatttatgtcactaagaaaactgatgcacatttgtttgaacctcaagaataaatgagtatcacttcttacttttcctgattaattttctaacagaatgaaaagtttttatgctaattaaaaacattacactgggctgggtgcagtggctcatgcctgtaatcccagcactttgggaggccgaggtgggtggatcaactgaggtcaggagttccagaagagcctgaccaacatggtgaaacctgcctctactaaaactacaaaaattagctgggtatgatgtgctgcctgtaattccagctacttgggaggctgatgcaggataattgcttgaacacaggaggcaaaggttgcagtgagctgaaattgtgccactgcactccagcctgggtgacgagtgaaactgcatctcaaaaaaaaaaaaaaaaattacactatagaaacatcccagcattggcacagaagccatagcattttatacttttttggttcactgaggagttttgtgtttaggtaaaaaagagacagtagcaacttgtggatatccgtcttacttatgagtaaaatgatcatctccattatcacaaaatatctgaatatacaaagacatcattattgtgatattagtgcatactcagttgccacaatattgagatcaccttgtattttaattttgtttgcttgcattaaggaaggaaatttatagtgtaagtatattttcaaacaggttttagccatgcattcctgcttattattaaatgatgtgcggaccagttaaaattatgcttatcatttcttgtgtaaatcaggccacactgagtttgtaatgcaaataaaaacaaagcttctgcttgtcacctttggttggcacatgatttgtgctgtaccttatgcataaaagaaagaaggttgtatttctcattctaaacaaatcaaaataggtctctcttttactcatcttatgaattccaaataactctacctcaaattagtgaagtttaacagaaaaatctattgtgcttatggcaagaatcttcatcacctgattttgtgatggcccttgttaactcatctctagaataaaatagttgtcatggtagaaaagattggactggggttgacttactttccagcgttgtaacacaatatagctccttatctccagagctttttatgtttattgcaaatgaagatacaagccaagagcaaataggattaagtttaggaaggatatatgcagggaagaattcttttttttttttttttttttttttttttttttttttttttttttgagacagagtctcactctgttgcccaggctggagtgcagtggagcaatttcggctcactgcaagctctacctcctgggttcacgccattctcctgcctcagcctcccgagtagctgggactacaggcgcccaccaccacgcccggctaatttttttgtatttttagtagagacgagatttcaccatgtttgccaggatggtctcgatctcctgacctcgtggtccacccacctcagcctcccaaagtgctgggattacaggcgtgagccaccgcacccggccagggaagaattcttggaggtgacaaaatcatgcccgtatatgatggaaaaaactctctaaactgtccatacgtgggttacttattctttattcactgatcgagtgaacatttattgagtggttatcatgtgctagagcctcctagttctgactgtggtagaaggctctcagggattgtctgcaagatgacaatcccttacctaggcctggaagtccaaggggaatattcagtatttccccattgctcttaggatcaaaatctctgtccttatttggcctgtaaagttgaggttctgtctggttctctagccttccctgctctcatctttgctttctagctcaagcagctgacaagtgaagcacagcatcggctctcccttgcttcttttgtaccaccaagccattgcacgtgtgctctctctctctgaaatgtacttcaactgtttcttctatgccttctcagactatatctgtgtcttgttcttgttctttttgtagtcttttctggtatgggtgttttttttttctaacaattgtataattagtataatttttattatactaattcgtatatttagtatgataattagaatattacactaattatataggagcaatactgaaactgggtaattagtggagagttgaatggagggctctttcacaaatagtgcactaggtttatgagaaaccaattcttgagctgaagataaaaaggaaaagaagataaaaaggaaaaacagtaccagaaaaagaactacttggaaagggttacgtgataggagtgatatttgcaaagaggaagcaagcaacctgtgctcacctggcagagagcaagccagggacataaatacagcgactgcccacttcaccttgacctctagatcttctgctggtgggtctatctggagaagtctgattggaagccagaagacatgggagccactgatgcagtccaaatagctcagcctcacagagcagaaaagagggcagggaaggctggagaggcagctggggcagcaaatggtgaatatccatcactccactgtgggtggccagtccacaacagggagcctgtggcatgcagttggcaatgcgtgacgtgactgactgaattttaccaggagaagaagaatggaacttggcattctggaaaaaggaaaatttacaaacatttggaagtaggaggaattgtagtgctttgtgggaactataagtagtttcatgtagtttaaatgtaggtgaaaagagagagtgatcacaggtggtgctaaagatgtgggtaagggccagatcatagagtgcatcacagcactgatctaggagcatttactttattcagcattcttgaggagttagtaaaatttttttaaagataaatatttatatgggaaggtttcagtgtaaaaatagacaaaataatacaacaaactcccaagtatcatcactcagcttttataattttcaattcatggacaatcttatatttgtcccacctacaacctcttccattatattattctggagcaaatcctagacattacgtatatacaatatatgtcatatatacatcatatgcatagcatatatatcattttatccatcaataattcgaaatggacttttaaaagatactttcttttataaacacaaccacaataacagtatattatttaaaaaaatgaaaataatagtacctgaatatcactaaatatttactcagagtttgaatttccagttgtctcacaaatatcatttattttcttatgcagtttctttgagtcggaatccagataaaacttacacattgtggttggttgatatgaccttaaactctccgtagtttccccttcaactcttcctcatttatttattgaagaaactggtcatttgtcctgtcaagtttctgagtctgaattttgcagataggatccctgaggcatttattaaaatgtgcttctttcttttttctgtacttgatagctggatctacatacactacatatattttcccccaaatctactttgtaagcagtgttttctttttctaaaaaagaatatataatgtctggctttctttctccttttttaatgttggcagatattgatggtcaatgtctggatgtaggaaacattaagggttgcaaaatagtgatattctaattctcttttttttttttttgagatggagttttgctcttgttgcccaggctggagtgcaatggtgcaatctcggctcactgtaacctctgcctcccgagttcaagcgattctcctgccttagccccccaagtagctgggattacaggcacccgccaccacacctggctaattttgtatttttagtagagatggggtttcaccatgttggtcaggctggtcttgaactcctgacctcaagtgatccacccgcctcggcctctcaaaatgcttgggttacaggcatgagccaccatgcctggcctgatattctaattctatccttctttacctagatagctaggtaaaggataaatgcattaaatgagatagaaaacataaaagagagaatatctcaaaagaaatacactgtgttttatctattttaaattcaaaatctctgtaagacatctaaggaaatatagaaatgggcaatttaaaatatatgtttagagttcaggagatcttttcaggagagattgttttggagagggaggggttctgccagatcctttttattcttctcctatcatttgtaggaaaaagagaaataatcgcagatggtagttggcaaaaaaggaaatggaatactaaaattaggtccattatttttttctcttttcatcatgtgaataaggtaatccatatacatcatcagctagcatcaaatgcatgattgaatctcagattccagtgactctaattgcttccaagaaagagaatgctatctaagaaaagcaaaattaaatggagtttaaactgtatggttttgaacattctatgacctctaaatgtatactggcatatatttctctctttttagacacattttatcttactacttgctactcatatagcagtaaagcattgtatttttttttcattcaggatgaaataatctaatttgcagtcttcaatttcacatttcttgaactactatattgcttatatttctaaggaagtaaattatttgaaaactcaaacatttgtttaagatgattatgtaaacagacaaatatagttatttgggtatatgtgtatatatttttgcatatttaatatagctgctatataattaaaaacataaccagtaggtcaagctttttagaaacaaactatttttcttagaaatttatatgtgtgtagtaattaaaggctataaacttaaaatcatggaatacactaataaatatatttgtacattgcttatgatttcagtgaaatccaaaaaattgaaaattcagaatggcacttttattataagagagctttgaaatagaattactggaatgagaaaaaagactgtttcttttagactctttatcttgtaattgcaaatttcaaagtagaagtcttcaattcattttactggttgaaatgcattcctgctaattaagatgattcttcattgggtgctgggtaatctgattacctttttggagtttacacagaccataatcagacattgtaatttgtatttatttctgccacaattttctgccattattgtttctaaggtcctttcatgttgagtttgtttctaagtaatttaaacttctcaagacgttcaaagcattattcagtcagaggaattgggaacctaatttgccattcagtatgaaatccaaagatttcagtctcgtaaactttaaagaaggcacgtccagctttctttttgttaattgaaataaaactgtgtaagtttctttatagttatgaattaggaaagcaagaggttatccagtgagtaaaaaggacatggagaaattctcagggttgaagttttacacttaccatatatctttgttttaagaaaaaggtaatattaaatgtatgcttattttgataatatacataagaattaaagtaaattatcagttataattttatgactcataaataaataactatatttgatgtgtttctaattgctttatttttacatttttaaaaatacatgaaaccatattataaggaaaacccatactacaaatggctacctacttttttattgtataaatatagcctaatttatgtaataattattttatgcaaagtttcctttatgaagcttttaggtttttgatgttttatattgcagataatcctgtaattaacataattgtttgtaaacctctcttcacatttcaaattattttcttatggcaaatcctaaggaaattacaatgacataagcattttgaagcctcttactaaaaattatagaattattttttagaaatgtcatactgtttacttgcccaagagcggcatatagagttcctggatgagaagtgatttagtagacagagttcctggggccggccgcgactgtggcggtgggggcggtaggagccccgcaaggcgttgggggtcgctgaaggccagccagctgcattccaggtggcacgagggaccgcccttgtgctcagagaagtgatttaaatatccaacagatgttgaaaatgtgttaatggatacagacataaatgatgtttaaatattatacttgatgaaacagggaagagaataaacttccatccctggaaggaagtaaaggaattatatatgttttatacagataaaattctggaacagacaattatgtccttacaaacaacaacatttgagagtaaggataagtttatttttattgttaccattttgttttttttaaaagaagtcaaatgtgtttttttgcatattttaatgggctgtttatcatttattgttgaaatagaagagatatattctggatacaagtcttctgacagatttatttattaaaaataaattctttttgtttatacttttcctttttgtgtttttagtgtttgttttgatgagcatgttttaaacatccaattttatgaaaaaggcttaatttgtattagagctttttgtgtgcttcctaagaaatctttgattactcccagaaagattgggaggccattctcctatattttcttcttgaagatttataattttggcttttatatgtaagtatatgattcagctcaaattaatttttgtgtattgtgtaagatacatattcattcataaaaaatgcatttatccagctttttccagcactatttgttgaataaactttccttttctgtaaaattgctttggtgcttttgcttggtgtctagattctattctgttccattgatttgtttatcctcattgccaataccacactgtcttaattagctgtatggtaacccttgaatctggtaatatgaatcactttattgttctaacagtgttttccttgttctagatctttgggcatttgcatataaatattagaatctgttattatctgcaaaaaattaggattttaattggaattgcatttaagttttagataatttggggaggaattggaatattaacaatatgaatgttccaatccatgaacatggtatatttctccatttatttaggtatttaatatccatcaacaatgttttgtagcttcagtgcaattttcaggtttttgcacaccttttgttaaatttatttctaagtatttttaatgctatcttaaacagtaatttaaattttacatttaattattgctaatatatagaaataactatatgtgtgtctatacatatacaaatacatatttgtttattgaccttgtctcataactttgctaaattgacttattagatccagtagcttgttttttttaatagattccttaggtttttctgcaaccacaattatattgtttgaaatagagttttactgtttccttacatgcctttccatttttattttttatttaaaaaatttttatgccactctagaaaattctttaaaatttctttttcttggatgttcactaagatgttgaataaaaatgataagaatgcacatgtttgtattgttcctgattacatggggaagcattccatatttttcataaaatatgcttaattgtagtttttttttattagtgtcctttatatgatgaaggaatttccatttcattcctactttcctgagagcttttgatcacaaatgagtggtgtattttatcaaaggttttttgtatctgtgaaattgacatacaattttcccctttcttttgtttatatcactaatttcattaatttttaaaaatcttatactgatcttgcatttctaggataagcccctcttaggcttgatttattatcatttttatattgctagatacagtttactaatattttgttaagcatttttgtgattatgattatgagggagagcgataaataaatttcttttcttgcataatttgattgggttttgatataaaggttctactggccttggaatctgagacaagaaatgacattctcttctatttcctgaaagaatttgtgaagactggtactatgatttttttccttatatatttcataaaatttcctaatatactatttggctttgagatttctttaaggcaagtatagatatagaattattcatattatctatttcttcttgagtcaactttattaagttaaatatttcatgaaacttgttcattattttgtctaaattgttgagtttatgtttacaatgctattaatattttactgtttgtaggatcccccctccattctggatacaagtaattttatcaatttacctatctttttctcataatccttcttctctttcttaccttatgctcttttttattttttgatatggagttttgctcttgttgcccagactggagtgcagtggcatgatcttggccactgcaacctctgtctcctaggttcaggtgattctcctgcctcagcctcctgaatagctgggattataggtgcccgccacaagggccggctaatttttgtatttttagtagaggcgaggtttcaccatgttggccaggctggtctcgaactcctgacctctggtgatctgcccaccttggcctcccaaagtgttgggattacaggcgtgagccactgtgcccagcattaccttatactcttacttccatacatctttcacattccatatgagctccacaaatcagcattaatgtatttgctttgaacaattgttacttttaaagaaattaagagatgaaagacaaatagaaagtcctttgttacccacctgtctccctttccagtgctattcactccttcctgttgatccaagtttccatctggcgtcatttttctttaatttcaatgatttcctctaacatttcttatagtgaagttctgttggcaacaaatagttttaaattttatttttctgaaaatgtctttattttatcctcattctttgaattatgtttttgtagatatagaattctgaattctggactgacaggtttgtttttgttcgtcttgctttagctctttaaatagttgttttgttttcttctggcctccatattttataatgaaaagtcagctgtcatttgcatcattatttccttgtatatagtgtgtctttttttctctgttcttgagattttctctttatttgttgtttttttaaaaatcaaaattttaatttatgagtagtaattgtgcatattgatggaatacataatgatgcttcaacacatataatgtacagtgatcaaatcaggataattagcatatcgatcatctcaaacatttgtcatttctttgtgttgggaacatttaatatcctcctcctagttttttgaaactagatattactgtcaactatagtcatcctacagtggtatagaacactaaaatttatttcttctatcttgttttaattttgtatcctttaacaagttttttcctgtccctccctttccttcaccctttctagcctctagtatcctctgttctactttttacttctgtgagatcaacttttcctagcttccacaaattaacgagaatgtgtggtggttaacgttctcttcctatcttattttatttagcataatgttctccagtttcatccatgttgccacaagatttcattctttttaatggctgaataatattccattgtgtatacatactacatttttttttttattttttgttgttggacacctaggcagtttccatatcttggctattggagcagtgctgcaataaacatgggggttacagatgtctcttcaatatactggtttcctttctattggataaatgcccagtagtgcaattgctggatcatatgatacttccatttgttgttttttgaggaacctccatattcctctccatggtgattgtactagtttatctttagttttaaacctctttgtagctgtattactttcttattgctgctgagaacaaatgaccacaacagtggcttaagacaacatacatttattattttaaattcatggagatcagaagtctaaaatgggtttgtaggcctgtgttccctctggagattctatggaagaattagtttccttgtctttttcagctactggaggctgcccacattctttggcttacagtcctgtgccactccagcctgtttctattcttgcattgtcctctctgactttcattctctagaccctaatttttctttataaggaccattgagactacattgggtccactaagacaatccagaataatcttcctatctcaacaaccttagtttacttacacctgaaaaggcccttttgctccatgaggtttgtgtggttcctgggagttagaacatgggcatcatttttggtggttgtagtggtgagcactgttctgcccaccacagtggttttctttgcatttatgctgttttaggtccactggtctccttggacctaaaggtttatttttttccccaacgaactaggaatatttttattcatgtattttatgctcaattctccctttctctgcttctgggatttaattaaatgtattttagattgcttgttattgtctcataggccatgaaatagaataaaacatttctgtctctgtttttcagatacggtaatttctattcatctgtttttatcttcactggcctctttttttctgcagctttcaatttgctcttaagttcactcagcaataattttgtttttttcattttattatggatgatgttttcttgcttctttgcctgtgttgtcctagtggatgatacatcgtatgtgggtctggattgtgtttcgttgtgacttagtgtgtactgtcttagcattacattctacttagttctccacttcctgcttcacaagataaaaaatcagtcttatataagggacgaattctactggaccagtattaaaagatggatagggtatatttcttttgttccagaattatacaaatctattttattccattgctccattatattttattgattctgtcactatactgccagaatattgcagattttagaggaatgattgtccatatagctacctttaaagcatacaaatgatttttttctcaaaccgcatcatgaatacgagtctaaatctcactaacagctatgaaactggacaggtccacaagagtggctttttttttttcctgcttctcataaactcactttggtagtgactagaatctactttcattaaacaaaagtgaaaaaagacacatgtatacaagtaatcccaatgagagttttgagatttttacaagactttttcatagaaaaatttttgacttatagtaagtatgcaataattgctactattttttttaatttgcagaagggaggtttttcaaatgcagttctttctttttcactctctagcagtttagagtggctggacaatatcacatcacttatatagtcaaggaaagaaacagggctctagatgggaggaggtggaatttgagaacatgattatagaattgtaggtacaaggccaggcgcggtggctcacgcctgtaatcccagcactttgggaggccgaggcgggcagatcacgaggtcaggagatcgagaccatcccggctataacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaattgtaggtacaacctagaatcataaaacgctagttctgaaagtgattgtagcagcatactgtaatcactttacatatgaggaaactgaatttatcgaattatttttgctataaatatttattagtgtggacaataattaataccaccactactaatagcatttaggttccctacagcatgttttaccatggagctttaaaacacaccagtgggctgggcgcagtggctcacacctataatcccagcactttgggaggccaaggtgggtggatcacctgaggtcaggagtttcataaaacgctagttctgaaagtgattgtagcagcatactgtaatcactttacatatgaggaaactgaatttatcgaattatttttgctataaatatttattagtgtggacaataattaataccaccactactaatagcatttaggttccctacagcatgttttaccatggagctttaaaacacaccagtgggctgggcgcagtggctcacacctataatcccagcactttgggaggccaaggtgggtggatcacctgaggtcaggagtttgagaccagcctggccaacatggcgaaaccctgtctctactaaaaatacaaaacgaaattagctgcacatggtggcgtgcacctgtagtcccagctactcaggaggctgaggcaggagaattgctttggaggcagaggttgcagtcagccgagatcgtgccactgcactccagcctgggcaacagagtgagactccatctcaaacataaataaataaataaaataataaaaaaaacccagtgcctagaaatgttaattcttgataaaatgaaaaaaatcttaatgatagatgttcctgacagtaaaatagcttgtaaaatgttgtgtcaaaaactatgaattagctgatattggtgccactgcaaattatgtaagtaaaatttctcattttggtgactagctgagtatatcaaagaggaaaataattcaataggagatagatccattgaggctatttagtacaggaggctagttatgggatgctagaagaactgaaaagaggtcaacccatagattagcaattcataaatcgacaactgcaggaagtctctgtcacctctagggctagagggacagcgagagaagatggtgttattagcatcaaggagctcaggctataaaacagagctggaacctgggagaagtggccacctgagaggcctgttgatgggcatggtgggagggtcatacggcagaactagaactctggagaagggaatcgctccaggagagttggagcctcagtgagggctgcctgtctgagttggagccacagggacaggttcgcctggagagagtgcttctcagtaggaaatggaagctcaaaggaattactagctattgccagacactgattgagaaaaagagatgggaagaaatacttactctctcctccctttcagcccactaatatttatatttgtatttttatttcttgttcctttgtgtatgacgtgaggtagaatactgattttatttttctctatatagtgggaaatattcccagcctctttggctaaattatccatcatttctccaataatttataatgccacatcaccgtagttcatgtactcgtatctttgagtctattctgttctgttattcatttccactggctttcactattttaatgactgcatctttaagtattatatatttcggattctaacaggggcagtctgctatccattgcccctgttctttccaactatccttagtaatttgtggatctttatccttcaaaattaattattgaatcatttttataagtatattagtcaagattctccaaagaaacagaacaaaagggagtgtgtgagtgggggagagagattgagatttattttattctcacgtgaattgtgaattggaggctggcaagtcccaatttgcaccaatttgcagggtaggctgacaggctagagacccagggagcagttgatgtttaagctcaagtccaaaggcaggctgaggtcaaattcttcctgttctgggaaggttcttcttttttctttttagagtcttcagcaagttggatgaggcccactcatgtttgctttactcaaagtctactgagttaaatgttaatctcattaaaaaaatactttcatagaagcatctagaatgtttgaccaaatatctggttactgtggcttaggtaagttgacatgaaattaacatgacaacaagattccttaaaatagtatttctattattttaatttgaattacattgaattggtacattaattttggaaaattaacattattagagtattgaattattctgttcatgaatataacatgcctctccatttacttaagtcttcccttacatctttcaataaagttttaaagttttctgcataaaagtctgcatgtactgtttttgttgatattgtaaatggcattttatatcctattgtatttgtttatttaatgctagagtagtagaatactattggttttttaattcaacagtgtatcagccatctttcttatgagttttaacacttggcctgtgaattttcttggaatttttgtgtgtgggatgatatcagtagaaatattagtaagtttgcattttttcttttaattctttttttttctaattttatttctttgtctcattgtgttggtcagtacttccaatattatgttgaaaactttcgttgctgatggataactttgtttcttgaaaggaatgcttctaaatttttttttattgtgaataatatttttttctaggtatcttggtgggtgatctttatcagttacaaaagctactttctgttcttagttttctatgaaattcatttttatcataaaaggcattgaacatctttttttgcttaatcttttgagatgataatgtggtttttctcatttaaataattaatgtactgaaattacaatgatgtattttctgatgttgagtaattcttaatttcttgattcttaacaataaaccataataactttaacttctataaaagagaccactggcagcaattagatgtttttaaatgattttggcattatgatcatgaatataatttaggataaaattttttgttttcttgtactgcttttatctagttttgttaccttaaaagctatagcatcatattttctaaagcatcttgtactaaatagacactgtctttccttaacatttaggtaggacggacttataaaacatctagcctctttgacatttttggggagggggtagtggggcaggtaaaatgaggaacattttttgataactctttcaatttttaaaatagccctaatctatttaatttctgtatttattacaccaaacttcgtaagttatatttttccacgaaatttctttcttatctaggtttttcgatttattgttttcctaaaattcctgcatgattttcagaactctgtattatctctttagctagctccttattttatttatttaattttattttttagatacagggtcttgctctattgccaggctggagtgcagtggcgtgatcatagctcactgcggccttgacctcctgggctcagaagctcctcctccctaagcctcccaactagctgggactacaggcatgcaccaccgtcctcagctgatttttaaattttttgtagagatggagtctgactatgttgccctagctggtcttgaacttctgacctcatgccatcctcccactttggcctcccaaagtgctgggatacagatgtgagacactgcacctggccatttcttatttttaataaagaaaataattttggccaggcacagtggctcacacctgtaatcccagcactttgggaggccgaggcgggaggatcacgaagtcagaagattgagaccatcctggccaacacggtgaaacctgtccctactaaaatacaaaaaattagccgggtgtggtggcacatgcctgtagtcccagctactcagggggctgaggcaggggaatcacttgaacccgggaggtggaggttgcagtgagctgagattgcaccactgcattccagcctggcaacagagtgagactccatctcaaaaaaaaaaaaaaaaaaaaagaaaatagttttatgttttctattcttttttgtttagtcttacaagaggtttgtttaccttgttagtctttaaaacacaagcagatgatctcttgcgcttgatctccatgtcacagattttttccttcgggtactttgttccaggaatgaggctggggctgatagtggcggtgaggaaggaaaggagagtaaggtttgctcttgcttcacccctcccccaacccaggattgcctgttctttccatctgacagcaagtagaatgacttaggcagtaaggaggaggatatgctttgagaggggttgagggaaaatattccagggaagagtgtagtgtgaaaagatagaaaatctcaagacatagctgcagtgcaaaggagagctatggtcttgggtcaataaatggcaatgaatgcattaggtcagggactgtctcagttttcctctcaagtcacagaaaagcaatatctgacgttctcagaagactaacacatgctaggttaaatagacagcgactgtcacgaataaatcaaagtattactaatagtaaatgattcattctagaaagtcttggggctttctattagggctcttagagactatgtcttataagatgctaagcctagaccaatctgagacatgaaaagtatgtatttctaataagttttaaaaaattacttatactctaatttgttccaaaaataatttaatgtgaccgtgctaacaataatggaaatgtctctaccctgaaaagctaattacagtacttcctcttgtctctgtgcaaccatcttggattgattgtgaaatgccggtaggggcggcattgacagttattaactctacctgcttgtaatatttgctgttgttttatttttgagtctgagaagatggcttaaaagtggtctagactactgtgtatgacttcaaataccaagaggttggaaggtgttcaagccattttcagtccggttagactcagcagaataccttcttaccaggcaggttttacattttatctgtcatgaggcctactcaagtctacaaaataaaaagagtaaaatcatatcagataataaggcaaaaagaattttagtaacttctcacatcattctcctctgctttcttgctcaccagtcagttggcgggaggtgtgtaatagactaggaaggggcacgtaggaaccttctgggtgttatacattttccaaactttggtctcgatggaggttcacatgtgtatataaaatatttattaaactgtataataaaatttgtgtgctctatgtatgttatacaacaaaaatgtatgatttttcttttatttcctagaaggataaataatactaaatacattttttttttactaagtcagaagaggttatacaaatgtgttgctccttaatgacagacttttaatattgtcttgaaactccattctgtggctaccatgatgaactgagttctgtctttcattttgatccttaaagctgctttgctttccagagtgttttaaattaagtaattgatgttattttgcattttgttgatcttatacaggttagagatagcttgtggaagtttagataaaaagcaaacacctatttaaacttgaaaagtaacaatgtgctgcatattaaagtattggataaatacaatttagaggttaataaactacctgctttatattcttcatattggttttgttctactttcattggttatttaatgagaatagataacacaaagaaaaagctttgtattaaactaacatgcttaaatttagatttgaaacatataagagcaaaaagtgatagttaataggaatttatggtaaagctcgtcaaaattgtgaatatttggtttatttgcattaatggtttatccaggtttcctactatggtggtggttaattttactaattttagtatgtttatcagagactccttggttatgtacaatggacttgggggtttccagctttcttttccttttttttctttgagatggagtctcgctctattgcccatgctggagtgcagcggcttgacctcggctcactgcaacctctgcctcccaggttcaagcgattatcttgcctcagcctcctaagtagctgggactacaggtgcctgccaccatgcccagcttttttttttttttgtatttttagtagagaccgggtctcgccatgttggccaggctgctctggaactcctgaccaccggtgatccacctgccttggtctcccaaagtgctgggattacaggcatgagccacagcgcctggcctccagctttcttaaataataactaactccttgctcccctttgactcttgtttttataggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgagtgagtctgctcatggcctaccttgcttaacatgaagaccttggagaggagagtgcagagcatgtgcatggtctggggacctcactgtgttgggaagaggaaaaaagtccaggagactcagtagttccttggtttctctcataggaacacatagagtttttttctccttgtttattatacagttccatgcccttcttttagtagttattactgtacatgagatagatgattcttcttcactgaccacttgagaatatatttactgggactagcagaaaatcattgagagggattctaggatggtaaaccgtgttcaggtaaatgcgtttttgtttgttttgttttagggaagcacatagttagcctgctctttacccaggtcgcttggagagtgttggtttctccagtcacgggtggttggcagagctggtcagtggcttgcctctatccacattgcatctctttctgcctgccagtgaattgttcccttcctgatgttcccattttggggtcctccatactctggggcttcaactcagtgttggctttctgggcagcatcctattgtccagacatagcctgacccactctttctacccctgaacacatggtatcccacctggagttttcctttcttaggcattttaataaactgacttgaggtaaggtaatattggctagatatttagaattcatattcatcttatagtgtgtctcactccaactagtgattaagtgtctgtggggttggagaaggggacggaaaatgaacataatttttggcatcttttgagtatttcctctatatcatgctatgtgcttaaggccatttcaggacttagccttttgtcattctctatcacagtgagggactctcaaaggtgctcctcccgtttgtggcctgtaatgcatggttacctatttgcactgagtggctggcttccttgtggtgcctgtaaagcaagggcgtgctttgccatgcatttattgagtcaatataacggtatgcagaagtccttacaatagccagcaacacaggtgccctcattcactaccaacacttactgctctctctctgtggtggcacatgttggttgaggaacaggattagacagtgctctcagagtgttccagcttttggcatctgggtctcagtttgaagctggggtaaaaaatcctgtctgtcctctccttccttctctcccagaatctggacttcccccagaatttttcctagatcattttccagaggtgttttttagttacatgtctttctttgtttacattttgcatttagtgaaactcctcgctcattcctcctgtcctccgtgcctgctgccctccctgcctttaccttctatcaggttaaatacacaattgctgaggttatatgttaaaaaatgtggcatgccagtggttgtatatggttcatccaattccccctagaaatgttagagttaaatggaccaagggtttgctggaaatctatgaactactaagtgaaaaaccatctctgaaactgtgctatagcctatgttgttgggtcacttgtagatagttaagaagatatgcagaatctaaaagtttttactatatataggcagagaactcacagtcttagacctgctgcttctgtatttaataaccttatcagacatgaaatggttttcaggtatttagttttaaacagcttttacctttgtgttgagaattcgtatttgctcagcaaccatattgttaagagttcatttgactttctgcatctatagaagcacataaaaagaatttttttctttttgtactcaaggcacacatgatatatgatggcattttttgtagcacttagctttgcaggtgttcaagaagcagcctcaacttaaaaatactgttactggctgggtacggtggctcacacctgtaatcccagcactttgggaggccaagatggccagatcacttgagaccaggagttcaagaccagcctggtcaacacggcaaaaccccttctctgctataaatacaaaaattagacaggtgtggtggcatgcgcctgtaatcccagctactcaggaggctgtaatcccagctactcataagaatctctaggaccacaaggcagaagtttcatggagccgagatcacaccactgcactccagcctgggcaacagagcgagactctgtctgaaaaaaaaaaaaaaaactcaaacaacaacaacaacacaccccaaaactgttacttactttctaccagaggcagtgatgcctgcatccaagccaccccatgccctctgaaagacttatgagaaatgggaataatagtataattttcattttattaatgaatatttataagacttaaagataacaaaaatctttattagtacttgtgaaaaattatcattcaacactacattttgagaaaatcaatacggatagcacattttcaaaagaaagcaaaaaaacctagtcatcatgtaatgtttgcttactaaaccttaattgctctcattctgatcttatttaccttctaacctatgattaaatatttctttcaattttaccagaaaaccttgttttgaaatctaaggtcttccactagatttccaagtggagtttcaagttcaaggtcagcctttccttcaagactgttctataagtgttcttccaccttctgagtccttcaagcctttgtctgctttgaccatcaattgtgtgaagtgcaccatttgaaacaatgaagaaagagaaacttgaaagacattttctttatttcctgccttcctgtctttgcctgtcttcttttttcctttacttgaggagaactagtcgaaaatatctttagcatttttagcttaaaaacctctgtgtgtgtgtgtgtgttcccagtaagaagaaggtggttgtttaattcatctttaaaaattaggcttctttcacacagcatgttaattggatattcgagacgtaagtgctgtggctcccgtaacaacagttccctttccacttagatgccagtgctccttgtggttctgccctttctctgggagactgtatctctgatctgtgtcttcagcccagaattttcttctaaaaattgaagactcatacccaaatatcttagttgacatttttaccttaatgtctcatagtaacctcaaactacatgctagaaactggactcattaactttatttccttgacttttctaccccaccatccagtgagcctattcccttcacagctgtacacatgaaactaccatccattcatttgtcctgttcctggcctctggggttccctcagtcgcttctacttctatacacctgtgttagtccatttttgcattgctgtaaagaaatacctgaggctggataatttatttatttatatttatttgtttatttattgagacagaggctcactttcttgtccaggctggagtgccatggtgccctcttggctcactgcaacctccgcctcccgggttcaagtgattctcctgcctcagcttcacgagtagctgggacaacaggtgtgcgctaccatgcccagatgtatttttggtagagacagggtttccccatgttgctcaggctggtctcgaagtcctgggctcaagtgatctgcccgcctcagcctcccaaagtgctgggattacaggcgtgagtcactgtgcccagctaaggctggataatttataaagaaaagagttttatttggctcacagttctgtagcctgtacaagcataggaccagcatctgcttcgcttctggtgaggcttcaggaagtttacagtcagggcagaaggtgaatggggagctggcatatcatatggtgggagagagagcaagagagacgggggaggcaccatactcatttaaacaactaattctcacatgaactcagagtgagaactcactcactacctcaaggagggcaccaggtatttatgagggatctgcccccatgacccaaacacctctgaccaggccccacatacaacatcggggattccatttcaacatgagatttggatgggacacacatccaaaccatatcagcatccatcagggtagctactacattctttgaactctatcttctgtttatttcccaagtctttgactctcatctcctctatcttctctaccagtaaagcagccagagttcaaaagtcacgtgagctacctctcagcagcattactaaaatatgcttctgactattttctgttcctgcccttgctgccttcacataatctgtctcttctgatatacccgttagattgatataagaatcccaagcctgtgttccttagctttgcagacctttttgatcactcccttcttcattctctttgctctttgttccagggaagattgctgttcctggaacagtagcctgtctcctacatcatcctggttttgctctctggtcctcttcttgcagtgccctctgcacctctttatcttctgctaactcctcgctcacagcttaggaccccattgaaatgctactattcctaataagccttttctgtctacttctagctgttagatgtacctttacgtgtttcagtggtgctcttggttatttccattacaccacttactaaaaatagtgtaatcattgattcactcctcccttctctgctctgtggggaggccctaggattttcctcttaggatcctcagtgtctgtcatagctcctgagacagtcacatcttgcatcagcgactcacacatgaatccattctataatgctgtctctgctgtgtttctcagaaattgctttctaagataacataaatctaaaattttgtgaatataaaactaatatcaaatgtgttttggtcacattgtcttataagtgaaagatacatatttaataatttcaagctatggtccacatggacagaaggaatttccatgagaaatagttaactaatagggcttcatgatgccactagatcttcatttatgcaaaaggaaaaattaatgttttctaaaaaatatttcttggcttataatcccatttgctattattatacacaaactaaaaagctaggtcccactgtgttcagaagctccttatatatatgggagcatatgtcatttatcatagcataggaatctacacagagtatgaactacagtaaataccttccccacaaaaagtaataagcagatttatctaggttcatattcatatgctagttacctgatagccaatatgctggattatgttctttatttgaaatgtgccattgaaggagaatagaaacaaaattacccaggtgttttgggagatcttcagtgaactattaataaatagataatattatccttagttcactagtaattaaggctacattattaaagatgatcgtttcatccaatgaccaggtttctagtcagcaaactttgaattgagcaatcgaattccatcatcctaggctgctgagaactattattgtttggaaacgatagtacttggaggataacacagacagagagagtcttgggctggagttacctcatgggtgactttgcatgagaagttatgtatgctgcagaacagagagatccgtggaactaggtctaatgtagttataatgaaactctttaaataagagagtggagagaataattatgtaaagtcaacaaaacattttgggtttagtttcttaaattctacattttgtcttttctagcagctgctgtagactccaatataaaagaagggagaaaagggagaaatctgtggtttcatttttctacccagaatgtgggtggaatgatagcaatacagtgatacaattagactttcttggtattacctttggagtttttaaaaagcctttgttgtttaactgaaggaagttgaagttttggttgagacactctttttaagatgattgtcttttggtgagtgttcctataaagcctggggaaacctgatggctgtgtgatgaaagggttaaattgaccttgaatcttttcaaagatgagtttaccatgccagcctaccactcaatatgtaagtgtgtgccttctctccttgggtgtcctgatgggcctgagcaagggaggccatggtcatccccctacaccccccgacctgccgtccagcatcgatcccagcctggccccgctccggtctgtgacttgcctagaaccagcgccttccgtgtgtcctgttggcttcgttgctatcaccggctttttttggattatttccgtggctggcttggttttccttttcctttccttcgctgttcggtgatgcgctcatttaatttctgtttaaattttgtgtgtctctctttctctcccctggcttgttccttgtctgtccacgctgtcgctgactctgtcttcgctgctcattccctgctgcctctagtattcatcaggtgcaaactgcggacctgcggcgagtgtctgctccccccggctccttcaccatgtgagtacagtgccattctgtttctacattttctccccagcctcgtctcctcagggttggactacctgtgtcccttgccttcacaggtctgttcgtcagataaggaagccacctcaccagaattgctttctgttgccctctttgatttgaaatggagctgtgaagtttttcatgttctatgtgcttccatcctctaagttaacagttcaatttttggatgagatactttagggtccatggttgcctggggttgtatagaattccatgctaagcattggtttttatgggaagtgcataataccgttagactatgtcattacttacggctcagagataagctcgaggaagtgcctgcagccctcaatttctggatgaaaccttaagattatgcgtggagttttgagtgtgtgtgtgtgtttctgttttggaagatccatagttacagtaaaagttcaatgaccccaaactgtcactgagttagcaaaatgcatttttatgtatatttaggagtttttgcttaatgtagtccagggtattatttttttctagtgagaacaaaaaaatatgttttttagcatttcagctcagaattattttgtgctgtgtactctgctttgtcctttgttttctccatatcacatatgcttacctagcatttattatgtttcagggactgttacagatactttacatattaattaatttgctctcccaacaacctttggccatatgtggtataattatctcccttctatgcatgaggaatctgatagacagagaggttaagtaacttgcccaaggtcacacagttaataaatcatagagtgggattcagactcaggcagtctggcttcaaagttcatgtttttaacaattcatagtctgctgcctttcgtctgtcaggatcctgtatatttctcaaggcccacttgaatgattacctttccaaagaattcttctttgattcttgctgtcagagttaattacaccctcactggagtttatcattcatgtatctgttgcagttctcaaggtttaatttggtgttaattacattaactctgtgtctgtgtattttacacagtagacttaggctatttgagatgattggcaatatcttaatatgaatcttgtgttcccagccatgttcacagattttaatatgaagtattctgaagccaaacaatgattgattggttttcttggtggaatgagtgcataaaagaatacatgtctaaatagaattgcacaatatctaacatctggtgatatgtatgacaaagcaattcctaaagttcagttatataatctactttcaactctcatcttatggatactaatttacttattatttaaaatatgtatttattcaaaaacctttattttgcacttgctctgtgccagacagtattttatgctctgtgtctagtggtaagcatgacagagcactaccttcctgaagcttacacttgagcagtcaaagaatcaataggaaaatgacattcaattgccaaactgaatgttgtggctggagtaaaattctatattctatataggccagttcaataaatttgagtttaaggagtggctgcatgtgatcattatttttagtggctccgttgattgtgatcaaagaattgagaatgttaacagcagaaatgcatatgatagtcatcttgtttctattatgggttaagttggttgtatttacactttagttgtgtatcttaaattggactgtttatctcttattccatgagtgtgcgtgctacatacagtaaagtaaattgtccatacttgtttctgtagggtgcagcaggctctaagttgtggttaccttaaaacttgaatgttaatttgaaaatattttatatctacatatgatatatattgaatattacatgtcatagattttctacctatagataaaacatttacataataaacattaaatcaggatattattttaaaaatcagttaataaaactatatggaatacagcaaggaatgtggagaaaagtttaagcacaacatgtgcattttgtctttttatgttatggcagtgcggatagccttgatttactcacacactagtgtttgctaatttcagcaatgttgaaaaaaccatggtaacattgctttggtcctgtagaagttaggagccccagtatcgttaagtgagattttatatatttttggcggggaggggaagggggttgctatctaatcagccactctctgctcagaacaactcttttttacagatggtcttttctttgggtgaaccctctctttatgctgctcttgaagcaattgttgcttccttcaagaagcttgaagtgatctttttttttctctctagctttcagaagactttttctccaggaatggagtacatggtggtaacaatgcaatgtatgaattattaggaattgcaacatactactaatgtctgtgtatgtgcaaaatttccagtttattcaaagaaaaatcatgaaattttatgttttgaccatatatgacaacatatgaattgatgaattttaatcaatggtatttactggtctcatccaataggacaaaacaaagcaaatagaatatttctccataaatcttgtatagtgcaagttaatgaattaataaattctttataattgattggcttcataatgaagtaaagtcctcattggaagacacatgtacacactacatttcataaatcatgactagtcatggtaaatgctgtaattgccaactcctattcagctaatgccaaaaaagtataaaactgcaaaatgtgtctttctagaactctcttagcctttagtagctacctctcattaggttctgtttccctcctgctcttcccccatcaaaatgaaataatgtgttccatttacacctaatttattcattgctttcatctttaaacaaacattattgagtgtttacttcagttactcaatgctctgtgggatattggagaagcagagacaagaacattaaggtttcagttgtgttgcctatgacagaattacgaagccatgtgacaagcatccaagtagaggttctggttgttcttccatatgaacgactttgtattgaatgtttattatatttgcttttatttttaatatttaaagttaacatactgtaaaacggacttttctggtgtacagttccataaagtttaagacatatagagattcatataaccaccaccatagtcaggatatagatcagtcagtcaccccaaaagagctgcctcatgatgtattccactgtagtcaaaccctcccatctcccaacctctggcaaccactaatcattatagttttgtgttttcaggaatgctatataaatggaagtatacaatgtgtagtccattgtagatggcttctttgactgaacactacacctttaagatttatccaagttgctgcatgtatcatttatttgttcctttttattgcccagctgtatttcattgtatggatgttttagcttgtttacccactcccccattgaaggatatctgggttattcttccagtttggggcaataatgagtagagttcctataaacattgatgaacaggttttatgtaataagctttatgtctctaggttaaacatgtaggaatgggattgctgggtcatatggtaagtgtatgttcaccttcgtaagaaactgacaaactgttttccagaatggtcgcaccattttgcatttctaccagcaatatatgatcattccagttgctccacacccctatcagcacttggtactgttagcatttgggaagcatatgtccaagtcttttgatcattttttaattgggctgtttgttttcttcctgtgaactttgagagttcatcatgtattctgcacccaaggcctttgtgtgctttgcagacattctctcccagtatatatcctgtcttttcattctcttggtgatatcttttgtagagtgaaaccttttgacagaatccagatgatttttttttttctttatagagttgtggttttggtattacgttaaagtactctttgtctaattccaggtgaatattttctcctttgctttctccctaaagttttataggttttctattttgcatttagttctgtgatctattttgagttcttttctatgagatgtgccatttagcttgaggttaatgtttttgcatatggatgtccaatgcatttggcaccatttatgaaaaaattatcttttcctattgaattgcctttacaactctaccaaaaatcaattggatatacaaaaagtcatcccttagtatccataggggattttttccagagtcccttttcttagattctagatgctcaactccctcatataaaacgggtatttgcatataacctatgtacatactttcatgtattttaaatcatctctagattgcttataacatccaatacagtacaaatgctatgtaaatagttgttaaatgcattgtttggggaattgtgatgagataaatagtctgtacatgttcggtatagacaaaaccattctatttttctgaatattttcaacctgtggttggttgaatctgcagatgtagaacccacagaaatggagaactgattatacacacacacgcacatgcacacacgtatacgcacacacagacacacagatccagtgtagactctattctgtgccattgacctatggcttatgcctttgccagtgccatattctttctattattgtacctttatagtaactcttaaaatctggttgcattattcttccaaatttattcttcattgtcaacactgttgtggctatttgagttcctttgtctttccatacacatttttagaatcagcttgcctatgtctccaaaaattctactagaaattggatgactggaattatattgagtctatagatcaacttggggaatgttgatatctttactgtgttgagactctcagttcataaattctctgtgtctcttcatttattttatttgtccatcatttcttggtagttttttgcataaagattttatacctattttgttagatttgtgcctaagtagttcatgtttttggagccattgtaaatgttttttttttttttttttttttttttgggggggtttttaaaatgtttgtttccaattgctcattgttagtatatagaaatactatggatttttttttccttttgatacagggtctcactctgtcacccaggctggagtgcagtggtgcgatttcagctcactgaaacctctgcctcctgggttcaagtgatcttcccacctcagcctcctgagtagctggggactacaggcacatggtaccatgcctagctaacttttgaagtagtgtggagttttatatgttgaccttgtatcctattggccttactaaattcattttttagttctaggagtttggtagcatcctcaggattttctacatagtccagcatgtctgtgaataaggatacttttattcctttctctctcatccttatgccttttctttcttttgcattgttgtcctggctaggatttagagtacaatgttgaataagagtgatgagagtttcccttcttgctttctttctgatattagggagaaatcattctgtctttcaccattagattgattattagttgtagaatttttgttgaagtgttttgtcagcatatctggaaaagattagggtattatttgttctttatatgtttgttagaatttaccaatgaaactctcagagccacaagattttttcctctttcttaagctataaattcaatctctttaggagttgtaggactactcaggttatctatttcaccgtgaatgagttttagttgtcttatagttgctcgaagtatttgaggaattggtccatttcatctaaaatgttaactaatgtatgtagagttgttgtatttctttctctctttcatgtctgtgaggtctgcagtacaagtcctcttttattcctgatattagtaacctgtatctttttcttctttgtcaatcttggtagagatctatccattttattggcttttttgaagaattggcttttgttttactaactttcttggttgtttttcaatttgcaattttattgattcctgccctttattatttccttccttctgcttgatttgggtttattttgctctttttttcccatttttttctaaagtggaatcttttatttatttgcttcagtatgcaattgactcaagttcaggccacaagttttgactaatcttctaagggttgtggttacaacgttagttttattaccaaagtctttgcattgctattcttatctgtctggcttatgcatgactaagttgccagtatgggatctgggtggagttctaccctgtagttcagttcccaaagtctatggtctggtgtttagggctagattcatgtatttacagcctagagataaacacccaagagttcatgaacatctttatggagttgttttctgagttccttcctttctgctgtcatccctggtactttctggtctcttggggcttcctttgtttggtccttgtgccagaaagctaagggtttagttacctcactctgctgcatactgcctgtaactgtgttcatgtccagggccaaccaatgataacagaaagaaaaagaagcaatgatagtttctgccactctcttggcgtcacagctcttgtgattagagaggaagcccctcttccctcctaattttaggtgccagaaggctttgtcattgcggctgccagaaatagtgaaaaggcctgagtagtgtagtgggagaaaatggaggggggaaaaaagaaagggagatccttttccatttctttcggcattcagagtcccttcttttcttagagctggagcacaagcattttgccagagctctttctctctgctcctggtgtccccttttgggctttatgctgcctggagtccaggctggggcttattggagagagagggattggggagtttactaccaatttgatagtatcttaaaatctgatgttcttcaccaatctactgctatcgtttacttttcaaagttctcaaatagctgctttatgaaacctgtccacattgtatagccgcatgcagtggggaagaaataatgctgtgtgctgacccaccttcaccaggataagatctcccctgttttttgaagcagagaactatcggactgcatttcttcttgcccactgcagtgactcagcgagtgtcatagctaaattcagcaaaacaactctgcagagacaccagtgtattttgaattacaactaacatatgttaagtgtaatataccatcttgcacagcagttgcaatttaaacataaacaggatatatcccactgctaaattgtgtgggtctgcttattaccttgggaaaagcaaagttagaaaccgatccatgaagaaagtatgaattgtcatatttgaccactgaatatgactcagcattccaaaattccttgtgataaatgaagacttcttggtaaggatgaaagtaaattgatttttgttccaggaagaaagggaattttattaaaagcaagggaaatattttcgatatattaaaattttttatggttctgttttaggttgagtttaagaattttatttttataaaactaccaagacagagcaaagaacctttgatcttcacaattgaagaaaacataaattagccatagatggctaaatgtttgcatgcctctggccagagaagtaaactagaagatcttttgaaaagctttctaaaattctgtaattctattctacaactagtcacatcaaaacttttgttctaacatttacttgagtttgtataattatattatgaaaggtctctttattctgtttacttagttgtggtcctacaattagaaaataagacttgatttgtgttattcagaaccctctttcctttcctttcctctctttataaactctgccacaccttaactctttaaggaagtaacaaaaatgataccaaagtggaaatttacatgcatgcctttgtaaactataaggcttacctctaaagcagctgagatgatccatcagatatggtttgcctcaatgaattaagctgctggtggctaatacacaaccttcctgagagtctgagaatgaatcgcactcatgggccagtggagcctccagaaatgtgcttcatgtctggggcagaaatctgtccagattctgattcgtggattataatttttgaatcatacctcctggacccaaaaaccaatttcgagggtaccaaaacagcctaagtacttcaacttgtgtgattaggtttgttggtcatgcttttgttattattattattgtatttctaggtgattatctctgaattgtaggattatcgataatttttttttatttctgtattttctgatggatttccatgaatggggagtacttctaaaaagggaaaaaaagcagaacatttcatatttttggaagaacaggagagaattgctacattcgtagaatttaaaggcatgctatttgctgaatcttaaggtcggatagtgaagtgtaagagttagcttcaggctacctggaaagcaaagctatttgctctctaaacttctgagcaaaggaagatgctaaactttgcccatcgtctcttcttccttcctctctctcccttggctcctgaatttcttgggtactcttactagtaatttcacttcagactgtgcacagtttcttgactttcagtcataccatcatgtcatcccttctttcctcttgttatgccactcttccctgctagttccataaaacagacatctgcaatggacaattccaaagaaaagaaataatggttacttggacttcagctcatgccagtttccacactttatctctcagtttccatgagagcccaggctgcaactcggttaatgttgttttttttttaatttgttttgaattttttaaatgaatttctcccatgagttccctcactctgcctgggcttccattccactctgagaggtctagtgacacaaagaaaaggggcagtggaagcagtccacgggtctgtagccagagcgtcttcctccttattctgcaacccctctttccttatggtaacatccttctgatttgagtatctgggggaaccctgcatttgtctgtgtaacatcagccatgtattaaccttttgcatttcagtttttcagatatttaaaaactgcagttggtccttcgaattcctatcagctttgaagttctgttatggtagaattcaaagcatgatcttagaatcataagaaaatctgccctccaaaaatctgtaacatgaggtggatgagacttgctatgggacaagacagcgttgtccttggttctgagtactgggcaggggggccgggccctgttcttcattggtaagcatagttcatgtctcaccttcctgttagcaagaaccaaagtggatttttacatttagtcagagacataatatgtacctaagcaccttgctctgtgatcaaatttaacaccctactaacttctaaggtcacagttgctactagtctcattccctagatgagaagacagagaacaagaaatggtaggaaacttgcctatgattgcatgctatacattgataaagttgacatcgtagcatttaaggcatttatctctgctgtcaatatcacttctggtcattttcttgtgtgtgcatatatgtatgtatatttatctctattatttatatattttaatccaatcatattatataaacttttaaaagaaacttgattatgaagaataacagttcaattctgagtgttgcaaatgtgtgaatctttggtgtcataggtttatagttcaagtgttgttataataaaatttcagaatgacaaatttcaggtaaaaatagcaccactaagtaatttgaagtcttttagaatcgtaaggagtggcatttgaactgagaaacaggcttatcaggaaatgtcatgctgacatccacagtggaggaatcgttcctgtgttcttatattagtaacagtccacccagagctcggcaatcagtccacttatgtaaaggcgcaatacacttagggccccttccacatttaacattctatcttattgctttcaaatttatttttagaggtgaattatttatgtcctcataggtgtagaaatagtcttaccactcagcacttttcatacagtaaaaggttacttcaaaagtgcagcggatatttactgcgggttttgttgccttgagtgtgcagggaataagggagctcttgcagaagtcagacttgggggtaaaggagaaagtttgcaggaaggtttgggggtagtacatgtgccaggtatgtttggcagggaaaaggagggggaaacatttatgaaatttttaaaaaataaaaataaatttcacaaatagaaatctgactttagagatacaattagtccaacagatacaacacttgttttttagatttttctatgtttttaatagataagtgaaaattagggtctgaatagccagggcggggatatcaaattggcagagattcccaagccagattgaaatttttgaaaattaaaaattagatttctctcattcttccattatatatctttttataaacactagttgtaggattagaacaaaaggagttagttctttttgtgcatctttttagtagatacctgtatgagtttactaggactgccataacaaagtaccacagagtgggtggctaaaacaacagaaatttatttcgttacagttctggaggctgaaagtctgaatgaaggtgtcagcagggttggtttcttctgaagcctgtctccttgtcttgtagatgctgtcttctcatgtcttcatatggtcttccctctttgtctgtgtccaaattccctctttatataaaagacactagtcatgttggattaggctccactctaacaacttcatttaaacttaattacttctgtaaagaccctgtttccaaatacagtcacattctgaagagctatgggttagaacttcaacttaccaatttgggggacagataacttagtacataacagcatcatactggataaatttgattgaattttagttatatttctgtgtcaccctctgaagactaaactttgtgtatattatttatataaatattttagttgtttaaaatatttttttattaaagggtataaagagagctgaagaacattaccctattattcataacagattttccatattaattatatagatacaataaggtgattgacatctctggacccaaattcactttctgtaaaataaagtggttgaacaatatgtactttaaatttttgttcaaatctgaattcctaaagcatgattatagtaaaaacaatctgcagaaatacatgcagactataaacgggaaggaaaaggaatacttttgttagtctttgtgagtaaaatatttatttaaaaatggactccccacccagaaaacaaagcaaaacaaaaaacctaaatatttttggaccgaccattataactgcaatgttattaatggatttactgcattcaggaaggaaaaagagacatttcaacttttactccagtactagaataagaactgacattatcctctgacatatcaacaaagaaacctagatgttcgttttgagcgttccaaacaaataatccaaataatccaattattttggattactttgctgaagtggtaatgaagtgtgaggtgcgtttcatttgtaggagggcttcaatttaattataccaattccactgagttttgctggtctctcataacaccctgaaacacttccatgaaatgaaaagagtacattttaaaaggcataaaaagaaagtactcgttgatgctacatttaattaatccctagaacacatcacattttgtgtcagaaaatgaagttctatacatgattcaccaagttccaaagttatagctcaggtatttgactgaaatagaaatacttttcatcttgggccattataaaaattaagaaaaaagataaataaaataaaatgaaagtaccattggaagaatcacaaatggaaggaaaaggccaaagcctttcagtcttataatatattataaagacctatagttgtatttattttgaaaaagtaatcacttagaccttactgctcttaagaaaggtggctatgtcctctaattgggacgtgattatgtcatttggcttgatgttattttgttgtccaggaaaagtaaaacaagtatgttttcttgagtaaaagctcttgtcttataaatacattggtttgctgcctttaatagagacttgatttactttaatgtggtaagtgaaaggagagaaagaaatggaacaagcaaaggcactccaaattattttcacattctattatgatattatcaataaaaccattattttctttctttttcattgttttctttttagtatttgtagcatcaaaatatctaactattttgtgtttgtttctccttcatccaagtaatttattttatatatttactttcatttttttctgagacagggtctcactctgtggctaggctgaagtgtagtggcactattatagttgattgcaatcttgaactcctgagttcaagtgatcctcccgcctcagcctcctgagtagctaggacaacagttgcatgccaccgtgcttatttatttatttaaaaaaaagtttttagagatgatctcactatgttttcagggtagtctcaaactcctgaattcaagtgatcctcccaaaatgctgaaattacaggtgccactgcacctggccccaactgacccattagtccacccattaaagtatattctagggaactctttttctcaaccttgctatcaaattttgtaaaagttatttttgttgatgaataattgttatattgatataattattgtgtgattcttttaagttctgttctagaaatgtctttattctgtcatttttacaaagacaagaagaatgtttccaagaaataagagcagtttataaaatccctcagtcattggatcaggaattagagaagggaaatgaaaggtttcctcccagttggctaaatgggctgaattgggaaagcgggagggtcaggtttagaggactctcaattattccttcttggatttccgacaagaaaccttgggctggtgggaacacatctgagctactaataggagctgaagttcccaccaactgtagattgatgaacagaaatatggggccatctatatctctttccagagccaaatgtagctccccactgaggattgaggaccttggcaagcaattgtcaacctgtccaggtaaaatattaattacctactaatgaagaaaaacaaacaattctgcaataattttttctctgatactcagattttaggagagtatatacattgtttcataaaatgttttatgtgaagggctaaaaccatttaagaaaatgccttttatgtaatgccgcttattgtcaggtcaatccttactttttatttccattataaaaacaaaacatgctcttcccttgactgagcctgtttcctagaaatgcagatctactaccacacaatctgtagagtagcttttcagtagtaatgcgtcctgtagctcatacattccattctttctatacataattgggttatgtgatttccccattttaagatagcaatatctgttttcacttcatcattgcttcatgaattttggctactgttttttttgatatttttatttataacacattctgaatctttgatttttttttctattggtttgtagatgaaatgtgttcaatatttaaagattatgtgtagtctattttggttaaaatgctgttttaaagttacacatagacactcaaatatcactaattaattcgttaaagtgcttagagttactagagggttagcaactataccagtagttagaagcctagtttcagtgttcttcatggttggtatgaaagaccacaagtgttttcttctgtgaaatgacatttttaaaatacgcaaatcataacacttcatccacacccttttttagcaacgaaagtgaatttatcggttgcaaataagaacaggaaaatacaactgtttgtgattgcaaatcctggggaagatttttagcattttaaataacaattaagtttaagagatccctctgatacatagaaactgaaagctgaagcagaaaatgtctgtcttcctgaacacatgagatctaaatccattttgatggcttaagagtatcattgtcctcttatgtctcattggttcaagcccaactgctccttgctccactaagtatagtgatgaatggtcctccctccaactgacagtaaaagaattctccatgctgtgagaattccatttagtaccattgattgcaggctatggtattaaaagtaactcatgttagtgttttgtgatagaatctttaatcatttttaataacaaggaaaccttcattacatggatttacttcttaaagtggaaatgattttggcctgatgtgatgaaagacagggcttgagtttttacttgttcccattccaacagttcttaatttttcttcatctcaacagttggaatttgcagaattcttctatgagaatgcatgttacctctatgtctaatttccatttgtttctatttcctgtggtacttacttctcctttgccttttattaggatatttgtccaagttttatactccttaagcatgaaagaatgtacaaagagtgtatgtgggaacttaaagtctaaaattcctaccttaaaatacttttttaaaggttgtcatctctagttgccagttcaccaatatcagggcagaagacggcatcttcgtaagacttaaatttgcaataatatctagtaatgagtagaaattcttctcttttgtattaagcaggggcaagccagaggctcaactcgatacctgaaggtggtacagcaataatgtaatgcataatcagtgattttatttcttgtttgttgcttttagttatgggagtaggtttttcctttgaaccaaattcttttgagtggtcccattcaggccaatgattctggcctaatcacacatgattaggtgtgatgaagaatgtagtcagatgtcagaaaaaagatgtttttctcatcgcaaatttaggaagtccatatggggatcagtaatttaacacatattgaaaacctcatattaaacatatgtagtgggagatttaaagataactatagttgggcatcctgtccttgaagagctcatgatttaatggggagagcaacattgtcatatcatgattacatttatgttttaaacagtgtgcagtgtgatgaaatttttggatgcatggggcccaattagcctaggtgcaagatgatattaacttggtctaaaggggttttagtggaaggagcaaagaagcatacgtatttgaaagatttagaggaggataaactgcagcagagagaaagaaggagcttctggtaacttagttggcaaaccagaagagtgttttgaactgaattccaaaagtaaagagcttcaggcagcagggagttaaccacagtgtggaaggctactgaaaagtgaagtcaggtgaatttaatatgcatggataaaggaaaaagagaaagtaacaatattgtatagtcttatggagagggaactttgagtttctggggcaatgagttgttcagtggcttaaaaaataaatctgtgactctggtaataaaaagttataacatggccgggtgcagtgactcacacctgtaatcccagcactttgggaggccaaggtgggtggatcacccgaggaggtcaggagtttgagaccagccttatcaacatggtgaaaccccatctctagttaaaatacaaaattaactgggtgtattggcacactcctgtaatccaagctactcaggaggctgaggcaggacaattgcttgaacccaggaggcagaggttgcagagagccgagatcgtgccattgcactccagcctgggtgggcgacaagagcaaaaagtcataacacatgtatgtagggatggatccatgtaaaattccagaattggatcaacgagccagtaacagtgatggcattcactgccacaaaaggaaacaggtggccagaagaatttgaaatatcattcaaggttgttagtatgtctattttcctttaaaacaaaaatgatgaaactgctatacttgttaacctgctctgcaatgccactgagggaagccactgcttgcttgttctatacctttgcttccctttaaataccatgaacacgacactgaacagaaaacacactctagaataaccatgtggtaaattagttatgggagtaagtttttcctttgaacagaattcttttgagtggtccctattctggccaatgattctggcctaatcacacatgaaaaatctatgctcaaaagcatagattttttttattttaaaaagttttgtaagtctgtggagtacaagtgtaattttgttacatgcgtagattacatagtggtgaatcaggccttttagggtatctatcaccaaaatagcatatgttgtacccattaagtaatttctcatcattcacgctcccctaagcacagaaatttattacaaatttccatggaggctttaaaattttaattacaatgtgactttgaagatctccagaaaatttaaaaaataatttctgtttcagccaatgtcataaaaatttattgacatttgatgcttatagtctgtttgcaatatgttagccatcaaggcagcaaatatttctttgatatgcatctagctttggtggttaatgtttgcactcttttgacattagtccatgtgactgattatttttgtaacttaaaagccaattccctaaaaatggtggtagatgggctaataaatagagactgcagagaggaaaatttagactgcagggagaatttgcaaatgattaaggtagcctgaacaaagactaagccacttccattagcatcttactgcttggtgaggatcaagcagagacttagaatagccacttgaagatgcagtcataggggcgtatagaattagatggaatagcaaatactgaattagatgagatcgaagattgcttttgactctataatgcttccatgatgatcttataagaagggctggaagaatagctgcctcaaataatttgtaagctgtaacatatcctattacctcctcacaaatggatgtcttagagactgagaacttactcaacttccatcaaaaaagaattaataacctctgaaggtactttctccaggaaaacatgttgggcagtgggagtgcatgactgattgctgctaatgtgattttggtttatgcttggtttaagaatcaaaaacttctgtacaatgtgtttcagatttccgaggcattatttaattgaagaacaggtagttcagaaaaggtttacttacttttttgatggggacatctaccatttgtaggttcttctgtctttttatttgtgtagattctactggagataaaaagtgggaacataattcaacatggatttatttcctgatccagaggtcaaagaacagaaatggatgaccaaatcagttatgactttttcacaaagggaaaagctgctagaaagcagctcagaaatgctccaatgccaagctgtgctatagcatcagaaccatgtacagttgcagaggaatttgatttccttgcattcatttactcatttgttcaaaaacatttattgtaagcaacatggaccaggcattgttctagctgctggagctgcaaagaggaggaagagattcatagtgtgaattcatagcctttcacactgtgaattcacactataaattcatattttaataaaactctatttataaaacgagccagttcaaatgaattctattagattagttagaaacaaattttattatatctagattatgatcaggtagaattgcttgaaagaagttaaggcaattcattattactattaaatcagggctaaagggtgaaaggcagacagagttatgcttttctgtctcataaaagaaaaacaactctatatgagtagcaaatgcctggttgaattacaattatttataaaaatcaatgtttctacatagtgcgtgttacaaggggcaagccttacactgaactaagaaatgttaatgaaaacaggatatttataaggtacaaaatgtagaatgattacataactttaaggatcttgtctcaacatgagttaagatttatattcataatatctttaaaaagtaaaaaaaaacttgcaaacattcaccatccctacttgcattattgtccaaaagactgtggatagcgacattccactgaatcttgtatccctactgatgttgacggatgcccattctgctaaggtttcctgtctactaagtgctaattagagctgcaactctggcttcagctatgatattattatctaggactgaataaacaatataaggcttatggaaattgcagaagcgctagggcgataataatagtaacaacaactattattatttttgaccacttattatttgccaggaaggtgctaactgccttatatatgtctcatttagtgctcactacatttctattatcagtcccattttcagatcacaaaatggtttaaagaaggtaactttagcgttctgaccatttagattggaactaaattttttgaccatacgtcttgctttatccacttgctatcatgtcttaatattaacggatatcactcctatataattcatgtttccagtgacagaatgagttaatggagtccgtggtttaaaagtgaccctggagaaccaaaacgctcagcccatccactttatccataaagagattaggcctgggtgggagattggatgagaggcgtctcttatcagtccgagaggaatagtgtatactaaagaaattgatcaaaaggaggaagacgtttgagggcactagggaggaatacgactctgatggattgaaattctacatgggaacaattgaaaaagaagctattggcaacatctacaggagagcagagaatagcaagattaagtgtaaattgaatagcagtgagtgttcagggagttgtcttaatggaaagtcagtctacctcccttccaacatctcagggtaaaaggtgtgtataacatggataagggaagctgtggcatggaggttactggaaacccatctgagtgattcaacaagtgctcttattatggttcttgagaaagtgttcatgggagacatttgggaattaagtccagagccacgaacttccattctgcataaggatctcaatcacagtgttgcagagaattggggtagtgacctaaacctgtcggcttagtgagaaggcgacaggtttaggtcactaccccaataggaaagggaattcacagactgctaaatcccttctagggagtttgagatgttccatggaagccgggtttagaacccctgatccagagcctaatcagtatggcagtatcttgtggcagatgttggcaggaaggcaaatttatttttacccaggatgtttgtctcttctttgctctactaacttcccagacaaaatttaaatttagcaaactaatggcagtgctattccccagactccaaagaacagctttgtcatcctctaccttcagtcagccattaatgggacactaatatattttgacataaaggtatgaaattgaattacttggctttcatttaatctctatgcacttcccccgactcccccatgttctagctgtctgttttcatgtttttagttggccttttaaaatactaggtgggagagcacccagaagtgtaaaatgtcatgccaccagccaagctagacaatctccccccagaggtagcccagcaccttgtcagaaatgtttagggaggttccttcatgtgctctaaacattttccaatatctggcagaagcagcaaatgctgttgattattaggtagaaccttatctaggagaacgattttcagaataattattataatgataatagctaaaatctattgagcactgacaatgtgccaggcatttttctaagcatatcacatgtattggctcatttaattctcttaatatgcctatgaggtggatactgatatcatctccactttacctatgaggaaaatgaagcatagagtttcctgattaactaggaactggaagaactttacttcaaatccaggcaatctgacttggagcctgagctcctcaccactttgctgtgttgcctcccatacctgctgtttacaccagggttgcaaatgattcgagaaggtttaccattattgaccctggggtctaatgccctagaatttgctgatgagtctcaactgggacatcttttgataggagtttaaaaaagaaaacagataccccgcccagaagactaggtttaagtaagctgctgctagtgggaaagtggaaactgttgtaggttgttgggaaaagatgggagctaagagcaagagagcaaaagtgtaggaaagtggatgggagaaagtgttaagcggtggttagagtctgatttcttctgtcttgcttagctgatcattctggagatgaactgagatcatatgtgaattcatttgggatctataaagtttgattcaaataatagtgtcttttatgccatggtgtgccccctggaagttagggtggagtagtgggtggccagaggttcaggagacaacagtgcatgggttggaatcagagggcatagatgagaacctgggaggacatggcacagggagcagccactttatgggttttgagaaaggtgatacacactggtaagccccaaattggggagctccaggaaggggagtccaggaactggtcagcagtcattctccaaatctcatttcccatttgcaactactgcccaatcgaggtcttagtcctgatacctccagcccagtagagaagactgaagcccactgccattagatttactatgatctcaaataattgcttaggtagagttcattcaacctctgcccctcctcaacttctcctattagggtctgataggccactacattctatggttccagcttcccttttatctgctgtgtgtgcaggaaaatattttctaattacagtctttgcagatcagttgagtgaacttggaaataaagggattatcagacccctttaatttggggataaaaatctaatgtgaacaccatgtggtcactctgttaattgcgtaaattttttcctccctacttgcatctaattcctaacactctttgctataggccttatttttattcttgtcctgcattattgtttatttacatatggacgtgcttttaaaataactatattaattccttaaaaattatacttgatataaaataatgcccaggtttcaccacacagagataacaacttgcaacagcttgttggacgtgtctccatgcacttctcttgcatgtgcaaactcctgaagtccacaatttatatgaaggagcttatgccatatataattattcatgacttttcttcacttcacagcatgttgtagccacacttccctctaaatgaataaagacctacacattcatttgtactctctgcccagtgttctctggtttacttaaccaccccgcctgatgattgtttattgataaagaaagaaatctgagcagcacacagagatcatcagactctgccaatccagactttatagttttgccgtcaaatccatgggattcttggtatttatccattgacaagagagtctgaactcctcagaggagcagagaaagaacatgaaactgatgagtgaagggtccaaggctttgcgtttagcactgctacttagtggctatgtgaccttaaaatcacttcacctttctgaacttcagtttccctacctgtaaatgatattgtgagttttcagtatattcaaggtctgttctactaactgaaggtctgtatctataaatatactgtcaagctgtatctccaatcacaacttaaatgcttcggctttatttgtccatacctttttgatgtccagcactatggtaatacaaagtaaatacccaacaaacacaatttgagtgatggatcggtatagctgttgaatctgtcttttcaaatttcccccagaaatatccatctctgtagttttatactgatttttttaagccagtgaacctcagacatttttacctgcctaccatctctctttagaatttgtgcatgtatatctacacttttaaatagccacagtttaaatctctctctctgtctgtgtgtgtgtgagagagagagagagagaaagagagagagaatgcaccatgtgtgagtgtgcacatatgtatctatagtttgatatgtatgtgctattttgggtgagtaaagtgggattccatatggagggagttactatactttgcactaaaatgaggctttagacaacagaatgagattatttttttactccctcttccagagttttactgaaattaaatgggtgtgtgtctgtgtctctgtgtgtgtgagtttgaagtgaaggtagagaggggtgtcctaatattgtagacacagtattcccttctttcatgtattctttcttatctttcctgttttccttctttccctccctcattctctcccttcctctctccctccgtctttctctttctttttttctttatttctgtttccttctttccttccttttcctcctttacaggaacaaattaaagaataatgccattctttctactttagtcaatgacgttagtcagtggtgacttttgtcaccatttaatataaaaaaaaagagaagcctctgtatgagaaaattctctcaaccaatgaaatcccagtataaggtcgtattgaaagacaagtaggtattttgttatattaatatattgaagaaatgtattgacccatcgtggtggtgatgaaaaccaaattattccactcaactaatgcccaagattaaaccactttcaaaatatcgcttaagaaaatcaaggagtcgagttacagacatttggggagtgaatagatgttcagaaagtttggtgctgcaccattttattgcttaatatgtgtctggagtcagtatgcattgaattctttcaaaatgagttacgcacttcattctcttcctaaagaaaggacactgtacatatttaaacatttttcttcattttggaatgctcagagccaccattacaagcagtgtttattgcaatatgctttgactgagaggtgctgtcaaaagaggctattgagctgtgtagagctacttcggtctcaaccctgtggcttctggactcttggtctgctttttaaagatagtttttccatctctctgagggtcaggctgcccctgaccatgtcttactgtgatgtgcatatctgcctgtggttcttaaagctccactccacctcccactatttcagatttgctgaatctaatttattatgtaacaagcacatgatcttattaaatgttttaaaaaatcaatagaaaatacgatataaaagtgggctccaaaggctctttttgcatatttctatattcttatgtaaattccagaaacttttggtttctggagaagtgttctccagatcactgttcaattctgataaggaacccacctttctggtttgaatgtgaactcttccttctaaacatgaagagacaatattgcccttattccttcaggtgcatggctaccaattccgctctctcatttgtatctgaccactcggttcttgttttgcagtccccagtctgtcccagatcgtctgaggatccgggtgaacaaaatcagtttacaagactatgaaggattccactatgacaaggagaaactccgagaagcttgtaagttggaagtgcctcattgatttcatgcgatcagcctatcttcagcttcttgatcctccttggtttgatgggtagattcatttatccttgtgcctgaaaatcatggttagagaagtgaagtgaaacacagtaacatgtgggctccaagtgataatgtatgggctacagaaaaaggaactggaaaaggaaagcagctgaataaaatcattctgctgtggatgccaagtcaggatctcttggcttattcgccactttagtctcagatttgcctaaaatgaggaaagcaaaaagttcgtgataccaatggtatagcaccatccagaaaactcttgagacaacacagatctcttcttggaggctgcgttatcaaacactgccctcattcgtcacagagatgtggcaaagaggcacattcagcacttctagatattatgctattatataatgtcagagaagggcctacgggaatgttgtgatattaaagtgattcattgatgatgaggtgccattatttttgaaacctgcacttgagtcgacgtatgaattacttctcaaagtttgtattttctgtatgcttctttgaatacatagctaattgttagttcatctcactagtcaatcagtatgtattggacactttttacaatctggtacattctgatcactgcattaaatctgtctgtataataatttatgaggtaattggttaaaataagccagaagttaagaccatgagagtgttagatattagggttctcggctccttcctaattgtgggggccaatagtcaactgcaataaagtcaaagaagataaggaaaactggtgtccaagggaataggcaatgatgctgatataaagaaatgacttttatatggaaccaaagacttacgaacccagtccccaaatggtctctaagtgtagacctggctacctgtgtaaaagaggaaaatagttagaactggcaggattaatagtaggaaagccttcctgggatggtcttttctgagctctggtttctgagactgatctgaagtaagctttagtggatggaaattctgaggtccaaggataatcccaggggtgggtacagagggttctacaatctggagttgccacgaggtgaggagccatatccctggtagcctaatcactgaatctactagagaatttgctgtgaattttctttcttaattctctcagctgcttcagcttcctaaaccctttatgttgttttccttagacatcaatatcttttaatttctccccagccttctcacttccatactttaccctcatttccttttataggaaagtgtgagctggaggaggagcaattccccaaacctctgaatttcttccttctgtaaacaacatattacattttctaatctaagtgaacttataagcgacagactagcatataatctgtttgatccataaagtgttagacatatatttttgcgatgggaagtgtagctacaatgcaaattaaattgagttctaaaggttactaatcataaagaacagtgttttatgttctttcttgtttgaagcttccaaacaaatagctaacagttcttaaaagaagataacagatctcaaataatattttgcagcttacgatcaactctgaagaaattcaatttggagtggggacacatttgaaatttttagctgaaatgagatttgaagcttatttatagctttcaattatctgttttatcttttctgtggcattatctgtctaccattcctggaggtaattgtggtttgaggttttccaacaagatgacattttctggcaagggctttactcagcatatgtgataaaatttctatgtgaagaaacttcttaagtcaaatatggcataaatgtaagccaaataaattgaacagtgtctttgggaccccaaagaacacatatactctctaaaaggggataaaggagttattctaaagatgtaaaaattcattccaatgatttggatttgaagaaaacaataaaagaattggaattaaaagtgaccaactcaatcattctacttttaatatgcggtgatggtgcttctaactgtggtttttcaggaaagtttatcctttgaggttctggattcactcctactaacctttactcttttgcctggttccaacttgaaacagaatacagattcatgggaaggctgacagggctcaaactgagtataaagacaaaagcaagcttaagtccatatatgaggtgcatgccaaaataaatgttatttcagaagcattaattaagtgaaatttgcacaacacatctagataaaagggactctaggaatgtactctgacctgcatcccagaacaaagagagtgaatcctcttaggtcattcatttattgtcatcaatgactgacctagagcagtagcatggtactgcgtttgaagttagttccatttcttgatggtgtgccaagtgatatcttcaggcagcatgtggttcttttccatcactgtttagcagaatcttgctcattgttcccgttagataacaagctcgcatgtttgtcacctaacaaagcccatcttccgtccataatgcagggctccctgacaataatggatggcagccctttaaattgctttgcttattttagcacagagaaagaggactatactctttcagatatttcccattcctcttccacttagccccatctcactggggggcaatccttctaaaataatatcccggaaaaatttagtccttgtcaatctttccctcagctcttgctggtaaatttcagacttatgtaagacactaaaagtcttcctcactccataggatttatcaaccctcagataatagttgtggtttgcaagaggggacagtctattcaacttaagaggtagaacataaagagaaagtggccatattaaaaaaattaaagcaaatctgtaataatgatatcagaaaatcactctcataaacagaagtatacaagtgggtccttaataaagcttataatcatataatctaggcaaaggatgatctgtttttaaaaatctgttgtatttctaaccccagaagagattcactgacacatgatatattttttaaaaatctgagataacttgatattcccccaaatttaactctgttcccatgcaaactggttaaacttcagtttgagcaccagtttattctgcacttttaaattgccatgataatttacacagatctagggtttaaaacacaagcagtagaaaccagcttgaagccaattgaaaacagatgtagtctataaggatagggaattaacatttgttgtatatcaaatacagtgtttgacaatgcttttacatacatgatctcagtataattcagtattatctggatgtttataacatgtaatgcataatatatcaataaatagggtaaaatcctagtatcgttagtgttaaccaaactaggtatttagttaagcatttgccctaatggaatttccttgtttggtgatttagtagaaaagtcagaaattttggtgtttgaatctcagttgaaaccttgacaaagtcatttaatttctctgatgatcaaatctctcatctgtaaaatgaaaatataattataaccccattcagtgctgagggttaaatgtaatgctgtatatggaacccttggtgtgaagtctggcacattagtgtgctctccaaaaatggtagctatgatgcttgtggtggttgttgttagagaggccctgctgtcatactgctcatcagtcttcaagtccataaaaccagactcaaagtaggtcatagaggctgacttcctctatgtagaactcttcctggcttgaggcagctcacttcaaactgcacacaccaccaccctccaactcactttcttactttcaaaaatagaattgaaaatactggtaaatatcacagaaagattatgggaagaaagtgtaactaaatcattcaatttacttttattgtgtctacttgtgtaaacatctgctgtaatgacaagatacttaaatctatgaagcatgtaaatactgaatgcccatataggatgatctgaacgtttacctgcaaatttccttccttaagtcctaatacattctcttaagtgtgtcatctgttatccaccactgaattttttgcaacaaatttttattttggaataattttagatttacaaaaaagttacaaaggtaatacagggcattcctgtgcattcctcccccagtttttctcattgttaaacactttacattaccatggtgcgtttgtcaaggaaactgatattgctacattactattaactaaacctttggaatttctatcccaggatcaaatctaggataccatattgcattgagttgtcatagctccctagtctcttctgatctgtaaccgtttctcagcgttctttctttttttatctttctttctttctctctctttctctctctttctccctccctcccgccctctctctctccctctttctttccttctttctttctttctctttctttctttctttctttctttctttctttctttctttctttctttctttctttctttttcttttctttctttctttctttctttttcttttctttctttctttctttctttttcttttcttttctttacttttcttttcttttctttttcttatgaccttgatggttttgggggaatactgcttcctgtagaatatcttccaatctggctttgtctgttgttttactcataattacactggatttatgggtttttagaaagaatactgtagaggtgaagtaggctttttgccccatcatgtcaagacttatgtgatatacacatgacatccctggtgatgttaacctgatcatttggtaaaggtggtatttgccaagttccttcaccatagacttacaattttttccccttccctactctattctttaggaataagtcactaagtctaacccactttcaaaatgatcagaggaggtggatcaagattttttaaattgtttccagtttgcatatttgagctcaactgaatttgttaactatgccaaaatggtagagccattcaaccattcatgcattcatactttcaataattacatgtttgcatcagttatatgtcagataccacactagatgttagtcattgaaagatgaaactagaaaatccaacattataacataatttattcagtgtacctttattgagtccttaccgtgagcaggggttggaagaaaaaaaaacaacagaattcgttcctgattttctggagctttttttctttttttaaaaaatgtgataataactgtgatggggctatggaaacattctgtacctatttttctagcaaacgtcatttaaataatgaaagaaagataaaatatataagcaagaatgagaaaatccagtctaaccactaattaagtgtgtgaccttgggcgatgcatttgtcttcttcaggcttctgtttccttatctgttaaatgcagtagttaaactagacatttcttaagaacagattataatataataaatgtttagttttatagaaattacacaggattaaaaaatttttcatcagcatatttccttagtagagtttttaaagctccaacatcattcataatgagtataagcattagaaaccatgtaagtacattgtgcttcaagagtttgctaaaaacactgattttttttccctatcaatagcttcatctaaaattgaatctttccccctcatttaacaagttgacaacagggctgttcagtagagattaggcctccatttggtggaggtaggctttccaagttgaaatctgtctgaggagttaaatgatgtcaatttgtcctctgaagggcattgtccttcctttttgcaagtgtgtttatgtttattcctattttcacgatttgacatttacccagagtttcgtgcttagtttcttttactgtcttttcccatctcttgtctgtctcttatatttatcattttattaaaaatataataataataatggttaacacacatcgtactattgctgtgagctaggaaatgccttttttacatatattgtgtaatttaactcacccgacatctcagtgtgatagatagtactgttattcccatttcacatataaagcaattgaggcacagaaaactcagacagtctaaggggctgacattttgaatacttatttaatcactgtgttttctgcttcctccaagtagtacttcctatttttcatataaatgtctttaataacataagtaaaaatttacatgtcagtctttcacaattccatttcaaatgtcttcttacatttaaactgactttgacttagtttatcacactcaggtttgttggacaagtttctgtttttggatcttcctccaacctcaaatcagccattcataaattcaacaaatattaattgactgcttaccttatttctagtactatttcaagtatttctagtactatttcaagatacagaaaagtgcttgccctggaacttatgttccagtggagagacagacaattgaataaataatacaatatggcagcaagtgctataaaggaaagtaaagcagaacagtgacagaggatcctgtttttgataaggtggtcagcaagagactttctgaagaagtgacatttaaagagagaccagaacaaaaagagtgcatgtatatgtggatttctagaagagtatccctgggcagaggaaatggcaagttccaaggccaagcatccttagtatatttaatgaatgtcagggatgtccatgtgactggaacctgcttagttgaatggagatagtcaggaagttcttttaaagggtcagcacatggagggggcttataggccatggagaaggctttggattttattcaaagtgtaatgagaaggtgttggaactacttgaggagtgtatcatgcctgaatttattctagataaatttggctactaggtagaacattttcaggttgcaatgatggaaatagggcagcaggtaccaggctaatgtgatactccaggtgacaggcaataggaatgagagagttaaagtagtagagttggagagaatcagttggattctggctacattttggaggtaatgctggtaggatgagatgatggattcgctgtattgcataagagtgtaaaattcagttgcctctgatgttttgaccttggcaacttggtaaatagaggtagggaagatgcagaggattcagcaaaggagaccaagaaggagcaataccaaggaggagcctatggttagctacaaaaacagcaggagagcttgttcattggaatcagagagaaaaataactcataaaagctgtctagctgtcagcgtttcagagaagttgagtaagatgcacactaagaattggtagttggattggagtagagggtagttagtggtagcctcacgagattgtggagtgaaaaatgtgaaagtgcatagagaggattcgtgtgcaaatagggtcaagtgaatgtcagatgtgagctgcataatgacatcttgatcaatgatggactgcatatacaacagtggtcccataagattttattttattttattttttttaattcttcagctaaaaccgcggaagaggtgatttattatatggttgttacactcggccacaaataaacacagaaatagtccagaatgtcacaggtccagggcagaggaccaacatgggcattttgttcatgagcaaggtgggtctcagaggtgatcggcgatcagagggcgatgaagttctagatccattgagacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcgcagaggtttccaaaaaaatggcgctaaggccgagagcaagattttaataccatagttttactgcaccttttctatgtttaggtattttagatacccaaatgccattgtgttacaattgcctgcagtattcagtacagtaacatgctgtacaggtttgtagcctaggagctacaggctataccgtatagcctaggtgtgtagtaggtgattccacctaggtttgtgttaagtacactctatgatgttcacacaatgaagaaatcacctaacgacatgtttcttaaaacacatccctttcattaaatgacatatgactataattcaccacagattgctcttttaaggtatttaactataaaactaaggaaagaaatgggatgatgactataaaagaatatagtagaatcaaaggaggattcttttttttaatttgtaagataatacagcaagtgtgtatgctggtgggaccaattcactagagagagaacttgattcagaagagggccaaatgcaggagcagtgccttcgagtaggtggtaagatggaacctggtgagcaatagaaggttgtgggcaggaatgtggggcaggttctcccgagtacagccagagaaggcagaggagggagtacagatacagatagcttggtgtacttggtgctagggagaaacagaagttctattctgattgcttttattttctcaggaaaagaagaagcaagcttactagttgaaagttggaaatggatagtatcagtgttctggaaaaaaagaggaaggtttgaaatagcttgaggagagagacagtgacagggttcggcagaattgctgacctttactttggaaatggatgattgaattcattgtttttttgtaagcacatagagcctgacttgccggtttctggctgtcttggtttatagatgagcctactctatgtctttctaatttcaaaggactctgatacccggggaatattgggccaaaatatgatcttattattaatataaacttttttgccatctaattctgtttatgacctaaaggctttctttctttataagaaaataaaatatgctctggtgctgtgctatattagaagttaataatgttagatttcagacaaagaactgggcctaaaatgatgatgatatttgatccttccttcactgttaaaacttagcctttggcaatgagagcaatcaattgcaggtagatccttaagtctctgcccaaaataatattttctcttttcattggtttattttatgtaacacatactcaaaattatggccaactcttactatttatagaccagcctagtccatttggttgctgtcttaccaggttgacaactctggaatgtaagctcagatggtagttagacttccctttgaagactttcttctaagatctttgtataaaattattactttcattcatcttgctaaggtttgagtagtgcagtgttggccattgcagagtcacaactatcctgtttaataataaataataacatccaatcattgcatagggcttcatggtttacagagggctgttgtatacactggccacatgcatcattacaaggacacttaagattgccttgcacagggttacattgctgtggtgggattttaataagaaattatatattttctctcttaatccagggcactttctagtatacagcctacttctttataaagacaaatttaaaagaatttgcggtcataggtcttgtcatcatttgagtttctggggaaacagactgtgagactgagttttgtgtacaagggttttattgaggatttcccaagacggaaccacagctgtgcagggcaagaaaagtgggaccaggaagagggagatgttgaactttgctgtagtcacaactgaggactcccacagggacctttggacctgggacagccattttgagttttctaaattgaggcaagggttattggacacagatcaggctctgccctggaaggggataaaccttgagtgaggtagcagcctttctggagaaggactcagctgtgcgctatcagcaaacttttagcctctgggaaaatgagtgcctcaatcctaacatgaatgcattgcttcagttccgaaagcagagtcttgctatgtattaataacctgatttttgaactaaggccaagaaagagccacccacataccaaaatccttgagttcattcattcaactcttcatttaacaacgatctattgaacacctactatgtatcaaagactgttctaagtgctggaaattcagcttcagtgagtgctagctctgaagtgtttctcttgttatatcttttaacctgatttccctgctatgccaaattcagggaattggagtacaagttgattattcagaagtgtctgaattagcaaagtaaaatggaaacctaaaaggtgaatgctgacctttccttaaaagttctttctgatgaattattgccaagccaaatattctccatttggaatttgagtaattaaaagtggaaacctgaatataaagccacctcaatttctggctgtcacttctagtctgacgctatagtcagcagagaaaacttcagagtttgattctcaatgggatgtgtattttttatatattcatttcttccttcactgttaaaatgtagcctttgctaataagagcaattcattgattgaactaaacagaatcaagggcggaagtgtaagctaatctgaaaataacatctttgcagattgactcagaaccacaattttatgcactagttacgtggataaaaacttcaggctttccctagttcacactggtggaaaacagtctttctcagtaccgagtgggtttcctgaatcactggtccactgccagtctcctggagtcatctgtaagcagaattagagatgtccccaggctgtcagctgctagggatgtctttgtttgagactgccctatttcacatctcctcatagaagctgtccatgtataatttgtttattcattttatttcccaaaagaggcttggggccccttcagctgattttagaaaatttttctgtcatgaattcttcacatgtatctaatcaactcagaaattccaggctgcatgactgaatgtgtccccagcatctagttgttggtgaccttgaccatcaccctgcagtgtaacagacagcatgatgtagaaattgtgaaagagatttggaccagtgtatctaatcatcatttcaagtattgaagttttaggtatggttgtgaatctttcctttcagacatgtaatatttcatcttgattttcagatgtatctggctagcctggccatgtagccaagattccagtgtcacagtcaagcctttgttatctccctcccaagtacttgagcactggtagtaaatatcagtagtggttctttctgtgtctaagaattttacgaatattcatttccattgtcaagggcatgctaggacctcacagttaaaagcttatatcacatttaacaccaggaataattgccaaaagattatatacatcatcttgttgtactagtactttattgcatgcaacattaggaaccttctttgaaatggaattatcttcatcaaaagtaggcatttacatcattgtcattaaacttacatattcagttggacaaggatgacatgtcatagcactatttggtctggacctttggttcctactatgtattagaagagaagtatgtgggccttctgcccatacttgctcctggataaccacggtcaatgcgtgaaccgcagtcatcagaagtaggaaaaaggccattacgaacagcatccatgattggatctcatgctccacctgacaacttttgtctttgttcagaagaccaggctttaacatctcctttttttttctccctgggattttctttctcatttctgcttttccatttatcatgtcatgaatgccaaagatttggaaagagaaaaagaaaaggatctgttactaactcctgaggggttgtgggctgggcttcgatgggcacctggagagtgtagtgttccctttcattctctttcttctgttctttcttctccagccttcagaattttctttccccaattctgtctataacacattctaactcagaaaccattttcttgtattttaggtgttatcaaactgcctttgaggcattgacaagtggtctttgtcctccatcatcacagttttcactaattttacattattttcacagtctctctgctgccgccttctttgctcttttttgctctctccagctcagcaggccacaagtccatggtgttaggtaagtgtatcagaaggttgtaacccccacagctatgcaaaacgacttcactgtcactcttgctccttttccctcttcccatccaactggccacagaggagttgcttccttggacttcgtatctctctcatatgcccttcccttcttgtctttctgccactcctctattccagacctcaccattgctcagctcattgactgtattcgcttcctcactcatcctccagtcactcacctaatttttcatcaatttgtcttccgtattactcccaatgatttttctaacattttgtccaagaaaaaggtgggagatttttaggcactgagatgagcgagtggaaaagtactggaggatgttgtggggaggttggtcaattgccaacccattgtatctgattattgtcatccatcaagtaagaattgtagttttttgataaccttggcacatttgaaactaacagaataaaaggaaagattccacttgtgtttacatcctcccttaggaatttgtttcttttctctactcccctgcctctcctccttgagttccttatttccaccatccttttgacttcctgagtaatgtgaatgctatgagtaacaaaataggtactgataattgttctatgtcaggatgatctcatcagcaaagtatctgtccatagcaaactcagaacagtttctttttcttttccctttctcttgatttttctgtaactaggcatctgtgtttgctaattgtctcttattaccaataattatttaggctcttacccacccacagagcctgagagagaggggctctgtctttcatgatgtttacatttcaaaaaatgacttctagctcctggagaaagacattcctgggttgtaaaatttggcatgagtctgggagcagatttacatacatctcaaaggggcagagaaaggatttacaatggaaagtttgctaaagtaaatgctctaagaaacaagtgttcagagccatataatcaagaagaaacctgtcggccgggcatggtggctcaagcctgtaatcccagcactttgggaggccgaggtggacagatcacgaggtcaggagatcaagaccatcctggctaacacggtgaaaccctgtctctactaaaaatacaaaaaattagctggacatggtggtgggtgcctgtagtcccagctacgcaggaggctgaggcaggagaaaggagtaaccgggaaggcagagcttgcagtgagccaagattgtgccactgcactccagcctgggcaacagagtgagactccgtctcaaaaaaaaaaaaaaaaaaaaaaaaaagaaacctgtctaaagttccatcatgctaagggaaacatgaaggctgttttggtcagtatacatctggaaccttcaccttctgttggaaacctattagtatctacccatccttttgagaataaagtctcaacttcttagtataaaaatcaaacctctggtcttagcctcaccctactctactctgtacctacctaccttcctaattcctgaacatttccttttcttcttttcatgctgtggttccttagagcctaagggtggtctgagataatttccttttgtctcaaaaactcttgttccttttgtcaaaccaccttattttcttcacagctcctcgtggaagagtgtctggtcttggggaatgtgtagcccttctggattctaaacacgtggagtacatgtctatccaattcctgccacaaagatatcatcagtaggatgttttcatgtactcccctcctcctccaattctgtaaactccttgagggcaggtaccatgtcttactcagccttctgtgaccaactgctgacactagagttgtccccagcaccagaaagtccttaaaacccgtttgctaaaatgattaagtgaatgacttatagacgtgaaaaatattgtggcataattctttgtatatgcaatatatatttaccaaattaatgaagatagaaaccatgagttgctcttcaagattatcaatgccataagcatttaagaggattttttttaagtgagttgcatgttccttatgttgcccacttaggtagtatactatcatgataaaagcagaattggatctgtacttggaaacccaaatttctagagaacctgttagtttctggaaagcactcagaaatcttatccttgaatagaatccaatgaaaactacataatttacttttatcttgtggatgacatttttaatggactatagacaggacctggtttagctcaagctagggaatccaaactctataattacttttaatcgtaaggactaggagttgtgaaactgctgacaggtcccagacatggcatggcaaggtataaagttcttgggatgttatgtttccttttgaatgctaatatgcccattcgttgctccccattggttccaggtgagcagtgggaaattaatgatgaccaggtggttgtaaaatggacctgtgacccacagcagggaaaaactggattgaaataccatattgcaaactgattctatctaattcttatcagccatcaagtaagaattgtagttccatgataaccttggcacatttggaactaatgaggtaaaaagaaagatcccacttgtctttacatcctcccatattatatttcctatagacaaagtatctgtctgtagaaaactcagaacagtttctttttcttttctttttctcttgatttttctgtttctttttaactaagactatttttcagagcagttttaagtttacagaaaaagtaagtagaaagtacagagaattccatatatcctctcaaccctcccctaccgcaacctatccacacacagttctcccctttattaacattttgcattaatgtggttcatttgttactattgatgagccaatactgatacgttattattgcctgaatcccatagtgtacgttaggattcactcttttgccatataattctatgggctttcacaaatgtgtaatgacatgcagtcattattgtattgtacagaatatttcacaaggaataccttgtgttatgtcttttcatttctcccttcctctcccaagcccttggcaaccactgattattttattgtcagcatagtttttgccctttccagaatttcacataattggaattatacatcatgtagcctttcaaattgccatctttcacttagcaatcttcatttaaaatacccctatgtcttgtctttgctttatagctcgtttctttttattgttgaataatactccgttgtctgggcataccacaatttatctgttcacctaccaaaggacatattagttgcttacaagttttggcaattatgaataaaggtgctataaacatccctgtgcagatatttatgtggacataattttcaactccattgggtaaataccaaggagctgatgctagattgcatggtaagagtatatttagttttgtgagaaactgccaagctgtctttcaacgtggctgtgctgttttctatttccaccagcaatgaatgaatgttcctattgctccacatccccaccagcatttggtggtggtggttttttttaattttagccattctattaggtgtgtagtggtatctttgttgtttaatttgcaattctctgatgacagaaaatgttgagcatcttttgatgactgtatttgctgcctatattttctttttgtcagattttgtttagatcttttgcccagttttttaattggctctcttattgttgggttttaagaattctatgtattttttgggtaccagtcttttttttttttttttgcatctcttatggattctttgttgtaggctcctagatgtggattgcagagttacagaacatttaggaatactagtacctactgtcaaagtgcacaaatttacactctgaaacaattgatttcatggcacccttgccagcattgaacattattttttaatcttattttaaaagaagtgaatattctaatttgcttttatttactaagctttccccctgtattcactcacaatttgtatctagggtaattctcctgtttcaagacagaatgaattagatatgacatgaaccaactacaacagcataaatgagatggtttctctgagtattttccattgctcagatctgattattgatctggtgagccttgctgagacaaaggttgagcttctcaatgcacgttctctccaagaggtaggagagtatcataaggagaaggcatcattatgtccatgtgggacaaccagcttccttctgtcctgtggcctcagtcttttcttttcttttcttttttcagaaatttgtgcaaaatttaagatcagttttctttttgttttttcttctatccctcccccatccccccacccccagaaaggccccagtgtgggatgttccccccctttgtctatgtgttctcaatgttcagctcccacctatgagtgagaacatgcggtgtttggttttctgtccttgtgatagtttgcttagaatgatgggataccagtcttttatcagatacgtgttttgcaaagattttcacccagtctgtggctaatttttcattttcttaacactctcttttcacagagtggaagttttgattttaacgaagtctgacttaaccatttttttctttcatggatcatgcttttggtgttgtatctaaaatgtcattgccataccaagcttatctagcttttctcctatgttatttctatgttattttctagggaatgggttttttttaaaaggctattggtttcttaatactatgcataggttgattaaatgataccaagtacttgcataaactctattgattatgttagtaaatctaaaattgatgcttaaggaaatgtcaagtttttaaaatgtgtatatacatagtgttaacaagcttattctaagatgactatattttgatggtttaccatattgttcaatacctttcctattttctgactttttaattctgtgattatatttattgttcttttcagaaggtgataaccttttttaaaaagcctccacaattcatatatatatttaaaacttaaagcccagtctttgcaaacacagtggtttctgagaagcttttctctaaggtatcacacgttcttataatgatcctattgaagatagtttgtttgtgctttgaataggtcaatggcttcatatggctgcaattctattttaacagtaattgcactgtaacagcaatgtcacataattaaatctttttaaaaaaatgctgagctctcagctctttatttccacaatgacatcttgttgaacacatcatggtaccttgcagagaacgaattaactgctgtgagttttctccctttttataaatcccattatcactttcacatggacttagtgtgaaaggtggctctttctgctttggctcttagggccttggcttgtgtcatcaagcaggcagctgtgattcccctcatctccttgtaggtttggttgattcttttatttacatgctttagtttagactctagagactttggcacaacacattatctgctataaaatgttctcacatatagtctgctgaaattggtttgggaatttatgaaagggcagtacatgttgataatagaattaagggtaaaaatgatgaattaaataaggcttagaggagtgaatataggatggtttttataggtaggacttaatcttcacagtaacccagtggggtagataatatgatctttctcagtacattgggcctttacatactatattgtaaaagaaccaaggggaagctaagctcattgagcaataaaaataatcaaaagtatctggaatcgtaattttcctgaatgtagttattgaccaaggataattaaacattaaaatgaatggtatgagaatatgtactatagcaaaactaccaaattgataatatcacaggctagccagactgaaaactaatactgttaagtaaacacaacatcaaaaatccttgggaaacacctttgaatagcttgtgcctctgatgtcatgaacttttcacacctcaagtgagaacgtgggttttgttttatgtttggtttgtgttaactgtcattgaggtcttcagttcagtattggaaattctgttgtaagaattttaatagcaaaacaagtcacagtgattttctgtaataatcttgattaaattctaggtactcttgttatctctattgtcccaataataattagcatctgctcacaattgtatagttgcatttctttgtaaagtaagcaatacttactttaattctgtgacccctaaattacagacaaggttatatagcaaggctgtcagcagttttgataagcttgagtcatggtctataagttcacctgaatctggcctatcggaaaaggagaggaatggggagcctttaaaaatgaccacatttctgccaagtatgttcacgagaatgtgtctgacttcactggtagtttctgagtctgatggttctggtcctttgtccaggcctggagatgtttcctccctgtttacagcctttccctagtgcttgtgaagctctacatatgggactcgtgagtccatcctcagctgctggtcagcctgtcactggtttgtgccttcacttctctgagctcagtgttgaaaactagtagaaactccatccttatgtgcagcccaagttcaatggaaagtaggaatagttcagaacaggggctcttgagtaagagaaacctaggatgaaagctggtgttccgttttagtggttgtaatatttagggcatgttatctatctgagactcattttcctcattttaaaaatagaaataatgacatccatctctcaggattgtggcaaagattaaataacacagtaaaactggtatattatttatgtgaacgtaggttattttttctccttcctccttgccctcccttcccctttctcctcctctccttccttgttcttcctcctcctccatcctcctctctttttcctccattttctcttccttctcctcctttttcatatcatgtaatcagtattatcattttcatgttcatccatatttgttccacccctccctaaatttatcatatgacacaatgctatgcaacatgacacacaattatgtatctttaatatcacatggatttgatcatactcccagatcgcaggcaatggaagtctgttctggcttatctggcttttccagaagtgtggagtatgattcactcacgtaagaaaataaattacttcagctactctgatccttctctcaatgctacttccttgaacccccaggcttaggccctgtattagtccgttttcacactgctgtcaaagacatacctgagactggggaatttacaaaggaaagaggtttaatggagaaccaacagttccacatggctggaaagcctcacaatcatgggggaaggcaagggggagcaagtcacatcttatgtgaatggcgacaggctaagagagggcttgtgcaggcaaactcccatttttaaaaccatcagatcttgtgagacccattcactatcatgagaacagcatgggaaagacctgcccccatgattcattcatctcccaccaggtccctcccacaacatgtgggaattatgggagctacaagatgagatttgggtggggtcacagagccaaaccatatcaggctccaagcagctgtgcccaggaaaagtgatcctagctcaattcagcatctgggagctcatgtagttggcatgtgtgttaacctcagagttccatctgttgtgaattttcattggcctctacgcaattcagcacaaagatgctgtgctaaaggttgtgccagaatgaaatttgctttagacatccctgggtagggcagtttaacctcagagtcggtctacaagggtcttttggctttcttcaacaaataattcacttgaggaaattatttgactgtcttttgcatcataccaactgaatcaagttttcttaaaactctacactgttgatgggaatgtaaattagtatggccaccatggacaacataatggagcctcctcaaaaaaactaaagatagattaaccatatgatccaggagtcccactgctgggtatgtgtaggtacaaaagaaaggaatcagtatatggaagagatatttgaatgcctgagtttattacagcagtattcataatagtcaagatgcagaagcaacctaagtgtctatcaatggatgaatggataaagacaatgtggtatatatacacaatagattattgttatgccataaaaagaataaaattctgtcgtttgcagcaacatggatggaactggaggacaggatgttaagtgaaataatccagacacagaaagacaaatagggcatattctgtctcatatctaggggctaaaaaagtcagtctcctgaaggtagagagtagaatagtgattaccagagacttggaagcgtaggggtaaggggaagtgaagagagtttggtcaatgggtgtgcaaatacaggtagatagaataaataacctttatggttctatagcacaggtgatagtagttaataataatttattgtatatttcaaaatactaggaagagaagattgagactgcttctaacataaagaagtgataaatgcttgaggtgatagattgcttaattaccctggtttgatcattatacattgtatacacatatcaaaatatcacatgtaccccataaacgtgtaaaattattatgtatcaataaaaaattaacttaagaaacaactctaggcacctttcattgtaacctttaacaacattggtttataaagctttgggcaattcagtctcatatatagggtccctgagcttgatttattatctggctgtttacaatttgtggtgaaatctatgttttataaattatattttgttatgttttatcttggtgtatatagactttaaaagttttttatgaatataagagtataattgtggattggttgctagaagattttgaatttgctgaggttgaatagttttcatttatgcattatttggcataaatttgcataataagttcaagtagtctaacttcaagtatagaagacaaaattaattagtgtgacctgtgggcattttacttcaaacgtaaaatccagagcatgcacacgtaaaatgtataatggatttctcaaccaattaatttaatcacagtctggattatgagacatttaaaccaacaggaaatagggaaagagggttaatggaggtcaggttgaagccatagaagggtgctagggcaggacttatattttggctggaaaggggtaatttgtagtataattttctcagggcttaatatcaccagtaaattccacagtgtagttcctattacctgaatttgtcaaagcttcctcgttgttttagtctgctctggctgccgtaacaaaatactatacattggatggcttaaataacagacatttatttctaaaagatctggaggcaggaagtccaagctcaggatgccggcatggttgggtctggtgtgggctctctttcttgcttacagacggctgccttcttgctatatcctcaaatttgtgtgtgttagtccaggttctctagagaaatagaaccaactggatatgtagatatgtaacaggacatctattatgggaattggctcatgcaattatagtggccaagaagtcccacaggataccatctgaaagttggaggaccaggaaagccagtggtgtaaatcagtgcaagcccaaagacctgagaaccaggggagctggtggtatatcttccagtctgagagcctgataactggagtgcaggagtgggtatcactggtgtaagtcctggaaagagaaccaggagccatgatgtcaaagggcaggagaagatggatgtccaaactcaagaagaaagaattcacttttattccacctttttgttctatccaggccccaagcagattggatgacacgatgacacttgcccacattgacaagggtgggtcttctttactcactccactgatacaaatgctaatctcttctggaaacactctcacagacacagccagaaattgtgttttaccagctatctgagtgtcccttagccaagtcaagttgacacataaaattaatcatcacagtgcgtatatacaatacagaggtttaaatattagtagtaaaataggcaccggtgtacctgccacttagactaagaaatagaacaagtaccacccctcactgttctactgggataactactttactcgttgtatttgccattctcttgataggtatatatttaccaccaacgtatgcatccctaaaccagatattgagtggttttgaaaaaactaagtagcagatctaaatccccctgtgtaaagaaaaggtgatgctttcacttttagcttaagtttcccaagaaagctgaaaagagtctctagttcattgttgagcttcagtttttctgagagtgcacacggactcattctaagagaacttagtgggcaaggtaatgactgactcctgggcagtccttggcaggtgttaagttgagttctagctatcaaatgaatatattatcacagggaataggcttctttgaatttttctgcttcactatgatccaactcttgctgtcaggaataggttcaggcagagcatgtcagggggtaatatagtgtcaatatattttatataacactcattcgtattgcaaattcaactttattggggcagataacccagtagcttcttgacagatcatgggtccttcattcaactcttgcacttgtttgattgtttgggttatctgtaaaagtcttagaactttgaaggtcttgtttcattgtcttccttactgtatggttgcctttgagaagttcaaaaacattccaaattttaatcctttgtatataatctggtttttcctttctataagcttgtagattcttccttttgtccccagtactcttcaatttcaaaacaagatgatgttatattgttctgtagttattgtgcttggcatttgatgaatcatttcagtttggaaactaatgttttaggaaatattcttcattttgttttttatatttattctctattttcttttgttttttgagactcgtattatggggatgttttttgaaactcctcttattgggacctcctggactaggtttctaatttttttagtttttctctcctactttctatctctttttatttttgctctacttttttagagattttctcaactttatcttttaacttttctaatgaggtctctatttattttatcaaatttttattttcaaagggttttgtactcttttattctctgaatgaggttcctctttgttttccttcatattctttgtatcatttaatattataatttttccatttcttggaaatttccattccattttctctcaactccctgaggatattaaagatatcatgtttaaagtgtttttctttgcgcaagttcattttctatttttaaaaaaacttttagattcaggggtatatgtgcaggtttattatacaggtaaattttgtgtcacaggtgtttagtgtgcagattatttcaccacctaagtagtaagcatagtaccagataggcaattttttgattgtcacgttccttctctctaccatcaaggaggccctggtgtctagtgttcccttctttgtgtccatgggtacacaaaggtggggaatatttgtgtcctacttataagtgagaatatgtgatacttattaaatcgatttctgttcctgaattagttcgctgagggtaatggcctccagctccatccatgttgctgcaaaggacatgatcgcatttttttttaatggctatgtagtattgcatggtgtatatgtcccacattttctttatcctctctacccttgatgggcatttagattgattccatgtctttgctattgtgactagtgctacagtgaacatacacgtgcatgtgtctttatgttagagtgatttatgttcctttaggtatatacccaatagtgagattgctgggtcaagtgctaattctgtttgagttcttagagtaattgccaaactgctttccacaatggctgcaataatttacattcccattagcagtgtataagcactccgttttctccacaacctcatcagcatctgtcatgttttgactttttaataatagcgatttgactggtgtgagatggcatctcattgtggttttgacttgcatttctctaatgatcagtgatgttgaacttttttttctatgattgattgccggatatatgtcttcttttgaaatatgtctgttcatgtcttttgcccactttttttttttttgtaaatttgtttaagttctttataggtgctggatattacacgtttgtcagatgcattatttgcaaatattttcttccattctgtaggttgtctgtttattctgttgatagtttctcttgctgtgcagaagctcttcagtttaattaggtcttatttgtcagtttttgttgtttttgttgttgttgcaatggcatttggtatctttgtcatgaaaactttgccaagtcttatgtccagaatgatatttcctaggttatcattcagggtttttataggtctaggttttacatttaagtctttaatccatattgagatgatttttgtatatagtataagggaggggtcagtttcagtctctgcatatgactagtcggttattccagcaccatttattgaatagggagtcctcttcccattacttgtttttatcgactttgttgaagatcatatggttgtaggtgtgtggcactatttctgcactctctattctgtttgatttgtctgtgtctgtttttgtaccagtatcatgttgttttggttactgtagccttgtagtatagttttgagtattgtgatgcctccagctttttttttattattattatttccttggctatttgggatttttttggttcatatgatttttaaaatagtttgttctaattctgtgaagaatatcattggtagtttgataggaacagcattgagtctgtaaattgctttgggaggtatggccattttggtgatattgattcttcctatccatgagcatggaatgtttttctatttgtttgtgtcatctctaatttctttgagcagtgttttgtaattgtcattatagagatctttcatctccctggttagctgtattcctaggtattttattttgtttgtggctattgtgaataggattgtgttttttattttgttctcagtttggatgttgttggtgtataggaatgctactgattttttgtacatttattttgtatcctgaaactttactgaagttgtttatcagaaaaaggagattttgggcagagactctagggttctttatgtatagaatcttattgtctgcaaacagatagtttgatttcctctcttcctatttgggtgccttttatttctttctcttgcctgattgctgtggctacaacttccagtactatgttgaatagaagtggtgagagtgagcatctttgtcttgttctgatttttaaggggaatgcttccagattttacccattcagtatgatgttggcttatgggtttatcatagatgactcttattattttgaagcatgttccttcagtgcttagtttgttgagggtttttaacatgaagggatgttgaattttgtcaaaagccctttctacatctgttgagatgatcatgtagttttggtctttagttctatttatatgatgtatcacatttattgattcgtgtatgttgaaccaccttgcatcgcagggataaagcctacttgaccatggtagattagctttctgatgtgttgctggatttggtttgctagtattttgctgaggatttttgcatttatgttaaagaaggattttttttttttttttttttttttttgtctctgccaggttttggtatcaggatggtgctggcctcaccgagtgagttaggaatgagcctctcctcctcagagttttctttctttttttttttttgttaaatagtttcagtaggaatcataccagctcttccttatacatctgctagaatttggctgtgaatttgtctagccctgggctttttctggttggtaggctttttattactgattctgttttggaactcattattggactattcaaggacttaatttcttcccggttcaatcttgggaggatgtgtatttccagaaatttaccaactttttcctgtttttctagcttgtgtgcagagaggtattcatagtagtctttaagggtgttttatatttctgtggggtcagaagtgtcacttctgattgtgtttatttggatcttctctctgtttttctaccattatgtaatgttgttctttgtcttttttgatctgtgatggtttaaagtctattttgtctgaaattatggtagcaacccctgcttttttctgttttctatctgcttggtagatgttttgtgtgtcatcgcatgtgacctgggtctcttgaagacagcataccattgggtcttgtgtcattatctaacttgccattctgtgcctttgaaatggggcatttaacacatttacattcaaagttagcattaatatgtgtggatttgatcctgtcattgtgttgttagctcattactgtgcagatttgtttgtgtgattgctttatagtatcactggtctgggtatttaggcatgtttttgtagtggccagtaatgacctttcctttccatatttagcactcccttcaggacctcttataaggcgggtctggtggtaatgaattctcttagcatttgcttctctgaaaaggatcttatttctcctttgcttttgaagtgtagtttggctaaatatagaattcttggtttgaaattcttttctttaagaatgctgaatataggcccctaatctcttctgtcttgtagggtttctgttctaaggtcagctgttagcctgatggggtttcctttgtaggtgacctgccccttctttctagcttccttaaactttcttcctttcattttttccttggagaatctgatgactgtgtgtcttggtgatgatcttcttgtgtaatatttcacagggtttctcttcatttcctgaatttgaacgttggcctctctaccaaggttggggaaattttcatggatggtgtcctgaaatgtgttttccaagttgcttgctttctctttttctctttcagggatgctgataagtcatagacttggtctctttaaataatcccatatttctcagacattttgttcattcttcttcatttttttttgcttcatatttgtctgagttattctggaggactggtcttcatgctctgagattcctcagctggtcaattctgctgttaataacttgcagttgtattctgaaattcttgagttttttagctctagcatctcaatttagttatttcttaaaatggtcatttcatctttcatctgctgtatcattttattgtattctttagaatttttggattgggtgttaactttctcctgaatctcgatgatcttcattcctgtccatattctgattctatttctgtcatttcagctatttcagactggttaagaaccattgctggggaactagtgcagtcatttggaggtaagaagactctctggctttttgagttgccagagttctcgcgctggttctttttcatctttgtgggctgattttccttcagtctttgaagttgctatcttttagatgtttttttggtttttgtttgctttcattttctttggtgttgttgggtgtttgattatggtataaggtgggtttggtcaactggcttcatttctggaatattttagggggccaatgctcagctcaacactcctgagctgtgtgctttaactctggtgggctcattttgggccccctgctttcatctctggctcctcagggttaggaacctgttgccttgatgggcagtgacagccaaagagcttcactgggtggtggaagtaagatctgtgctcatttgtacatgccagaagcaacagcagtgtgatgacatgcatgctcatcagctggagtggggccctggtgagccaggggcttccagcctccatacaggcatttgcaagtggcagtaatagtgggtgcgatggggcactggcgggtgtggggctggtggtctccatgtgtgcattcacactggaggcaatggcaacatagggcagggagtggggctactgatcttcatttgagtactggtgctaacagtggtggtacagctgggtggatgggggcaggttgcgctcatgctggcagcagtggcacagtgggtcgtagatacgtcccagcagggaagggtaggcaaggtctgctggcacacacacactggcaaaatggtatgggggtggccttggatgagtgcatgccagcaaagtggtacagaggatgctgcagtggtgggagggtgcgggtgggctgatgtgccttggcagaggccactgggctggagctatttgattgtcaggcacagtcagccagcgcaggagctattatgcatgtccctgggagacaccccagttaggcatctgcggctgcactgcaagcaggagatgccagcatacaggggtcactcaggtcagactggccctgctctgttcaggtctgacagtttgcctaaggctaaagtttcctaggggagcatgggacgccttggggatgggtatccctggtcatgcttcactgtggacattgctgcaccaaaccctctgggctccacactggctggagccctgcccttaccacctctctaagcaactatcccttccagcttaagtttctgtgggggtcttgtggtctcctcctgccaggattctataagtccatggtgagagtatgtcattccttccctgctcaactcaccactaccccaggggttactgagggccaggaactgatgaatggtagcccctgcagggtttccagcttcctcccccttaaacccagcatctgtgtcctttctctagccattctcaataccttccttctgaagatctgcttagagtgtgccagtcttcctgatgtcctggtctctcgatggcagatgttccttctggctgtgtctgttcagctatcttgcctggaggatcctgtttattttgatctttggcttctgcattagaaaaatttctcaattttctgatcacttttgcctttctcttcattattaaaagtgggaaacataaaagctgcctggaagttctgagctcatgcataaagcttattgacttcaagcttcgatgtgggggaactgagtgaactgtttcttgggaatgatgaatcagtgctgtctttagacctatggaagaggtgcttcagctttcgatgtcctagatatgtcccatttctggctttgccctgcttcatgggatgatttgtctaaagtgctaaggaaaagggctcatctagggatttctctacccttttctagactgtgctttggattcttagaattcctgccccaacagctccagacctgcttctaggatctgcgtaggcctcttcttctggtctagtctcacaggagtcatgtagagtgggcataggactaaggaaggccctttggggcagcagtttgcatgggctttggagaaagtttggggatgtggtctgtagtatctgtatacataagcacaagttctttcatgttttgaacatccatggagtggaaagagaaggaggtctaactatggaccacaagcactatgttttgttctaatactccttggagtacaagaattatgagtttcagcatctcatttaggtaactacaaaggaatatttatcaggataggaagatagaacatatttcatttaacagttttggggattaacattaaacttataaatatctagaaatatggaatgcaggtctttatgttcttgccttgagccttataaatgttggtagtgggcctgttctcatgttaatatatttcctcatggttttgtcagattccattgagatgagttttccaatgtttttcctagaaagtaaggttctggctgccagcttttggggaattcagggtgggaagaaaactggggatcactgcagtcttcagatgatcaattaatcttcattttctgtaaggtaactgtgcctttccacaatgggtggtggatatctggtgatctaacatccagtgcttctatcttaaccacctcctttaacctcagctcctgaggcacccggtactgccagtttgcaagccttttgagggttttgcagtagaaattattttggttcatgtctatacccactagtggtttaggatttgactctctaagggctctgagtcagttgccaatttttcatctacttcatctgttattttatccttatttttgttgatttcttttaaaaatctatttattgtaggttagtagtatttctggtgagagattaatatgtgcatgaaatatgccatcttattctggaacacagcttgttcttttcacttagttagaacttgtgaattccatttaatccctgcaataaaagttccattgtgaaggttgagtattaactcatgcttcctggacttaaacaaagtctctgctaccaaaataagatgaattgttgagctcagggatagtgacactggtgctcaggtgataagtgctctcactactcctaagtaaaatagaggaaatgtcaaggaagcttggcagttggttaaccatagtgtagaaggaaggtggtaatttttgaaaagtttctgctttttcttcgccatgtaaaggcccaaatggaagtgtcagattacaatatttttctactacgttgtttttttacatggcaggaagagtagaagttagtttttagaaaactggcatataacttacgaaactactgctagctaatccttgtagtactatgctaaattaaaagatagatgattgggtatgtctgttttctggctaaagatgctcaaaagatagtgaaaagagtaagggagaataaaaattgatgttttgataatttatttttaaatatagtgttgtattgagtctttacaaaaatcctgtatgacatctattctaaacaccgtagtctttaaaccaaggctcagaagaattgactaagtagctaagttgagtaatttgcaagaccaaagcaatactgggatttaaacccagcagtggatgactgcaaatcctttctactgcatattgccaccttcttggaataaatttgacagttgttggtaatcgtgttataaaattgtggtagagaatgcccttttttctttcttttctcctcgcaattaacagctaagtattgctcaatcaaaagcagttactcttactttgctccttgaagaacaggcaaagttgttgattttatacccatattagagatgaatgacacatgtttgaaaacttctttttagctattcctcttgattccatatcttgaatatacaatctctaattgtagtttaaaatgtctgctatgaagtacattgaatttatacttggaccagactaactccaaacactgataatagaaggaaatcagaggtgttgatgggattcctgcgtatgtataaaatatatctcctaacttaagtaaatggataaacattgattaaaatctattttctatttttgcacatttaatattaaaaggaaatattaagcaagattccaatgtggatgcttatgttaattatagctatattccacttccagatttattatctatgtcaaaattccaacttttcctcatcattcctcaaatattagaaattctattctgctcttatcttggtggatcaacttatttccatctttatagtaggtctagctgaagatgattactctaatcactatttttaggagatctccttattgaatttcccttccatttcctgcaaagatgcatgattgccatgctgaaaactttttgatgtttctgtttatcttttaaaaggaggagaaatattcttttagaatgattattactcccccaaagatatgacagttacaagtgctccttatcctctactgactgtcttttgcttaccttgtttcttgtctaccctggacaggtgacttgcacctgaaagacagactttctcttttgcatccaaacagtcgttaagcccatcttcctccctctttttatactcatttattgaatatctaccatttctttactaggcattggggaagtgaaggtaaacaatccacactcactcacaggcttccatagttccacaaaatcatggatgccttaaagatttatgtatgcaggactttagaaacataagggaatggggtggtgggattgattaggtctccctagcagaaaccaatctaggaggtaacattgagatacaaactctatttctttttctctagaccacctttactcctctagctaaaacgtcaagtgaggcttcatgttcttcagagagcctaaaatctaccccttcacccaggcaagaattagcccctctttcctatagttttcaaatgactaagttaatacatttaatacggcctgtgttatacttatcatttttttgtttatatatatgccttctctactacgtggagattcttcaaggttttttatgcattttaaatcttcttctgtgtattatgaatttttaaggccctagtactttgtattttcagacagatttatggatgatggctttaaatatacactcaatgagtgaacgattgtaaaaaattcttagagaacaccactgtcttatcatttgcttgctacttaccagttggttaattcaaaattttgaaggttttatgttagatcatggatttaatcgtgtaattgtacttttaaaatgagaaatttgtagatttttttttaagttttggaaagaagactatttttcagtatttcaggactcttgtgattctatctgaagtaggttctatacactaaagccactgtgtgtgtttgacactacctaagtaggatattttataaggtgcataacttagtcttgtcttattgttttctgaggtcctactgttaccactcttacattggccatccttaaaattagttggattttttaagctttgcctcttctagaagctgttttttgttcttttctttctaacattttatgcctttagttctgatattggccaccaggtagcaacagtgccttgagtagctcaagtctcataaataggaaactgttgtagacagacaaaaagatgaagttgtctgcattcaggaaggaaggagtaagtgtccagaatcctcaatgtttaattcccccggcactgcatcctcatgttgtctattgcaaatgcaagcataaatttaggcataagcataaaaaatgcaagcataattatcaactgtccatgagcagcctccctgttctgccaatccatcgttactgcgacaattcacttcatctcagggccagtgaaacacaatgagatgaggggcaggtggcaaggggcaacatggatcatgctaggaaagtgtgtgacaactgcaaacaagaagagactgaaataataaaaaaggtgtagggagaaagtacttctttctttttacggacatatctaaaaaacccataatatttatgagattgttttttaaccacgagaaacacatttatgctgatatagaaaaatcaaatatgttattttagatttttcttcttccttcacccttagcgatacctctgggtattctagttgtgcgtggagactgtgatttggagacttgccgtatgtacatagaccgcctacaggaggtgagtttatttagccaattttttattctcctcaactttccatttttgtaaacaattaccagccatatatatttgcttctgaaatgatgcatttggagaggaagtggaaatgtggtggctttgtccttcaagcatacgctgtatgtcaccctctcccactgtctctgttgttcactcctcagatggttgaaatgggaaagcattgactacagggtgctgttgccctggtgtgttccataactatagcttggaacttgtcattttaccagacacatacctgtatatttgagatgttcagaatttcaacagggactgataaataatgaaagaaaacagtgatatttaatgttttgtgtctgacacttatgtcagagacagctagattttgtaaacaaaaaaataaataaaacttctatgggaaagaaaaatcctctacatctcataggaatttgtcagaacacaaaagaataatctatttttttttctcaatctagtcttgctttagagaaacagaaaggaagtgaccccgtatatggcactcccataaatgtgaactgcaccagcaaagccaggagacccaaactcatcattacaattgttgttggttgtttttgcaaaaatttgagggggagtcttaaccgtctccattccacaaattgcaaaaagcatatatgacgatttctttatcattttttttgatgaaagatgtatattagagtcacttttcttgggtgtggcctagacatttgtatttttaaagctgttgggttgtcttgataccccttgataagcaattctgtcccagacaacatgttatacataggtaaatattgtaaataaagtagacacatactgtttaaaatccctctgagttgtaaccacttcaccctgaatatttgattctgtttctcttggtagaaataaattcaggggagaggcacatagtgatgtgaaaaattactgattttgagaaatagatgacaaatattgaatactgatgtggatgagagaaagatggtcaacaaattttacacttacggcttcattaagctattttgactgaggatagctgcttaaacaagttaaaatacgtgaatttttagtgactcaggtccaattctgttaatatgttcccaaacttctagtatctcatttcccaaaataatgtttgtattttgctgtggaatctcactccagaaacctgtaatgaaaaaaatgaatcataattggtaccaaacctttttacctttttttaaaattaacacatgtagagctttgttaacaagacttcacagtagaataatattaatacacgattgatgaattgactttgttaaaaaccaacttaactaacttaatagcatgcttaatgcaccaatattcaactaaaagtaggatttttaaaaaagaggcaactcaacaaataaagaggaaaaatttttaaaactaatggaaagtaatgtgatgaaaccctgtgggaaacaggtgtaaggacaaaggtacccaggattgctgacatctgtgaatagaatcactacactcattagcaaggaagcctaggaggcatgacaatggtgacaagttcgttataaaactttatgaaaggagtcaggctttcacaatctgccagtaaaacctcattaatttcaaccctgttaatttgcactttgtgataatgtggaggtggttggtgattttctctttgtagtctatgaaaacccctatttgctaagcgacttatcagtataaacagttaccatgacagtatgtatctggtctgaggtaaagaaaagctttctaagtgtttaaagggatttccaaagccttcttcacaagccaaaagtttatatgcacattaaatataatccccatttatcagaacaaaattgcctgtcttttacttctggtctcctctataggagattgaaataataatataacacttactttaaacactatgtaggacttataggtttcaacagcttaatgaccttctctcagtccagcttggtttgattttattatttctggcattaccttctttatttaacctttatgaatttgggtgtgttcgatactttccagatgagcatagtaatattaaattgggagttcagttgagattgagttgtggggcagcttgttcaaactaattttaaggtatggattttttttttcattttctcattaggacctacagtcagtttcttctggctcccagagagttcattaccaggtaacaaataattgactctccttgtttcttaccttctggccaaatgaagtccatctttcaattaatgtcttattttgatttagagttcacatcttccctagggatagagttcattctaagaatctagtgaaaatggtattctgattcttttgcattttcctgattttggaccagcctagtctagcacaaatttagactgtggattttctcctagatcatttagaaaagattataaaattgagtgctttcagtaacaaataccagaaaactcagctgaaactagcttagcaaggaaagggtctcttggttcacataagcaaaaagtccagatcaaggtggatttctcatcccatttggtcatggctcacactccactttcctgctggtccttctactttgttctcctcttcctgtcaattttacctctgggctagatgactttgtggtccaagatgactgccattagcaaccaggactatgtttttttccatcatctcctgaaaaagagaattacatgcttcctacaaccatcaagcaacagttttaaaatgtaatctgagtggttcatcctgggtcttttggacaatctaataaacccagtctgcatctctctatggcccatataaagtctgtaggagaacactcagttattctttatcccagcagactttgggggtgcagtttctttccaacttccccatcccacttgtgatgcacagatctcttcagccatcctcttatgcattagatttctcagacatgatgtagatcctagtacacagtattactcccgactgcaaggagcccaaacaaagctctttgactggtctcattaaagcccttttatctgaaggctccttaccctgccctgttaagaggaaaggtatgtgggaatcacagcatgccaacaattctctccaaataaatctcttcaaacccttcatacttccatgtggggaggaatataactatgcctaaatttataaatgtgaaaatcctggtttagcacttcactttggatttttgtgtctattttcccatgcctgaaatttccaatttaacatcctttaacataaatagaaaacacaataatttaaagaaaaacctatatcttgtagccttctaggtattccccctaccaatgataccctctgtccttggctgaagcagcatatcttcagccttaatgacaggaatggcctttgtgttcttatttgtgtatttatttctcaaacaacgtatcccacacttccagagttctttcttccatctgtctggccttgaaaggaagaaaagtcacttaggatatgtttacattaaaaacaaaacaaaatgaacttcttctagactgtttttaccaaacactagaagacaaatttccaccaaattttttagatagagcacaactttcatcagagtgactatttgcatatttacccagagccactatcttggtgtaaattttattttaaaaagcatagtgctttcacaatagcaaagacatggaatcaacccaaatgcccatcaacgatagactggataaagaaagtgtggtacatatatactatggaatactatgcagccataaaaaggaatgagatcacgttctttgcactgacatggatggagccggaagccattatcctcagcaaacttatgcaagaacagacaaccaaacaccacatgttgtcacttacaagtggtagctaaacaatgagaacacatggacacagagaggggaacaacacacactagggcctgttgtaagggtgggaagaaggagagcattaggaataatagctaatacatgctggttttaatacctagggtatgggttgatgggtgcagcaaaccaccatggcacatgtttacctatgtaacaaacctgcatatcctgcacatgtacccaagaacttaaaataaaaattaaaataaaaaaagcatagtccttttaaaggtaagagctgatctctaacaattggcagtagtagttataagactatgaggatattgtctttaagagtttatactttttcctcttggacattttgaacctttaaaactttatcaaaatatgttagatttatcctagctaggtttatgaaactacttttatttattattcctggcttatacgatgtagtcatttttggtgtgagagttaaaattgtgggtattttgtaccatatttttttatgccctatctgtaactattcatggagatcaacggatggataagatactacaatatgagtgagttatgtattgcatgtattgtttggtaataacactcagaaggattaatgatatttttctatgtcaaaatattgctgcattattttgtttacttacagtcaagtcaaatcttggtgtcaaaactgctgcattataaatgccacatcaaaaggttttgtgtgctgaacatctaggataacgaatgcagtgatcagggatgagtgtcagaggtgtcaccttttcccatatccttccttaggacaaggaaggcgcaagaagagtgataaaaatcaggggactttgagcatgaaggaatggttggaacaaaaaagatccaagaagcccagaatttgctcattaaacaggaaagaaaaagagactgtgttagaactaacgtggccagagcacagggagaagctaatgaggaatttcctgagcagggcaaggagaactggttgaagcacgaagctgggagagataaactttcatgtttggccaagatcatcaaaggaggaatgagttggaggcataggaaatagagttctgtgttagccgtattagttttgatatgcctgttagatccaagggggttggtgagtaggcagttgggtatacgaatattaaacctcattaaaaaattcaggcccagagatagaaattttggagtcatcagcaaatggatgaatggtgcttaaaactacaaggccggaggagatcacttagggaggagttcagttaaagaggagggcccactgttctatctatgtttattcatgagtcaagaagagtgcaggttcaagacagcaactggtcaagaagaatcatggaaactgagataagcagcagggaagctggaaatcaaggagaaggtggtatcacgaaagccaagagtgaaatgtatttcagagaggaaggagtaatggacagtgtcaaatgccattgagaggctgaaaagatatggattgatttccgtatttttttctaggtgtgtgtattataaaacacatgggatataggtgctattaatttttatgtagaaagtgactggcaggaaatttaatactaaatcttttatttcttagtgcagaaactgattacatcagaattccctagtttgtcccggtgggagtaaggagtgttataggtgaaaaagaaacatgaacgacgaaatgccttaaatgcctgttaatgaagtttcttgtctatgagatgacattaaatatgcttggaggattaactgtgaagagaataaattaataccagtatgtttgaaaacttgagaaattcctgtcagctcactaatttgcagctagggttttagctgactgttttctaagaccagaaaaatctcaagagaaaagcagcatttagaaaggtgtacacgtgcccaagacaccttattagtgagccatgtggcagtttctcgccacttaagcatttcattgctttggtttcttccttttccaaatgcatagtgaattgccaacaaagcactgaagctcaaaaatgacacctcatgttaacctaacaaggtattatgggttatacaagaatgtgttagatatttatagcctgttgaaaattcctgcctacaccatctctgaggtcaaaattcaaaggcccctccatcctaatagcattgatgtaacctgtaactaatatgttttacaagcaaaatgcattgcacttgcagatttaggatattcttgaggttgccaaatgaacaagaattaacataagaattggactctacctgcttatttgataagggtcctttctgaggccacctactttgagataattccttctctgcttcctccctcgaaatcatgatatcccttcttaaccccaaatcacaaaggtactaaggaatagaggcagatgtgccattctagtgatttccagctgggaagaatttgctccctgtaggggacatttggcaaggtctgaagactttgaaatctgttggataaaggccaaggatgctgttaaacatcttagcgtgcacagagaagcctcctaccatgaagaattatccagccccaaatgtcaatagtgtagagcttgaggaaccctgagtcactctgacggttctcagtacataaatgagaaccccagataggtataagacctagatgaggaaatggaaaggagaaagagagaagaggaacaaaagaaaaggtagggatggagaacagaaggaggcatttatagatgtagtagggtagaataaagagagaactaggagcaattagaggggtttttttgtagacaccctgggtttccccatttccccagggtgattctttatggggcattaaatggtaggaattataacttgagattttagtgcataccataggattcacctgtagttgcaaaaatagattcaaccaggtgattactttctctaagaattaactcacttaaaaatagtaccagaatggttggaatatttaaaaatagagaaaacattattgaaaagccttttcattcttcagggtggtacagatgtctttcactttcataagaaaaaaaaaaacaacctcttggtcagatcggagtctacattacttgttcctcctctgatgtcctttgttcctacatgcctgctcttctggaggaccagcctatgttgtattccattaaaattgtgtctagttctaggcaaacagcattttcctataaatatttcattcatcccctttctctttattctggctgtccttattcatctctctcctttctctgaaatctcttcctcctccatttgttttctggagtctagaagagtccttcaatagatagagtgggacaaggtttagagagtcttcctgggaattgatttatcttgtgtgagagaggacagtaccagctagaaactttggagaatgccattcctttggactagattaaagctgtcagaaatgggtcaaatgaggaattaaataagacttgcctagggtcaggtctgttgtctcttacgagtgaagacagtactggagttgtcattattgctaatggagaactttctcacacaaagggactcttgaaaatgttagaatattgcttatttctatcttctaccccactgtcttcatcttcgaaatctgggttgaagaatggctatgccatttctgtattcctccactgtaggagtcatgagtggtaaagtaggttcgagatggaggggttttaagatattaaaataaatagtagcaaacctatttggggctgtagttagacagagacacatacatacctatttgtatgcaacattatgttaaaaaaatggatagatggcttgtatgtgggagatgttggggcagacagatgagaattttgaatgggtaatgagagaaatttaaaagtaaggtgattattgattggccattattaaatgaggcagggattcccaagccatagaacttttgttttgtttctgtttatgtcttttctcaattttatgaaagaaaaagaatttcattcacattgaaggcatagttcaacactaggtgaatattgcttaattggaaaacttactagtgtgtgatggggctgctgtgccttcattaaattatgtgtgcatcagctatgagcaattgcatgtaaattaagggtaactttggcatatgcatgccaaatagtggttcagatcattttctcatcaattttatataatttgtgccagttggctttcagaaatatatatatatatgaggaatgtcagttttgtgtttgtgcatgtgcctatatttttagcacaagaaacgtattttccattaatatatatcataagagaagattcacgtatcagggatttttgaaatgagcagtttttgctaatattattcatttaaagagcatgtaattttagaagattattatatttaaaatagaaaggagcatggtatatctaaggttatgtcatttggcctacattacagagcaatgacagttgcattcatctaaatcacaccatttatatgaagaaaagtcacagatccaaaatgggcaagtcaagtatcttatctctttgatgaatcattgatttgatcatgcaatttgagaggactggggagactagaggccctaaattaccattgaaagctttggatatgatggttagaggcacagctcagggaaatatagctgcattcatacaatcctattgcttcagtatctactgtcagatgcttttgaaagacgcatatttttaagattgtgttttttctctctattggaaaataggtcactgtacatttatttaatgtgcagcattcacaaatcaaacacactctgaccatttgtgttcttgtgtagtgatgagaacatcgccaggtccaacctagagcttccatgaagctaaggtctgtcctggaaccaatattcaccccctttccaggagccattagtttttcttacttcctatttccttccaagtctaattcacggtccacattgcactgcttttcacccttctgcagagactagaggatgcccctgaatcaaggaatccttaatgccagggctacccagtctaccagtcttccagaccctctgagaacagagaaggtgtttacctgatgtgagctgtgtggattagtaacgagagttactttaaacactaattagagaaaattcagtaatacctgtctattaacatcactatcactcacttacactccaattattattatttttttgaagtacaagagaaaggtgtatagatagacgtgatgcaggaattatttgtaccctgcgtacggaagaaacccattcatctgtgtggtcatggtaggttaagaatgtgcgagcataaaaagtttatggactatcgcggtaaattgtgaattcctgtctgatattctgcttctctttattcctgctccatttttaacccatacaatatgcatttctctctgatatcaaggtcctcatggtatatctcttgacttatataagctatgtgtgttctgcaatctgccaggttttataatcttggtttacctcagttttgatattgtacgtaattctagacttctgtttggtttttaactctccacccaatgtagacctttatggtgcgcatttttgttttcctacatttatacaaagttacgcacatagacatacatgaatacatatgtggggattgttgtttaaaaatacaaatgtagctgggcgcagtggctcatgcctgtgatctcagcactttgggaggccatcatgggcagatcgcttgagcccagcagtttgagaccagtctgggtaacatggtgaaaccccgtctgtacaaaaaaacaaccccaaaattagccgggcgctgtagcatgtgcctgtagtcccagctacttgggcagctgaggtgggaggattgtttgagtccaggaggcagaggatgcagtgagctgagattgcaccactgcactcccgcctgggtgacagggtgagaccctgtctcaaaaaaaaataaaaattacactaaaaataaaactgtgtttacaatttgcatgtgcacactatacatattataccacaatttatttttaacagtaatgtaccatggaaattcatcttgctaataggtgaaactctaattcagtctttaaaaattatcactctattccatggtatatatttaatgctgtttctatggatggcatttttaggttgtgtagtattgttgccaatgtttgcaaaattccaataaactttatggtacttcaaaaataaaatcataacagaaatgaaaaccatgcaacatgctaaaaacatattaagattggctatatttgtgtgaagattataagttacataatgcatacagcaaagttacccaaaatctgtaattggatttttcttcacatggttgtagtctcggttcctgtgtctgggttggggttgcctgccattcccattgattaccatatttctgtggaattcttaggcagcagggaacacagtggtgggaagtgggaagagagcaagactgaagaatgtgtgggggcaggaactctgagctaccaggagcaaactgtctggtaagaaacaggaagcttagtttgacatctgtgtaagatccttgactagagtagaatgagatcttcatagccatttagatcattctaggtttgctttcttcctgcttttgtttgagctgagtctagaaaattctgagctctcaaacttgatctataccaaacctcactcttccttcaaaacctgaaatcataattcctctagaagctgtaaaaccctgtgcataaggtcatgagctctgaagtaaaagaagtctgtactctccaccactgaatagcttggggcttctgggtagtttacttaaattctcaccactgcagttctttattgtggccagctcttacatgcaggagaagaggttcaggaagaatagtggggtggattgcaggagaggtaggtaggagctagattatgcagccttcttaataacaaaacgaaaaaagcctgcacatgcatagaagattatgggttaaaattaagctattattgagactgtagcctaatatttctaaattatctctatggcagtgtccaggtaaccctaaaactaagggagatgactatgtgagacttgaacactccaattgtgaattctgatagtaacatatatggctgagtgaaattttatcaagtataaattattcagtagatgaaataaaaaatggaatagtctaagctttatttaatctatagccaccattaatacagaagtagagccatgtttatgggaaattctcagaagcaaaaaatgagcacaccgtaaaaagaaaaaaaaaggaaaattaccatcaccaaaatgtggttcagtgattttttgacagcttgtccggattagtgtttcttatccttcactgccagacagtggagatgagtcagggcagaagctgtaggtggaagactaagagtagggaggaatgaacgagagccagagtcaagagctacctgttctacttgacatcgtgacagctggcctctatgtaacggggttggatgactcaggattgtatctgctggcacttcttggccgtacgtcagcaccaggactatttgaaaactactgctccagaacaaaggtttttagccccaaatttgagactttgaaaggaaagggctttcttaaatgtgaattgagccttccatttggtttgccaacaatgaatttattctgctgtcttctatttttttttttaattaccaagctctgattcttttggcagctggctcaaaatcctttttccaaaattggtggctgttggcagtagccaggaaataaattgaaatcgtaattaaaatagtcatccattgggaaaagaagttgaaacttggtaaatcagacttacagtaactccaagaattggagccagaaagaagcatgcagagcacctagactggttcctagtgtagtggccaccctttaacgacatggtccatgcttcgttttttgtgaccttccgtcacatgccttgcatttcattggctttaataaatacacattaaaaaggttgatcacagttgtatcacaggaaaaagaataatgtatagttttgtgacaactgacaaattagcaagtgacacgttaattttggtgaaactaaggaaatagcaagtaggcagttactattgaatggggaagggagacatcagtaaaataaaatgttccgaaatgtatgcttgttggtgatagaagacattcagccttgaagacaatatcctgtatttaagacaattatataacatctaatgttgtgaacagaggcactggattgctgattaagacaagccctataagcaccaaaccaacaaatggcatgatttcagcctttgtttaaagccactctgttttgtgttcactcatacaaatttgtcctatttctttgttttctccaaaactcagaatctgagtgcaaatgtatttatggataaatagtgttgtgttaggggtagcaccatctaaatgatctggtctgaaatgtggcctgtgtcccatgagaccctcatgtgactaagggcagaattgttttaggtaaaataatgtctcagctgcctaacatgagatataattatctctcgcataattatatctgcacataaacatgtttcggcaaatgggttaagcattttatgtgtcattaattcctcaaaagaaccctttatgatagatattattgtagccattttaaaatgaggtattcaaggaactggataagaaactatcctacactctcacagcgagtagcgggtagggcgccaggattgtcgtgcctctcaaagctggtgtgcttcccatcagccttccgccgcctctgggcttgctgcttaattggggctggatcccatacaatctctcgccttgtttttccatctcattcatcagatctgtctcccctacgatattttaacacctcaaggacaggaacattttttggcatctcaattcttagcttgtctgtgataatgatgatcacatcctacaacaatttcagttttgcgaagcagactttctcactatctttttgctctgtttttcaactcaagtgaaatccagcatccaccaccgccacctcaaccaccaccaacttttctgtccctagcctgctcttcacctcctattctgtcttggatctttgagatatattttcagcacccatttatgcttcgtacctggattttcttgtttcttgttttaccgattactggcatattttgtgggtgtattttgcatattgtcaatctgttatgttggaacatcattttaacattgacttcaaaaaaatctccaatttttagtgtcccgatgtaggtgaagcattttcatctgcttagatatgtacatggaatagattcaagggcaattttttttgagacttgatgcttttgtacattttatatatgtagaatttttaaataagtagtttagttgcattatgaatctgcccagatagtaattacagtttttcattggaattcaaatgacttttaacgtaggacctattatgtgagtagctgtttctttaagaactcacttcttcttaaaggaacaaggtggaaagagcttcacaaaagttggaagaggatgcaaatgtatttcagggaagcatttcacagaagttagaactctacttttgcttttctaacaactcccaaaattgaagtttaattgtcaggtcaccaggaaagtatccaattgttaaaatcagattcctgtgcctttaagtaatgatgtattgtttaacttcaattattaataccatacaatggtaaatataaatacattttttccctttgtttataaaaatgaacataagtagaagaacttaaggcactgaaaacaaacacttgggagagactatggatggaaataagcaaaaagttgagtctttccatgtaaaaattgacctagtttcagtctgctcctaggagaatagccacaagctcagagagcttttgttgtttgttgttttggtattacaattaccagtaactttgcattggtgattcctattctcataaggcattttactgatcagaatcttcttattttgttgaattctctgtgacataaatttttgattctttaaattaatagcttttttagcatcttggaaatctcagatcactttgataatctagaaagcagtggtttttctgtccaggaaaatgaacatacacatagacataccaaatctggcatacaattttggagagttcaagaattgttgaacctatttgaggacccattaaagtattttaaagagctttatggcgacccatgtgttttcaccaaacaaaattgtaatgttatctttagacgaaacctctttaagaacattgagttatatcagatgtttctgtagatcaaacatttttgcaatttccatctatggatcaaaatgtagagtaaataagtgaacaaaagcaaactacattaaaaaagtcaggcatgggcataaaactctccagacacacagccacctgcacataaaaagatatataccatctatatttccttaccaacctgtggtagtcatgttgctgaggcagtgcctcaatctagattttactaacctagactaaataacatccaattttctgtaattagaatagcctagagatagtgtgatggatccttaggtttttaaaacaataaatcaagcattcctgtattttttccattgatttttacatacagaaattaggattttttttattgtgtcctctgcagcatattcaacatcaaaatgcagaaagtgtccttgatgttttagcccctttattcatagagaagataatcctgtttctgtttaatctctttatttattagctttcatagttgccactaaatattttgaatcacttccaaatgtcttgatctataattacatttctcacccaactgagagacgtcagtagctttatctgtttttcaaaaatgcattaagtaccttaagttcctttaaaacaagttgtcacacatgtcaaaatataattctcaaaatgttacacataattctcatataaatagttactaagcacatgtcaagattttacttagctcaacaatcaggatgaaaatccagttcaaaaaagaggaaatatatacacgtgtatatataatatatatgtatatataacatataatatatacgtttatatatgtatatgtacatataatatgtatatgtatatatacatataataattataatatgtatatatacatataataattatatgtatatatacatataataattatatgtatatatacatataataattatatgtatatacacataaatatacacatacatataatattatatgtatatatacatataatattatgtgtatatatacatatattatatgtatatatacatatatatgtgtatgtatataatatttatatgtatatacatatatatgtgtatatataatatttatatgtatatacacatatatatgtgtatatatatttatatgtatatatacacatatatgtgtatatattatatataacataatatatatgtatgtatataacatatatacatatatagtgtgtatataatatatatgtatatatgtctgtatatacatatataatataatgtatatatacacatgtatataatatataatatatacatgtgtatatattatatatacatatatacatatagagagcaagagagagactatatgtaacatatattttttctgtatatattatatagtatctctgtatccatagctatatggatatatttataaatataaatgatatacatattttatatttataaatatagattttggtagcattcctgaatgagaccattttttcctctatcaattatttaattcacagaattcatttagagtaaaactccatacactccaggtttctagtttactaagatgcatccttttgttcggtaactttaggttctttcacatacatcctcagacctatctgaaaggcttgttaaaacacattgctgggttccacccatagtgcttctgtagacctgggatgggccctggaaatttgtgtttctgacaagtttctagctgatgcacactttgagaacaagtgatttaatcccaggctttatttgaggatcaagtagggcagcagggagtgttgattaactcccaggaaagtcagtacaacctctgattgggtccttattacttcttctatgttattcctgttttcttctcctgtcccctctgtacacacaagatcatccacacctgcggcttcagctgccaagtctttattgctgcctgcacagccgcaccccagtgctgctccctacatttgaacatttcaaatccctattaagggccagactcccagtgtcttccccacagagacctggcctccctcgtttgtcccatttctgtcagtgatttcaattccactgcaaaccagggctagaatgctccaaatcacatgttgtaaactagaaggtgctctcctccctccccagttatcactggcaggcttctcttagtagagaaaatgtttaatttttaaaagtttggaatcttaaagagaaaatcctttcagttttcaatctgccagttctctcttctgtttcgtggatgtagccttaattctttataagaaataaaagcttctgagacttcaaggaagtttgggaactgagaattgtagtaagtcagggaagcaagctagtcctggcaatctcttggaagggcagctttggaaggctgggaggtcagaggccaagcttctagaggtcatgtctgaggtgtgtaagtgagacttggagcaggagataataaacataagcttcaggagtttggaagggcaagaaaggagagtttaagaagattatcaaaagatatatcagcttcagtttcagctactcaggaggctgaggctggaggatcacctgagcccaggaaactgaggctatggtgagccatgatcacaccactgcactccagcctggaagacagcctggaagacagcctgtctcaaaaaataaaatataaatgaaataaaaattaaaaaaatagatgtaacaagatcagctgagggtaatttattttggaagagagggaactattgagagcagaagaattaatgagtggattttaataatgctacagaaataaagttcaaaggagaaagaaagatagtccagagtctaaattaagtgattgactttggagagaagagaactatttttatccgaacccagaggaaagaatgatggtagttatgtcaggcagacttgatgttaaataggagaggggaaattgggaggtcatagaaatgagacgcctagaaaatgctcaggtgaatgagcacattgctgtctggatgagtgttggacagagtgattttgtcatgagttaacctggcactacttttcttccttgtctactcctctgtaattaggttcagtggagaaggctgaggttagagatgacctcagtatgcgaggttgattttctttgtttccatgtagatgaacagtccctgtgtatggatggctgctgctttttctcacgtaccgtatgtcccgtgtggccagtagataacgtttgattcattcccattctgtgccagcgccttagacctatgtgtcaatgacagccagctgtcactcattccttggcttcacaaagggaaagaaagaaattcccataaggaagtaaatgtcctaaattagattatttatgtttaatggaataattgaaaatatttaatggaataattaaaaacctcatgctaattttatgagggagtcattttcaaaagttctatgtgaaagaatttcaaaaaagagcccttctttgtgttcctagagaaaaaaaaatgtgatttgctcttctcaccagtgctttgtgtaggaaaggatggcagaatgctgagtgagggaagcccatcaggttattgaaatgcagccactagagtgtgtgtgtctctttccaggaccatgaaacctccttccccagggctctctcagcacagaggctctctcctcggtggtgcttcctagatggtgagttctgcctttcttgcgggtatcgtgggagttggggaagttgaagagcaaggcatcaattgatagggtgggctctagttttccaaaagattattcagaaagccttcatgtgactccacatggctggtattggcatgcggaacaatgtgggcctgctgatattgcactgtcctttcctgaagtcatttccctcaacacagcttggttaactctggctgaactcagcatcaagttgctcaggccgatgtttttctttcatcagccctcttttcttaaagcttgactgcctgccttaaattaattcagaccagtagctggattctatatgcataggatggatataatttctatgttatttgcatcttatggaacattcatattatttttatgagaccattattgcagtatgatgtatacatttctggaaaaaggtggaaaaattcagttgcattcaaatctgctcagatccgcatgatatattgcatgcataataggttagttatcttatgattgtttaatgagtccgtttttttatctcaagtatctctctcctagatgctgcctaatactacatttctatccaattacccgtattgcagtaccttctcacctctgtatattcatgcttacatactaccgaatgtatctactacccattctctcttttgttcatatggagacatgattttcattgtagaccccttttttgtttttctgggtgagcatctgagaggatataaatgtgaatatgagtatgacaggatttgtgagtgtatgagcaagcattgggatggcagcagcagagatctattaagatttaaggactgtccagtagcctagcatgactgcaatgtaagggttttaactggcatagtggaagagaaggttataactttggtgccagatcacagaacactttgaatgccatatatatatttttctagtgttatgaagatgggcacttgtatctgtatgagatctaacccacataaatcatgatgtaggtttttgttaatgtctcatcagctgcctctcagaactttcctccagcttctttattccatagcaatgagaaacataatcatttgtcattcctgaatttgcagaggaacaacttgtatttgagaaaattatgaaaatatttatgttgttatgttctatctaaagtcttaaataaaagtacaaatattgtggctgacagtcttagcccaggtagtagttttactccatagttttaataaaataaaacctttaaaaggtaattgcagtcatggtttaaaagaaaaaagtagagtgaatttctccaaggcagattttattctattcttaggttttagacagcaggggtgatgattggctggtttcttagttctgtcgcctttggagagaagctactcattaaatgtttgtgaattttaaataagtgcttgcattttgagtttttctttcttgtgctgtttgttttgtagaaaatctatttataatatttgggctttgttagatagatttaagtgagaagcacataattctttttggtttgcttttttttttttttcttttttgagataggagtctgactctgttgcccaggctgaagtgcagtggcatgatcatggttcaccgcagccttgaactcctgggctcaggcaatcctcctacttcagcctcccaagtagctgggaccacaggggcacaccactatccctagctaattaaaaaaattgtttttgtagagatgaagtcttgctttgttgcccaggctggtctcagactcctggcttcaagcacttctcccacctgagcttcccaaaatgcagctgatagttctttctaatattaggaatatttaaaataatttctagaaacccaaaatttgtaatttagatttttttcgcataccatagatgtagctcaatctctttcagagaatgcttaaataatttttttgctgttttggcttccttcagacatgactctaaggatgcaggttgaaagtgaaatgattcatttaagaccacatatggtctctggcctgaatcttcaagccattttccgaagtgggaagtcacttcactgagaagtctacgtaactgtagctttttctagctttatttacttaataaatacatactaattcctaacttactttaagatcatttgctaatttcaggaggcataaaagattaaatgaaacagatttttaaagaggcaggtctcttagtctcatggttatctgtgaagatagtctgtataagaagttttaaaaaatgtaaatgtggatggatgcagggtcagcaggttctgtctggtgttgggaggttgggactgagaaaggtttcacagaagcagaagcacttgagctggttctttaaagacaagtatgatttagatggcagaggcaaagggaagggctttccaagccttagaatagcagtggcagaggcatggaagtgctgaggttttcttaatagatttagggactggccaggagactagcatgactgccatgtaggggttttgaccagcatagtcgaagagaaggttataaatttggtgccagattacagaacattctgaatgccatctgcattttttttcccctagcaacttctgctgatcgcttttatcgaatagacagatctcaggtaagtttttttccagcctgcttgtgaaagtgaaaaattcccaagttaatgtgctttattggtagctaatctcataaatttttctaacgaaaaccactgagacacaaattttggaatggtgttcataacttaagcttgaaccttttatttgtcttcacgtgttttatgatttatggactcaagatgatgtggcttaatcttgcaaatgagtacagaaaataagttgacttgtagacattatcaccagcctgtactccaaattttcattcacaaagatatttttactcctttttagccaaatttcatgtctttttaagctcatttctgtttagcaagtttgaggccccaggtgtataactagactacttagtttcagttcgccaatccctggaggtcagtgatgagaaaaaaaaaatggttttgcccaagttaagaattcctcccattatctgaattctcctaggagaaaaatgtacagtattgaacctaatgataaagttgttaaccatgctgcttagctttgaccagatgacggggtagaagtccacttaccatacactcctgctgggccaattgtatgtgggtgtcacttctctaatagtatttgggaagaagatgaggcaagaccatttctagatatatctaagaaaaagtcctggttaattggaaatcctgaaccaaggggattcatctctccctatctcccactgtctgcgttagcgcagctttggggaggatcaccaactgatcaagcttctgacaacacagtgtgatcctttgacacgttgcagaatttcattattcctcgagaccaagaatacttgttttgttattcttcatgcaacagacttcttgttcttctttaggaacatttgcactttgtgatggagatttcccaagatgagatttttattctggacccagatatggtggtgtcacagccggcggggacacctccgggcatgcctgacctggtggtggaacaagcctcggggtgagtgtgcttctcctggcctgtgaggctggccttagggtgacatccatgtctggttcgcctttgaacttgacatcgttctaatgacatcaaatgattttgaagtgtagattttcttgttgtgtttccttagagtggttattataagtctgtcttatgaatggccgtgaagaaacacaaaaccagatttacaccatgtccaagcctctttccccatcacagcaacccttcctaacaaacctagaaagcactagtacttgtgtttgtgcttgtacgtttgtagtaactctgttatctacattaaaaattgacacaggtgatttgacaaattttctcctcttcctcttctttgctatttccaggctgctggagacatgtagattatataataataactatgacataccaagccctttttaagagctctgtcctgtgtctctcttctgtttctaccaccgcttcatagtgacttaatcatcttaagtgctctgtgcttattttctcatctgtaaaatacaaataacaataatcctcactcagagaattgtttggcgattaaaagaattgatacaggtaaagcacttaaagtcattcctggcatttttaaaacatgcattaaacagaatgttattacaataataataatagtcatcaccatcattctagtgaccttgaaaatttggtacaattatccttaattcatagattaaaaaattgagacctaaagggttatgttacttgtctaatatttcacagaaaataagtagaaaaaatgagatatagtcctgggttacctgatgccagagcccatgcatttaactaccaccttctaccaccaaaacataattagtatttctaagttatttcaataattaaaaactatttatttagagaattttgtgtgccaggtcctagtgtaagcacttggggaataacagtacaaaaataaaaacagataagaatctttgtccttgtgaaatttagtgttttactggtctatggggcctgaattgttgaagtaagaattgctctagaaaccatacacaatgtgcccaaatagtaaatgcacatcgtgtacacagactcatacagtatgaataaacagtccactaggctagcacaactgcaatgtcatcttcattcctgttttccccttgtcacttgatttactttttttcactttttttggttcactgctgctatttgtgggtggtttcccactctgccaggggcagttgatgtccaatatgtaccaagtctaggtggagacaagagaggacacaagtggctgcatggcctgatagcaagctgttctcaggaagccagagctgcgatgtcagagcatgggggaaggccgacaggcacaaggggtaacctgatgcacccctgggagccccaaaggtggtggggaaggccaacttcgtggggcacatccatgcatcagacccatcagtagtggggaaagcaggtagagtgttttgtcctactgcagaagcagcaggtgctagagtctgggtgtcctcctaccccacctaacctgggctctgactcttgatctagtaaggagaaagtccattctgccaagttgccctggtctttgctcacttggtcattttctttttcttttccttttttttttttttttttttttgagatggagtctcgctctgtcacccagactggagtgcagtggtgcgatcttggctcactgcaagctccgcctcccgggttcatgccattgtcctgcctcagcctcatgggtagctgggactacaggcgcctgccaccacgcctggctaattttttgtatggtcgttttcttcatgtcaaataatggccaaatgctttggccttgctagacctctgttagctctagctccaaaaataaagtagcctgaaaatccaccaggacttgaatcagtgcctttcttatttctcaccagttgcctcccctgaactaaaccaggaacagggaagcagtgaaacaggatggactttgttattttctaatctgcatttctgccctaggtctattacttcttattcatgtcacatttaaaatgacttaatcttgaaaatcagttttctcatctgtgaaggggacagaatcatacaaatagttcatgattgttgagataaatgaatgaaataataaatgggtagtatctggtaaacacttcataaagatgaattttgcttctcacatttactggcaagattcatcttcagaaagtggaaacgaagtcacgtggctgactttgaatgtttaactgtctggtgcccttctttctctcaggatctcagactggtggaatcctgccctgcggaaacgcatgctgagtgacagtgggctggggatgatagctccctattatgaggactcagatctgaaagatctcagccactcccgcgtgctacagtaagagttctcttgctgttcttttcctctgtgccactgtgattgctgggagaggatgtactgtgggctgtgccccagtggtcaggattctcttttcaatggcgctcaggctgtctcatgcaggtgctactctgtgttttcattccatgcaccttgctcatatttatctaccccaaaccgttcatggaactccaccttccatttcttttgctcctgagccaccttgagccccttgcacgtggacctccacatactttaaacctcaccagtgtcttctttactggagtttagtgtttatcacacgtccctgtttgccacatcataaagacatgcatgagagtgatcatgagtagcttgaaagtgacacgtggtttttcatttgtgaacacattatcttgctgtttcagtggtcctcagtcctgagcctgtgcatgtgtgctgtacccaatattgccacgtgggtttgttggctaaagctgggtgctgcccatgttgtggttgcagtctctgtgggtaagcagtacagcatttgtttgtagatcagaacagtatgtgtgctttcttctgaggtctgatcatggtgagagtgtaggatgcatgctgaagtttcacagcagtgtcgatacctttgtgctcggtgaatccacctccctatcatctcctctggtgacagatacactcatgcgcacctactctttaatttcaggccaatcaatccatctcagaggttatgcaaatccagtgtgttcatgaaattaggctggtttccagtttacctggggtcttaatcaaataatgacaatggccttgtaaccacacagtcttagtcttttgacagaataacaagataactgaagattcttcgaatcctagggttaactaaagaggcaaaggaagtgctttgtttctggagaaagaccagaagcaatttcagtattacaaaggggaaaaaaatgagaaatttggagctaattatttcattggcaaagtttcgaggcacacaccctcagggcagaagacttcattttaattgcttctctgtattacctcttattttcttgtgtgaagacgggaaaggaacaacaatgaattactatggatttttctttttaattaaactgtgttgttagtttctgatggcattttgattgcttataattcaggatgttttccatttcctttttatacagaattgaggcttgtgaatcagggtgagtcagccacccacgaatggctaaaaaagtggccatttatctgttggcagacttattggaaaattagtgttttaattagctacagaaatagaaattaagcctggacaaaccagtatttgtttactgagtaaaaactcagtaaaccaatgagtattttagttgtatatatatatataatctgtttccacaaagcagaatatgagctcaatctagttttctaggtcctgatttttctatatataacatactgatgtacgtatcataataaataaaataattgtatataagatagtaaatattcttcccaagaatgacaaataaatttaccactttatataatagccaggttcttaaaaccagatgtcaaaatgaactctttctgtctgtttgcgttaaactatctttttagggatgtctcttaatttttggttgatcttcaatttacagctataagtttttgcagtcatttatactactttagttctaaaatgccctagagtagtagacactttttaaaaaaacctgaaaaattactttgaaaacaagcaaagtggcattcaaacattcatccccagcctttcagcttctccagctggatctccagacattgtggaacaaaggcaagtcatctctactaggctcagtctgaattcctgtctcatagaagacacagcataataaaattgttgtgttaaatcacttaaaaataaaactaaactaaaccagatgccttacctcaactttttaattaattctttaacttttaaaattattatgtccatttatttcttagaatatctttttatttccttcagacatcatctctgatacaaataggtataattgcagttgtggaaatatctaataatgttaataataactactattgatggactacttcccacttgctttgtatcataattaaatgatcttcattcaacaatttttaaatttagctgttgcttaacagataagtaaactgaggctcctagagggtaaaatatttatcttaggtcacttcaaatggcaagtgtagtttgacctgaggtcggtttggcttctgactccatgctttttccattgtcctacactatcttcccaaagggaccatacaaagtcagcgtaccagagccacagaagtttactttggtttctatttcttttttacatttgtacagtgaaaagtcctacaatataggggtactatgcatgcacattaaatatacaactgcaaacttacccagaagtaaatatggctgagaattaatttttaagcatttttttctttaaaagaagagattgaaacaaaatataatggtggtaaacttcagtttaaaattgctaaatatatataaactatgttctaatcaaaataagcgtaaaaattatatagaaggccatcatgtaccaaccaccttgatttattatgtcattgtttttctatatttgcattatatctttctttcaagccataaacaacacagagtagtgtaaaaaatattgttttatggttttgttttgtattgtacaagttggagtatctctaattggaaaatctgtaatctgaaatgctccaaaatccaaaacttttaaagtgctgacctgatgctcaaaggaagtgcttattggaacattttggatttcagatatttggatttgggatgctcaactggtaagtataatgcaaatattccaaaatcctaagaaaataaaaaatctgaggcacttctggtcccaagcattttggataagggatactcaacttgtatttttgtttttgcctgtgttatataatgcatatattttggaacttgccatttcactcagcattgtgtttttgaaattcattcatattgatatatgtgggtttttaataatttttgatatagaatattgcatcatacatatgctataaattgtttctctatttcgatagtgatttctaatattctattattttttaaaatgcagcaaacatcctgtgcccttctgtgttgcagaatatatatgcagtttcagcttactcgataatgcaaaatttaccttcccagttagagtactgatgaatcagtaactgaaaaggccctgaacacttattgtaataatctaggtatgatcagcatctgttgctttacactttaaagccccagtcaacttgggggataggaaaggttcaatttagcatcctgttgacagtgctaaataactcactatataaacagaaatcaaaagagaaactttcaattcttagaactgaaaatactacttatcagagttttcgagacactgctaacgtagtattcatagtacgttaggactgcagattcatttatcaagggaaaaatgattgtgtgcaaataagcaaagcattcaatttgataaattggaaaaagaatcccagtgtaaagaaatgagaggggagaaaaatgataaagataatgagagaaatcaatgacaaggagaataaaacagacagatgatgaacagaaaataaaatttttggccgggctcagtggctcacgcctgtaatcctagcactttgggaggctgaggcgggtggatcacgaggtcaggagatcaagaccatcctggctaacatggtgaaaccccgtctctactaaaaatacaaaaaattagccgggcgtggtggcgggcgcccgtagtcccagctactcgggaggctgaggcaggagaatggcgtgaacccgggaggcggagcttgcagtgagccaagaccgtgccactgcactccagcctgggcaacagcgagactccatctcaaaaaaaaaaaaaaaaaaaaaaaatttaaaaaattcgttgaaaagataaataaaacaaaattctgagaagtctgatttaaaagaaaaaagtactgaaaacagaaagaaatatacctgcaaggctttccccatatcattcttcctccaaggcacccagggcatttttgtgccaagcggccctttctcctccaaattgcaactgacccggctctgttggatcttctcagcattttcccatggttttaaaatttaaaatagtcccttagatccatcaacctccctttttctcaggcagagtgagaggcaattagtataaaaaggatgaattagatttctatcattactggaattggttgcatttattttaaatgtttccatttagaagcattataattttaaagaaagatatacacatacctacttatatgcagatcctataggaaagactgtaattccaaagtaggatacgcaatgtgtatagtgtctgcaaaacctgtgaacataataacaaatatttaagaaccaattttgaaatgaattggtgagaagtggttgactgacattattactgctgggaccataatgattttttctttaagttaaaaaaattttttttcagtgtccaaggaagttctatttaaaatgacatgattctggaaatgtatttgctcttatcattaattgtaccaccacgattagtgacaagactatatttcatttggcagaagattaatagagagggaatttacttaaattttagcagaccaaatctatttgagttgtaaggaagaattttgccacttgaggatctatgagaaaagaaaataggcatggaatgaaaactctgatatattcttcttaagttttctttgagaaaaggactgactcacctctgagtcaggtgggttaagagcaggcaggtaaagggtctaggagacactgcttttgtttctgaatcagagtaacctttttccggttcttagattttgtagttcgtaagaaacccccaaatgactgaaagagttgtactttttctcaatgtccccaagtcctagtcctgaaagaactaaaatggactgtcacacaaataatatcttgccactagactaagacacaggggaaacagtgtagtgaaccacaccgagggtagatattcaatccagataattgtgtctaggcaggtatctggtacccgatcagctgcacaaggctaatgggtttttatgattggcagaggatttctgtcttcaaggaaagataatgctatcaaatgtttaactataatgtgtgaggtctgatttgtgatttcattgtgattaccctaagaaatagggtaaacaattcagtcaatcgtgtattgaacaaatcagtattgggcaccttcagtgactgaagtcaggcactgaagatatacaactaaagaagaaataattattgcccttgaagagcttatatttaaaggggaaatattaaaccaattattaaagttccttctaataagtgctattatggatatatgcatagagtgttctggaaacaagaggaaatataatttgctgcttttttttttagatttaacttttttgaccctagaaatgatgaatatttaaagaattaacgaaaatgtcagcctcaaagaaaaaaaataggcttattaagtgttctatgtgtattttcttcattttttacatgtgaacagataagtatttgtccttcctcattgtgtaaaccagaaatatctctcaaataatggaaaacattcaatggtagttcaacctctccatatgctatgtgtgctcaaggaaatttggacaaccgagaaattatttggagataccaagatacctaataatactttaaactgaaaaactggcctttttagtatagtctgcaattgcaattctgaatcactatatcgagaagataaagcccggagacctcctgtgttctgaaaactcagatgttctaagctgattatgggagaaacaacatcattcccctctggtcctcaactattttctttattcagtttcttctgggaacattaggttatggcctgaacctaataaaaagggtaattgtgcttattgtgaaagtttcaggttctcaacaggaagacagactgttggacagcgattttgattttggaaatattctttcagcttcacaatcagataagcgggagaaaattaatcttcttagtgggatgcaggttttgctgaaatatatcttagagatgaaatcagtgctgtcaggataaagatggctcctggcatctgtttcactgagatagttgggtcccgtttctacctacctttgacatccctgcttacctttgactgggctcaatcttgctcaccccggatactcattccagctggaaaaatacaggatagctgacatatgtcttccttcttctttttcttcttgacttaccttgagtttgaaatgacttggtgaattactctatttggcaagcacataataacactctattcctatgggtgtgtgaaatatttaataagagatttgcctttgttatttttagaattgttcctcaatcagttatgcatatggaggccctaaaccactcggaggaaatggatttaaatttacctttccaagttcagttagtggaagagttagaacagagttccctgtgtaccagatcttattttgactgacattgaaagaaaaacaaacaaacttactttaatgttaaacatccattttatttgaaataatcccaggaaattctcgcccttcattgccatgagttccaagttttgccaatgattagagtatgaggaaatattagtgttaagtggctctctttttacatttgtaaaagctggcagccatatttattcacacttcaggaatactgtgaatgtgaggcagtattgattggatccctctttaaagcatgtgagttccttggatgaccaaactgtgcatttctccctctgtctccatagcactttgcaccatacctaaaatggtaggcatccaacaaggcaggcttttgggatgaatagaaggatgttccattcatagaacatcccttgatagaaaaggtgctttgtcaaaccaaaataaatacgtgtctatttatattgctatactaaacccagtacttatcaaattataacaaaataatagtgataacaaaataatatgtaaaatgttgaccatttttgttaggctgtgggttccatttatatatttcaaatttgaatataagtatgctggatccagggaattcacagatcaaaataataaagacacacctgaatgcctgacttggagaaatgttggtatttcacaagcgagaaagtaaaaggtaagtatggtcggtataggaagttgtaggcactgttggtgagcacagtggtaggtagagtggcaaggaagaattgtttcccaggcattcacctccaaaataaactgttggtccccggctgcattctccaacttccaccaacactcttgttttctcagtgtgtctgtcttaggtgaataatttgattaaacagatctaaagtgtgaaagagtgatcattttgaaatattttcaaaaaaattcgcttgcaaatctcaagttgctgggatgtggagcagtaatcacttaccatgttcagtgtggagttgaggaatgtgagagggatgtcatattatcactggaaatggtggtggctggggagtcatatcgggcatgggacttctctgcggtacttctggggccctctgaaccccctactctaagaagatcagaacaagagatatctccacaccatgctagcactacttatttggaattcagggagatggagaccacattccccgccccccccccttttttttttaacttttctggatgattgtgccaggcatcacacataagaacaacaatcctccaacagttttctccaatactctgtgagatgctggtcttactccatgactcccttacaagctccttaaaggtgggaatggaatgttttaagttaagtacctcccacagctcttggaatagagttaagtacatagcagttcttaatatctaacactggagtcactgaattattctcacagtctgtcgagcccattttaatttcttgttttcaatattactatgatttatctgcattcattatattttttttcacagagctcctcgaactgatctataactgagaaactctcttgtccttagacacattagagtcaggaggaagcagacaatgtttagattctgttcccaccctctcctgagaagggtggggtgggaggagatgttgtcagaaagctgctggggtatgttacagttatcttcagaggtgccaaaccagcttccaaccccgcctagttttgtctcccattttctaaaactgggatcagaagtccttatttggatttcctaaaaataagtagctgtggctgagcccttactcaattaccacagggagatattgcatatccgggatcacgagataagtgaggtgccttgcttataagccccacgtgctaagactaaacgtggctctcatgtgacttgccttcacaatccagagctccctcatgtttcaacttatgcttaaaaagaaaaaaaagaagtccacatttacaaaatccagatggattatgtctcaacagaagctgttggccggggttcccagagtcactaggataaagctggcagcttggcttttcctaaagggtccttcctcctggctctccgggtatgtctccgttgtctggattttagaataatgtgccttttctatttcttcacccttttttttagaaagtgggctggcaactatattgcagagactgatttctaaaggcaagccacccatcctttattgcttcacaactgtgctgggtttaattatttcttttttcattttgtctacagaatgctaaaatgtgatggctacatcgtcaggataaataagcttgtgaagtattattttctccaacttcatctctttattttatctatttcttttctgtgtccactgtcgcccattcttcctcaatctctcacatttcaaactgctttgccctcattttgttgcagttcttaaaagttaacagtaggtggcagtaaaattttatactcgaaagacattcaggcgactcagcaaactgaggagggtatacagaaagtatggaattgtaaatgctaaaggtaaaacagcgtttttttaaaattagtttttagactttttaattgactaattgcatatatttattgtgtacaacatgattttttgaagtacgtatacattgttgaatggctaaacctggctgatcaatgaatgcattacatcacacagttatttttgtggtgaggacacttaatatgcactctctgtgcattttttaagaatatattatatcatcattaaccaaagtcaccatgttgtacaatggatctcttgaacttagtctgctgaactgtaattatacgtcctttgaccaatatctccccaacctgaacagtgctattttctaaaagccaaatatatctaaatataggaatctatttaaaaaaaaaaaaaacaagatatttcaagcccagctcacatgggggtcatcaaggcatatatttgggtaggtgagtcttaaagactgggaaattatgataataaagggaattggtagaaatttgtatcaaatgaggaactcaccaagcagcctttattatttacatgctggaaatgatttccttccctccacacaaatgctcatctctgtcttcttcctttcattttgctctttctgcaccccttccctctgttggtcatgaatgttacctttgaggctgcttggcattccctgaatgggtttgtgaccacttgaatagagaatgtgtttgtctttctctcatttcaatgccactctgtgtgtttgctgtaactttcatctctcactctcattctcgcctgctctcttttactgtatgtgctttgttcactgttttaagagaaatattcacaattagaaggaccaaaagcaaacaaagagaggattatgtagtcgatggagatttgcagtgctgtgggatttctggtcctattttacctaattagagatgctttggggctagagtgataatggtgaagatgtcacacagatccatggtctcattctttctcccttgggtcctccaaatgatgtcataggcctggcaaactagttctccaggataggcaatgcacccttgagagatgctcaagggaagaaagctattgcacagagatgataatctgcagccatgctttcacagcacagtaaatcatacctttgctcacttgatttgaatgaagattcttgtctaccaacagttttaggaaatagatggaatttgtgtagcatcaccacttcacggtaaaacagaagaaaaagatgaggtttctgcagttgtgatgcagaccgttgaaatgtgcctggagagaatgcccaactgggaaatcggttttcattcgggactacgtaggagtgtaacagaggacaagcatcatggctcaagaagcagggaggaaagtggaacctggggaatgctgaccaggcatgaacattcttacatgttcaccataggaaaaaggtgtgagcacatgatgggaggctgttctatccaggaaagactggattccacccaactgtgacaaaggtaaatgagaaagtccaggaaactctcagggctgtggtcaggagaggggaaaagaaatacaagtaaatgactgaaacgacagagaaagaacattcagagctgacattaagagcttctctttcccttcctaagtaggatggatcatcacctgatgtttatagaaagtggtctttttgctgtggttctcatccccaaagctagacagtaaagaggaaagacaggcatgaaagggaaattgaataaaatacgcatatagtgagttgttttcagtgtgtggacatacgtgtgctgctttgttccccaacaagaacttcacaataaggagtggtgtacttatttgtagtgtgctgtgtagggtgtagaaggagcacggtgtctagcttgcccagcattcccgctttgtttccttttcttattgcaggatggtagccagaaaatgaaggggccttggctatttcagtcaggcccgtgaattggatgagtgtctcccacctcttctactccatccatagtctgtggtcctggggaatcccactgctgagtgttttcagaatatgaatctatgctcttgtgcctatttaaactctgctgtcacacctgtcctgcatgtttatcttaagcccatctctatgtggtggccccatcccttggccaactccccaccaggtgatggtttagcagtgctgagtagaaggtatatgtgttggggacacggaatagagatagacattcatttgtagatgtttctttacagaaagtaagagtcccatatagaggcatccccaatatttatctaatctatcctctgttctttaggaaagactaatggataatctattgacatcctatctccaaagaaggaaatgatgtagccattctgaggaagggccaagtaggaaggccatgggtgcttttaaattaaagccatgagatgatgaaaaaaaataaataaagcaaaatatgcatagagtctaaaaaaataaaaagaaagaaaactggacagtgttattgaaatgaaaaggatattgtattaggatcagcttgtaagttttgatcatttcatggagcttaccaagaaaatgcacatatctaaaacctattgtaaagtatattataccagatataaagactgaaatagtcgtgacacccattatttcatttccaggtttattgactaaaaacgataaaacatcataagaggtgcaatactttataaagtcctttgccttcccaaatataatactcatttgcttttatgtattgctcttttgctggtagaaaactgggcacatttttcagtgcccttaagccttgtaatcgatctactagaaagataaaaggctttgaaggaaaatttgtggattgaaggcaatctaaaaaaagtatctttgagtttcttagagatgcttgagtttagatagagtgctgtctgtaatgcagcagccactagccaatatgtgctgaatgtcttgttccctgatttgtgatatctctatatattaatctaataaaatgattcattccaagatattatagctgtgtttagttgggtaatttcatatattcagactgccatgacaacactccgttccagaggaacaaacttacttccttgggaacctggagacttgtctgaagctgactgcctcaaacacagatatctgttttgtcctgttttattttttgtttgtttgtttgttttcgaagtttgtgactttaaaaattcaagggacttttgcttttggatacataatatgactgtgctggtttcagtatgaaaatattttaatttttaccagttaaattacataatattctatctaaaatagcattttgttttccaagagcttccctttttttccaagtttctctgtgtatgctagtttgaaaagttgtctttattttagagacaatatggatattctcataagcagggttaatattgggaagggtactttcaccagcaaatattcagatcaagattcatggaagagtaaatccaaagtaaaatatatatatatgtgtatatataaagatatgtatataattaaaaatatgtaactatatattattttaattttttattttttcgagacagagtttcgctcttgttgtccaggcaggagtgcaacggtgcaatcttggctcactgcaacctctgcctcctgggttcaactgattctcctgccttagcctcccaagtagctgggattataggcgcgtgccaccacgcttggctaatttttgtatttttttaagtagagacagggtttcaccatgttggccaggctggtgtcaaactcctgatctcaggtgatctgcccgccttggcctcccaaagtgctgggattacaggggtgagccaccatgcccagctattattctagttctttaaaaataattttaaaattgacataaaattattatgtgttgtatacaacatgatgtgaaatatatataaccattaattatgtagctaattaacgtatgcattaccatgcatagttataaattttattgtgagagcacttagcatctactctcttagcattttttaagaatgcagtgtatcatccttaactatagtcagcatgctataccataaatctcctgaactattcttcctatctaactgtaactttgtctactttgaagagcatgtctcccatctccctcaccccgaaatgccccagcctctggtaacctccattctactctctacttctgtgaaatcaacattttagattccacatgagtgagacatgcagtatttgtctttctctacctggcttatttagcttaacataatatccttcaggttcattgatgttgttgcaaatgacaggatttccttttttttatggctgactagtatttcattgtgtatatataccacattttctttatccatttgtacgttgatggacacttaggttgattccatatcttggctattggtaattgtgctgtaataaatgtgggaatgcagctatcttttcagcatgctggtttcacattcttttaatacttacttttaatatttaccttatgattgctgaatcatatggtagttctatttttgttttgttttttgaggaaacttcatattatgtaggttgtttctttgctctggtgattgtttcctttgctgtgtagaagcttttgaatttgaggtaatcgcatttctctattttcgcttttgttgcctgtacttttgaggtcatgtccaaaataatcattgcccagaccgatgtcgtggagcttttctgttttcttctagcagtttcatgtttggggacttacatttaagtctttaatccactttgagttgatttttgcacatggtgtgcagtaagagtctaattatattcttctgcatttagatatatgcttttcccaacactatttattgaaaagactgtcctttccttattatgtattcttggagcttttgctgaaaatcagttggctataaacatgtagatttattttccggctctctatcctgttccattgttctatttgtctgtttttatgccagtgtcatgctgatttggttactgtagctttgtcaaatattttgaggttaggtagtgtgatggctccagctttgttcttttgctctagattgctttggctattcagggtcttctgtggtttcatacacgttttaggattgtttctactaatctgtgaagaatgtctttggtatttttataggaattacgtagaatctctaggttgcttaaaatacgaacattttagcaatattaattattttaattcatgagaaagagatgtctttccatttatttgtatctttttcaatttctttcatcaatgtttcatatcttaatagatttttaattattatttatcttctcttaatcttttttcctagtgcggtggtaccacagtggaaaaagccacaagtttctttaataacaactagttcaaagactctgggcagacttttgctctttttgcctccctgtaactatttcttgatcatttttcttctttaagtttacatttcacaaatgctgtatttacccctacctcccttccttccctccctcccttcctccctcccttcctccttcccttcctccctcccttccttccctccctcctccttcccttcctccctcccttccttccctccctcctccttcccttcctccctcccttccttccctccctcctccttcccttcctccctcccttccttccctccctcctccttctctccctcccttcttcccttccccttccctccctccctcactccttccctccctccctctctccttccctccttccttccctccatttctaaattacacgaagatttattaatcatttttatctgctttatgccatcatctttttagtgtgttctttgcctgtgttttgtgttctcctctggtatttttgcatagatgtcatgctggttcttttctgttattacttgtaatatttgcattgggtgagtttttttttttttttttttgagcttctagtttgggatggatggtcggtcttagtgatttggtgtgctgctcttaagtttgactttgtctctgttatcttcaaacttttgcttatcagcatcctcttctaggtttgggtctacttctggctagcagaacaccctggctcaaagtggaaggctttctgccatagattttgttgtgtatgaaatagtttatatctctttagctgactaaaatcaaaattatctgtttccctaaaacttagctctatttttactgtacttggtagctcttcttcatgtatgatggtttgggcttataaatacctagtttaatcaaagagggtatttcctttaccatttctcatcctccctgtcattttccatgggtttcaaaaaaattgaagggcagaggaattttttttctgtgttactaacatggaagtttttcagtcatagtctttaacttgagctctgccttttaatttgtcttcttgttattttatggttcactctccactgcctgctcattgcagaatgtgtgacttctctgcctcacaagcttgctccatttagcttagaaggtaaattgcaagtacttcaccggggccccacacgccatgtatgaaatggcccttgccacttatttctcaagtccttgcttttgttactcctttacattctagcaatactgagttacttgtatatctggtaggattctatgcaatttcatatctgtactccttttcacacgcctattgctattctgcctggagttcttctccttcctaacttacctaataagctcctctttattcttcaaagccaagttcagatgattcttgtttttctaagccttctttcacacttttcatactgaatcaatctccctgttctctgtgctacctctttgcctcatatatattttgatcattatatattttttacattataatcatttatttacatatttttctttttcactagattatgagttccctgaaattgttctttgtgtttccttcccttggcacatggcctggtaataatagggtctcaagtaataaattgaatcaacataaatggagagagtcaaacctgaataataatgatttaggcttagtaggagaaatatttttaaatgcatggcttgaatttttgttttgtattattttgctgcatttaagcaaaataaaatgtaaaaagtaccaaaataaataaaaacaaagcacaaacaaatatgaatattctgtagctaaaggactcatgatcaggaaagaagtgaagaggacagctataagaatgctagtaatagtttacactataagggcagatgcttgctccaagataaagtatacatggaggaaaaataaacagtctgggatacaaccacatgtctttcaggtgtggtgaaaagaataaccagagggctttcctgcatgcctcagttgtcaggtttaagataattatctctttttgggattgaacctctgttgttaaaataactacttatattgctgatttcagaatatttcttctctcctgagctaacttctttcccctccctctctctctttctttctttcttttttgagacagagttttactcttgtcacccaggctggagtgcaatggcgcggtctcggctcactgcaacctctgcctcccaggttcaagtgattctcctgactcagtcccctgagtagctgggattacaggcacccaccaccatgcccagctactttttgtattttcagtagagacggggtttcaccatgttggccaggctggtttcaaaatcctgacctcaggtgatccacacatgagctaactttttatgccgatttccagcaataatggatgatgtgcatgtctcagtagtgcagtgcagtaacttgttgcagtgaaaggtgaaatactgagtgaggatggaaatactccatatgtcttaaaattccacaaagccaggcatatgggagacattcaacatggaaactcaacatgactaattttcacaaaacactctgaaattgatattttatccactgcctggacatactgcagaatgcgtccccttgggactctaacggagccatctggaatttttcagatttaatatcagggctttgcttttgcacaaagccagcaaagaccttgcttcacaagctctccacttgagacatttagttgtcctttggcatgaattttactttgttcctgtagctctgtgacaaattaattgcaaacaatccaagacacgttttcacttacttctcatcagcaaacaccaggaggaaagatatttccttgtggctgattctagtatgacctaagcacctgaagaaattagctcatcttacttaaaatataggttctcttttagattcagcttctaatttcatttcacctctcattcaatactcccctccccaactttatttttaataataatggaggcagaatatgggtgcctgtgtttctgggtgcttttgatgtcctttggctctgagagtgtccacattataaccaattggagcttcaggcactttcaagtctctaggacttttccttgcagctggcctaggagcaggcaagcttgtcttaaggatggttttacagtaacatgatgactttttgggaagctccagaatgtgtcagtctgaatatcagtgtgatggaactgagattaattcaattcaacacattttaattaagggctcatctgttctaaataagatacagccttagttttcaagggggttacaacccagtgagaaaggctggtatgtggatgataaaaaataagggaatccagtgggaggataaatcaaccctacccagggaggccaaatggtgcttctcaggcagtgttgactagggattgtggcaggtttccgctcaccacccccatgtccatctcccagaagccaattttctttccaccaaatcttgggactctgtagttttcatgaaaaagtctactttaagagatttgcacagttgaaataaattgatactttgccactcattgaggttcaaggccttttctcctttaccactgtgtctttattctttactgttcactcacataataaacagtaatcttactaaccagtagataaagtcatatcaagcatcccaaagtagctaaaaattattttcaaccatttttgtattgactgaatgattcttgtcctgaggtttatcttcatgtctcataaatattagttatagtaattggcagctctattgccaaactcctgagtttatctttggccatttccctgctatggatttgagtgagccaatcattcagagaagaggactccttcaaaataggggaagtatgtgatgtcttgtctttcccttcgaaatttcaacaactctgaatataatgttatatgtctctctctttctcctcagaaaagaataagtgtgagtcaaagccgtagtcttcaagctggaggtgaattcatctccaaacttaggtctatactactcaaagtatttcaactagtagtcaactggggggaagcaagccttttagggttgatatgatttttcatttgagatctgattatcataattaaagcagaactcacatatagtttgcaaaagttgttgataaagttctgaggaacctcagtgattgccttctggcctcatgctgtttctcccgggttctgagacataatgcagcgaatagagggtcagctcactcaaacattaaattccatgaagagtgaaaacaaaaactggtaatgataagggtgcatgctatttcttttacctctgtctcaatttatactgttcaagtagatctctttgtatctacagacacccaatctaatgctttttttatatccctggctggagccatgtccttgggcaatacacatcacaggatttcatctatactacatttctatgagttctctttttttgtgtggtaaatctagacttagctaagtttgttgcagtcctaggacaccatgcatagactgatattttagtaacctgtaacatccaaccaatccaggtaagagttgggaattgttgattgaaatataccatgcaatcaacacattaattacactgtctactatattgactttccatttaattcaatttgagggtaaaattactatgaaattattcttgattatcattataattatcatataaaatattgatcatgcttattatttccttttaggtcaccagtctcttcagaagatcatggtaagaatcatctgtcttatttataccaattcaggattgaaacttgacccctggtctttgcagttcattgtcagagcaaataattgtttaagcaaatgtctctaagatattggctttgtggtttttgaatgtgaaatgtcaaacacttttaaaaacttaaatcaccctagctgaatttgatatctttcaaatctgttccaacccgtctggttgacgaatattgtgaagccttaatttattctgcctgatttcagtcccatcagcagaaactttttgtggttttgtggttttggactagtcctgtgctttttatgactcagatttttatccttaaaatgataaaaatttttgtggtagtttgtggtagatattccctacagtcccttccagaatggacattgggatcatgttccaatcactcatttgtgaagagcactctaaatctgaaaggaaggcaagcagtcagtggtatttgttgttacccagttgagatgaattgtttgcattttaagagacagctaattcactcaaaagagaaaatatctcattttgttccatctcacctttggagttgttcatttatccaatcagtcacaaaagtgttaagtgtctacaatgatcagttatgctatgtagttatgttttacaaatatgctatatggaactttggtttggggcccctttgtatcttacttggactttggaaattctctcataattggtatccatacctctatatttcttttccctagtacactgtataccgggctagcaccaaaatgatcgttccatagtaaaaatctgctccgatggcctctagaatgaaatctttccagccgaccaataattgtgttcagcttttcaatattgtattttagcatggactagtaagcactaaatgatggaatctttgtcttcctccactgcttattgcttcatttaccatcttttcccttctcctacccatgatctgttttccagccatgtgacaatacatctaattctacatcaaatttctggagctcaccatcttttctgccatctccctgcttttctccatactgttctctctgacaggatgctacttcttttgccatatagatggtttctatgcacctcacctcatcctctgtaagggcttgctgatctgcttatcgttgtgcctaatatttttctacattctagggcttaatgcgcaaatttcatgctttatttacctgttttccctattagactatgagttctttgatatagtttccaacgaagagcaaacaaggaaaaagtgtttattaaatgaatgaattaagaaaagggagaaggagttttaggctggcctcttctactgccacattgtgaaatctgacttagtactggaatgaagttgtgttattctctatgaagaatcatagggaaaattatgttcaggcccattaagtcaggatcaggcaattgaccacctaatggtaacctgctattatgtgctattttgctgattgctgttggtattactaggtgtttgcccatttatataggcccttgggcttccatgttcacattataaactagaagcttgtgtttggtttttattttgaactaggattccctttaatgacttttggttgtctttgccttcctgtctatgagaatttattcctcattcagacaaaaatggtgggtgagggaaacttgtgaattataatttgataatccactaggacttcttaagtggttatgaaataatagggggcatatgtcagggtcctttgaagtcctaaagggtgactactgacagaaagacttgcttggaagattaagagcacttcagaattgattattttaagaaccttatatgtgattagttgaagaaacattattgaaattagagggccattataatttcatggcttcaaaaaatttcttacatgttcatacctcttagtttgtttctgtgacttccaaaaatagttcaagtacataatgcaaaattatagtgatgatttacctaatcctatgtaattgttcatcattttctagcccatatattcttgaaaaaaagcttttttctttattaccagaattttctatccaccactcaaaatatatttccttctttttatacatttttaagagctcatgtgtactatggctagtataaaacctcttgaatgttatagcatcaatcttacatattatttgtacacaataatggcattgcaacacacttgtaggagaggtgagaagtagcaatttgtctttctcaaatttattggtagaaaatttaaggcatgttggacacatggattgtgaaattggaatataaaaccttacgtctcttgattttctattttgtttgctttcctcaaatagtcctccctctgtaataactagtcactttggctctaagacaagaacttattcttggaaaaatctaattttgcaacgtccaataaccctggtatttttcattcccatggtactcttgcatagagagcttaaatacagtggctttgtcctttaccttatcttgtttgttttcttttccttgtctgtaaaatggagctaatcataaactgcgtacctcatgggattgtagcaagttcaattgagaaatcatttgtgaaatcactttctgatttttttttttttttttttttttgagacggagtctcactctgtcgcccaggctggagtgcagtggcacgatctcggctcactgcaagctctgcttcccgggttcacaccattctcctgcctcagcctcccaagtagctgggactacaggcggccgccaccatgcccggctaattttttgtattttttagtagagacggggtttcaccgtgttagccaggatggtctcgatctcctgacctctcgattcgcccacctcggcctcccaaagtactgggattacaggcatgagccaccgtgcccggcccactttctgatttgttaaaagcaccccaaacatagtattattcgctagcatccaggcagtagaagaggaagcacaagtttatctgtgatgtttgctcgggattatgttccgcccttgaaaagtttaaagaggacgggagagaataaccgtttttttcattatcattaaattttctctggaaaccttttattacatcagggtgaggaggagtaaaatgtttaatacaccatttagcttatagtgccagagtaaaggctcagttgatgattagatgtgtggtcatatagaattggcaacacaaggtctaaatgacacataaactgtttctatatttatataatagcgcatcagggtcactaagaataaaggctaaattgtattgagtgcttattatgcagaagcactgtgctcgcatgctccaactgccttatgtcctttcatctttcacaaataacactctgtagtcaatgtatcacccccagtttcacagctgcaaaagcaggctcagagtgcttaaataacttgcttaaggtcacatagctagtaggtgagagagttaattttcagacccaattctaacaatcaaactcttaactctcttttatcggccatgtccctggaaaaccaaagacatgattgaatggatagaactatggagataattcttccctcctctaacaagagtatatttactactgtgtaagttaatttctttttaatgacaaaacagagcagaacaaaaataacaacttctccctcctgctggtaatgatttgtccctgtagaaaaaggaaataccaatgtcacattttctcataattagttaactgagtgaaactgaagtttcagggaaacctgccatgctaaaccccagtggaaacattaagttttaatgttacatctggaaactggagccctactccttgttagaagataagcttggcagtgattgattgcactgtcctctgcatttcctctgtattgaatgcctatcacttcgtcatttaaattgctcctggagccatctcctgggcccaggctgcttccctggctctgagaactcatcttcctttctgtcaccttagcctgcttattttacaggctccttggaatgctgcgcttaccgctgcttcacttactgctgctacctgtgccagcacactcagggcaggtcatcttccaactaatgtctgttcatttacaaaataaaaggcattagtggcttctcaaagaaagtgccagcaatctgctgcatgccccactggaacatctgaggcaggcatccctctcctgtcctacctcttagacctgttgtcaactatggccgtcacattctagggcagcttttttgttgcagcagtaacatagtggacatgaattgcagtaatggctatttggaaataaaattgtcacaaccacaatcactagtgtaaagtgttcaataatgaatccactgtcaggcttggagacggctgtacttggcagtaggttactgatatggtttggctgtgtccccacctaaatctcaccttgaattgtaataatccccatgtgtcaaggatggggccaggtagagataattgaatcatggagcagtttcccccatactgttttcgtgatagtgaataagtctcatgagatctgatggttttgtaaatgggagttcccctgcacaagctctctcttgcctgccaccatgtaagacatccctttgttcttccttcgtcttccgccatgattgtgaggcctccccagccatatggaactgtgagtccattaaacctctttcctttataaattatgcagtcttgagtatgtctttattagcaacatgagaatggattaatacagttatgcagtgaaacacactgtggcgtggcccaaactctttgaggcatcaatggctgtacctcatcaattcacttttctttcatgtatattactgaaatagatactattcataaaatatataaaatgttatctgctcagtttaaataataagcaaaacgaactactgtgtacttggccctcagactaagaagtaaaacatttgtaggaatttgggagcttcatgtcatttgcttccctaattatgtccccttccctctccttcagaaataactactattctgcctttttgttaatcatgtccttgtttcttcttgttttactacatatatgcatatcttacatatgaatggatacgtggatatataactcatatatgtattcctatatgtgtgtatatgtgtgtgtgtacatagttttatgtattttgaatttgtacaaattgaatcatgttgttatttgtttcttttgttcaaaagaataatttttgtgattcatccttatggatgagtgccatatgcatttcatcaatagttcatgttgtatactactctattgtatgagtatataccaatttatatatccaatctgctaatgaatatttacataaataacaggtttcttgggggtttgtttttgttttgctcttgcaaacaatattactatgaacattctcttttttgtaactcttcctcgtatccatgcgcttaaacctgggaatagcttaagttaggtggtagattatacacatatttaacttatagcattataacatgttgttttccagagtgatcattttaatatacactcccaacttcagtggataagagttcccattgatctacatcctcaccaacacttgatattaactaatttaaaaatgtttgctagtcttgtgaaagtatgaaatggcatctcaatgtgattttaatttgtagtcaatgattacacatgagatcaaacatcttttcatatacttatgggccatttgtgtttactcttctatgaaaggtctttttatttcttttactcacttttccccacctggttggttgtgttcttcttaatgatttatgaactttttaatgtattctatgtaaaaattattttgtttcctatgtgtgttgcaaattttctccagtttgtggcttatctgttcgagctctttttgatgtcatctgatgaatagatggatattctttattttactgcagtaaaatcattaatgttttctctatggtttatgcctttggtattttttaaagaaatctttcaaagcataatcataaagatattgtcttgtaaaatttttagaatgctttctttaatatttgataacttggaattgatttttgtggtttggtaagagataaaggtcaaatttaattttgattctgttcatatacataactagctatttcattttcattcattttcttcactgacttacaaagtctgtcgtctccctgtaaatgtgagtctctaggttctattttctgttatattgatgaatatatctatccctgtgctattgttttagttgttataactttggtatgagtccagatatctgttggaggatatatcctgtaatttgtcctttgggagtgacttggttataattgagttttgcctgtttcatataaattataaaattagcgtatcaaattttgtggtgaaattttttatgaaaattgcatgaatctataaatttgtataaagaaaattgatatttctatgataatgcatcattctattccaagccacatctcttgacatttaattggctttttcaaatggctatgaatagagttttataatttccttcatgaaggatttggtcatttttgtgttaaatatattcctaggtactttatatttttagtgacaatttgtatgttgtatttttaaaattatgttttctaagtagtctttgctggcatattgaaatgcagttgaattttaaaatcttgtttctttatcaatattcctgctaaagttttaaattcataaatcttatctgaagcgtctttttgtgggaagagaattctatataggcaatctcatctacaaagaattttgtttcgtcctttccaatcattatgctttgtatacatatttctggtgctttctgcactggttaaaaccttcagtgcagtattgactagtaacagagatagtcagcatcattgacttgttcctgatcccaaagtgagtgccatccacaagtcacaattaagtaagaagttcactgccaggtggtcatgatgcaggtgacagtacttgttttgtggatatttcttataaggatcttttccttcgctctaatttgttaaattcaacagatgttgaattttatttaatactcttttcttcatcttgagagatgacaatttttttccccttggtctgttaatatggtgcattttactaattgatttttaaatagaaatcaatatcgtatttatgagaagaactcagattggttcttatatttaccgcctttatacattgctagatttgatttgctaatattttgtttagatatttacatccatgttcataagtgtgattagtctttaattttgctttctattatgtagtatgtatatgatattcatagcttaaaatgaattaggaagggtttcctcttttataatctctggaaggctttgtacaatacttgagctacctatttctggaatatcttgtatatactactattattttcattttacagatgagaaaacatgcctattgagtaaaaggtagaactaggatgtgaactcaggtgatctggatccagatccttttcttaaccatttctctgtactgtctgtcaatagcattgctgaaatttgagctggtgtaataggaaatcatgatattatttgttaaataaagacctcataattgtatgaggtctttttattgggtagaaagtgattattaaagatgggaattttttattcatgtaagtaagaaaaacccttgacacagaaaaacattcaaagatatattttggatccacttcttgtagccccatacttcataatcaagaaaatagggttccaatctcctgtcaataacattcatttttttaaatagtagagttctcaaaaggtagctattcccttaaagagatatcacaagtaggaagataattattatgaccatgatgactacgagtaaagaagattaagaaagttagatactggctgggtgctgtggcctacacctgtaatcttagcactttgggaggccgaggcgatcacctgaggtgaggagtttgagaccagcctagccaacatcgtgaaacctcgcctctgctaaaaatacaaaaataagcctgacatgatggtgcatgcctgtaatcccagctgcttggaaggctgagggaagagaagcatttgaacccaggaggcagaggttgcagagagccgagatcgtgccactgtactctagcctgggctacagagcaagactctgtctcaaaaaagtaaacttgactgatgttacagatggaaatatgtgcagatctttaattgcattgctaggtagagcctactgtactgagcgtcacagtacatcactttgcaatgactttgggctatcataaatataaagttgctagagtgtccttttttttgccccatatcagatttttcctatagaatccccgttgtaaaaaacagtgctcatttttgaggctctttctcttcccgctttagctcatgttgctttcgagctttagagagttacttctactctgcttgcgggaccctctctagacctcgcctttcttgtctttatttagccataagctttctgtcacctcctaccatctctctggcaggcaccttcattgtccttcatgcaggtctcacctcaatgctcattaatttccgtgtcttggaaccacctctatagacgctaaggacaaacaaagatgaattttcctgacaacttaaatgcccatgatttctccttccttattgcctgttttgtttttttgagtgtgttccaattttctttcctcatgggtaatgttgctcttcttatttgactataaactcagtgaatagagacattgccctattctgtgctgtgccctggcacagaactgattctctctatacaagtcttactgttaaatttgctgcagtatgtggtgttggcaaacagaaactttcattacacatctttgaatcccattgcagcctcattaatattcttccctgttgtagaagataggtcactcctggtctttttccagagattcagttactatgtgctgaaaagatggccttttgtggtagtctcagtgggtgttccctatagactgtgttttgaaaggaaaagaataaaaatgatagcatattttttcttagttagccttctttcacaaatcctaggaaaatagataattcactgctgattaaaaaacagaacaaaacaaaacaaaacaaacccccctgggctttccaaaatctggttatattgctttctatgtgtcctgaccctactattatctgtcatttacctttactaaatctcactattgattgtaaccatgtaatccttttgattgttctggtttttctggaatgctttgttggtgataattatctagttgtcttttgaaggttgattgtaagtggctggagaagatgagggaatactcttttttgtttgtttttgttttgttttgagatgaagtcttgctctgtcacccaggctggagtgcagtggcacaatctcggctcactgcaacctccgtctcccaggttcaagcaattctcctgtctcagccttccgagtagctgggattacaggcgtgcaccaccacgcccaggtaatattttgtctttttagtggagacagggtttcaccatgttggtcagcctggtctcaaactcctgacctcaggcaatctgcctgccttggcctcccaaagtgctgggattacaggcatgagccaccatgcccagctgcgggaatactctttattaaaatttacctacagcattgcattgggttgcttttggggttatagaatatttaagttaaaatattaacacattgtaaaataaaaaagtaacgggaaaaaaggagttagaaaaaggaagagagctggtgtccaagtcctagtttacttttttttttttttttgagatggagtttcactgtgccacccaagctgtagtgcagtggcatgatctcagctcactgcaacctctgcctcccaggttcaagcgcttctcctgcctcagcctactgagcagctggaattacaggtgtgtgctaccatggccggctaatttttgtgttttttactagagatgatgtttcaccatgttggccaggctggtctcgaactcctgacctcatgtgatccacccgcctcagcctcccaaagttctggcattacaggcgtgagccaccacgcccggcccctagtttacttttaagtggaaagatgagaaggggccatcagacaaggtgatgtgtctggcaacaagtgaagagatcatagatttcatttccacagataagtcaatacagttatttaggaaatgagaaatctctgactctggtctttgtgtaatattctatgatagcagaaacaaaaaattgaattgtgcctattgttaaaagtttactttgtttatgatttctactgtatgaaattatatgatctgggttatattaacacccagtgaaaccaaggggctgggttggtacactgaaagttattataatataattctcatgtgaggctaattgttactatatttgtttttaatttgactagaaatcccaatatttaatcaaaagtcttctcctctacctagagcttgttttatcgttttggtggcctcctcttgcaaaggactggctggtgaatggtttccctgaattatggacttaccctaaacatatcttatcatcattaccagttgcaaaatattagaatgtgttgtcactgtttcatttgattcctagaaggttagtcttagatatgttactttaacctgtatgctgtagtgctttgaatgcattttttgtttgcatttttgtttgcccaacctgtcaattatagctgcttaggtctggactgtcctggataaagctgttaaaatattcaccagtccagccatcttacaagctaattaagtcaactaaatgcttccttgttttgccagacttgttatgtcaatcctcaatttctgggttcattttgggtgccctaaatcttagggtgtgactttcttagcatcctgtaacatccattcccaagcaagcacaacttcacataatactttccagaagttcattgctgaagcctttccttcacccagcagagcaacttgattttctacaacttccctcatcagagccacaagagtatgggatatggagaccactaaaactacatccctttggccttaccagggaaatattgggaaggaaggaccttgtattactacctaatgaccccatagtattgtttgacagtctatacaaccagatgagcaggcaaggtagtaccctgctaaagagacaggctttctcatatctcataaatatttcacatcctggttctacatgctggttttattccatattagccatgaggtcttcagcaaattacttaatgtcattaaacctcaatttcttcatcctgaaaatgaggatgataataataagagtatatatctaataggcttattgtgaggattaaattaggtaatataggcaaagacctagcatacagtttgcttacaaacatcaacaaaagaaagagacaggaagagatgaagtgtgcaagagagagtgagagcaaccatcaatgtcagacagccaaaaaatgggcatatagatttttttataaatagacctcatatgtctcatttgcatgggcttttgggatgattaaagcctattgttctctaggattacttgaaatacacatttcctgcaggttacagcccaatggacacagaatgacttgtgtattagtccatccattctcacattgctatacagaattacctgagactgggtaatttgtaaagaaaagaggtttcattggctcatggttccacaggctatacaggacgcatcgatggggaggcctcaggaaacttacaatcatggcagaaggcgaaggggaagcaggcacatcctacatggctggagcaggaggaagagaaagcaaagggggaggtgccccacatacttttaaacaaccagatctcgtgaagactcactcactatcgtgagaacaccgcaggggaaatccacacccatgatccaatcacctcccatcagacccctcctccatcactggggattacaattcaacatgagatttggtggggacacggatccaaaccgtatcaacttgtatcattctgagtaattgcaactttcgaatgggtggtagggttggcaattgccaaaagccatggtttggagtcacttgcatcaggcctgggtttccccctggagcaggctgagcttggctgccttctaaggcctcttctgctctggacatttacaggcttctgagccaggagagaacactaagcaatgaaacacaggaggaaaaattaaaaacaccacctttaaattttggaaagtattttggagatacctgtgccctgctctctaaggagttcctgtagggatttctgcttatgaattccagtatattgtttctctttgggatgacaaatggagtttctgttgccacaccttgccacagacccactttttgaaaaacactaaaatccactttgcaagtgtataaatattgcaggcaggcagcttccacattctttggcaagggaacaaaatactatttaataatgcaggttccagcttttctcctgacaatgcaaagtgccaatgattattgaaaagggaatttgaaatctgccagaatccactcagttttccttgtgtggttacatttccatcctgtcaccctcgctagtgaagacaattgtttcagccattgagaaaaaaaaaaaaaaggtattttataagattgcaagaaagtgatttaaaccatgactatgtctgttaactgtttgctttgtttctctgactgtgtgcctctctagtcacccaatcttctttagctatcctgtgggctttttcctgttgtcaaaaagcatggtctacccaaagccattcttcaagcatctgatttcccagctgtctttctgctatatatttaaacttctagttctctttggggaagagggtggtagacttgtgtgaggatatagtctgaatgaagtctccgagtgattttttgttgatgttataggggtgggagttcggggagaggagggagagtctttggcctcacactcccctctgagtcctgaatggggttctctcagcatctcattttcccgctattcctgacacactcctccctgaccctattttagaggtccctgttatcaaatggaagtgcttcttatgtcttccttcattctgctaagctgactgttctctatagaaatctgtacccccagcttttctaccaatgcgaatcttcgtttttggaaaatttcttttaccttctctaggaaatcattctctacatcactctatttctttagcaatcagggactacatttggatgtataagtatatacatattaagtttctagatattctttttctttttttaaaattattttttattttattattattatactttaagttttagggtacatgtgcacaatgtgcaggttagttacatatgtatacatgtgccatgctggtgtgctgcacccattaacacgtcatttagcattaggtatatctcctaatgccatccctcccccctccccccacgccacaatagtccccagagtgtgatgttccccttcctgtgtccatgtgttctcattgttcagttcccacctatgagtgagaacatgcggtgtttggttttttgtccttgtgatagtttactgagaatgatgatttccaatttcatccatgttcctacaaaggacatgaacttatcattttttatggctgcatagtattccatggtgtgtatgtgccacattttcttaacccagtctatcattgttggacatttgggttgcttccaagtctttgctattgtgaatagtgccacaataaatatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgttattttcttgtaaatttgtttgagttcattgtagattctggatattagccctttgtcagatgagtaggttgtgaaaattttctcccattttgtaggttacctgttcactctgatggtagttttttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccactttcagctttctgcatatggctagccagttttcccagcaccatttattaaatagggaatcctttccccattgcttgtttttctcaggtttgtcaaagatcagatagttgtagatatgtggtgttatttctgagggccctgttctgttccattgatctatatctctgttttggtaccagtaccatgctgttttggttactgtaggcttgtagtatagtttgaagtcaggtagtgtgattcctccagctttgttcttttggcttaggattgacttggtgatgtgggctcttttttggttccatatgaactttaaagtagttttttccaattctgtgaagaaagtcattggtagcttgatggggatggcattgaatctataaattaccttgggcagtatggccattttcacgatattgattcttcctactcatgagcatggaatgttgttccatttctttgtgtcctcttttatttcattgagcagttgtttgtagttctccttgaagaggtccttcgcatcccttgtaagttggattcctaggtattttattctctttgaagcaattgtgactgggagttcactcatgatttggctctctgtttgtctgtcattggtgtataagaatgcttgtgatttttgtacattgattttgtatcctgagactttgctgaagttgcttatcagcttaaggagattttgggctgagacaatggggttttctagatatacaatcatgtcatctgcaaaaagggacaatttgaattcctcttttcctaattgaataccctttatttccttctcctgcctaattgccctggccagaacttccaacactatgtcaaataggagtggtgagagagggcatccctgtcttgtgccagttttcaaagggaatgcttccagtttttgcccattcagtatgatattggctgtgggtttgtcatagatagctcttattattttgagatatgccccatgaatacctaatttattgagagtttttagcatgaagcgttgttgaattttgtcaaaggccttttctgcatctattgagataatcatgtggtttttgtctttggttctgtttatatgctggattccacttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcgtggactctttttggttggtaagctattgattattgccacaatttcagctcctgttattggtctattcagagattcaacttcttcctggtttagtcttgggagggtgtatgtgtcgaggaatttgtccatttcttctaggtattctagttgatttgcgtagaggtgtttgtagtattctctgatggtagtttgtatttctgtgggatcagtggtgatatcccctttatcattttttattgcatctatttgattcttctctctttttttctttattagtcttgctagtggtctatcaattttgttgatcctttcaaaaaaccagctcctggattctttaattttttgaagggttttttgtgtcactatttccttcagttctactctgattttagttatttcttgccttctgctagcttttgaatgtgtttgctcttgcttttctagttcttttaattgtgatgttagggtgtcaattttggatctttcctgctttctcttgtgggcatttagtgctataaatgtccctctacacactgctttgaatgtgtcccagagattctggtatgttgtgtctttgttctcgttgctttcatagaacatctttatttctgccttcgtttccttatgtacccagtagtcattcaggagcaggttgttcagtttccatgtagttgagtggttttgagtgagtttcttaatcctgagttctagtttgattgcactgtggtctgagagacagttttttataatttctgttcttttacatttgctgaggagagctttacttccaactatgtggtcaattttggaataggtgtggggtggtgctgaaaaaaatgtatattctgttgatttgggttggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatgcatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctgtgtgtgtcactgcacatgagatgggtttcctgaatacagcacactgatgggtcttgagtctttatccagtttgccagtctgtgtcttttaattggagcatttagtccatttacatttaaagttaatgttgttatgtgtgaagttgatcctgtcattatgatgttagctggttattttgcttgttagttgatgcagtttcttcctagcctcgatggtctttacaatttggcatgattttgtagtggctggtaccggttgttcctttctatgtttagtgcttccttcaggagctcttttagggcaggcctgctggtgacaaaatctctcagcatttgcttgtctgtaaagtattttatttctccttcacttatgaagcttagtttggctggatatgaaattctgggttggaaattcttgtctttaagaatgttgaatatcggcccccactctcttctggcttgtagagtttctgcccagagatccgctgttagtctgatgggcttccctttgtgggtaacccaacctgcctctctggctgcccttaacattttttccttcatttcaacttcggtgaatctgacaattatgtgccttggagttgctcttctcgaggagtatctttgtggcgttctctgtatttcctgagtctgaatgttggcctgcctttttagattggggaagttctcctggataatatcctgcagagtgttttccaacttggttccattctccccgtcactttcagatacaccaatcagacgtagatttggtcttttcacatagtcccatatttcttggagtctttgttcatttctttttattcttttttctctaaacttcccttctcgcttcatttcattcacttcatcttccatcactgataccctttcttccagttgatcgcatcggctcccgaggcttctggattcttcacgtagttctcaagccttggctttcagctccatcagctcctttaagcacttctctgtattggttattctagttatacattcttctaaatttttttcaaagtttttaacttgtttgcctttggtttgaatttcctcctgtagctcagagtaatttgatcgtctgaagccttcttctctcaactcgtcaaagtcattctccgtccatctttgttctgttgctggtgaggaactgcattcctttggaggaggagaggcgctctgctttttagagtttccagtctttctgctctgttttttccccatctttgtggttttatgtacttttggtctttgatgatggtgatgtacagatgggtttttggtgtggatgtcctttctgtttgttagttttccttctaacagacaggacccttagctgcaggtctgttggagtttgctagaggtccactccagaccctgtttgcctgggtatcagcagcagtcgctgcagaacagcagattttcgtgaaccacaaatgctgctgtctgatctttcctctggaagttttgtctcagaggagtacccggcagtgtgaggtgtcagtctgcccctactggggggtgcctcccagctaggctgctcaggggtcaggggtcaggggtcagggacccatttgaggaggaagtctgcccattctcagatctccagctgcatgctggggagaaccactgctctcttcaaagctgtcagacagggacatttaagtctgcagaggttactgctgtctttttgtttgtctgtgccctgcacccagaggtggagcctacagaggcaggcaggcctccttgagctgtggtgggctccacccagttcgagcttcctggctgctttgtttacctaagcaagcctgggcaatggcgggtgcccctcccccagtctcgctcccaccttgcagtttgatctcagactgctgtgctagcaatcagcgagattccgtgggcgtaggaccctccaatccaggtgcgagatataatctcctggtgtgccgttttttaagcccgttggaaaagcacagtattagggtgggagtgacctgattttccaggtgccgtctgtcacccctttctctgactagcaaagggaactccctgaccccttgtgcttcccaagtgaggcaatgcctcaccctgctttggctcgcgcacggtgcactgcatccactgtcctgtgcccactgtctggcattccctagtgagatgaacccggtacctcagatggaaatgcagaaatcacccgtcttctgcgtcactcacgctgggagctgtagaccggagctgttcatattcggccaccttggctcgacccctctctttttcttaagaatatatgaattcctatgaagaatgaaggtttagtcttgatttcatttcccttcctatcaactggacaataaaaatttgatctttaataaatataattgaagacttactgatacactgaagcctattctatttcaaattaatgttttatgtcttgggcatgcttcagaagtaaccatttacataacaattcttctaaggcataatgttgcttaatcaatttagcatgatatagtgaaagttaagatttatttttacttttctgaaataaaatgcttaatttttatattcttccaagtaataactgtcatatgcttatatggggaagattcaaaattaatgttttattataacccagtaggggtgggtctaggggagggatagcattaggagaaatacctaaagtagatgatgggttggtgggtgcagcaaaccaccacggcaagtgtatacctatgtaaagctgcacattctgcacgtgtatcccagaacttaaagtataataaaaaattgataaataaataatgcaaataatctatatttacaataataagtgagggtatgctcttgacattttatttattttttaattgtacacttttgccgtatgtgcattttgctggtatgtctctgaacatgacctttgctaaattaactccttcctgactttacttttgttccagtgaggggtgtttggctgttcttctttttggtttaaaaagcctttatattacagagtggtcagtttgctgctagtcactgagaagaaatgtaatgtgtatcctgatgactggatgacttataagcttataatctttttgagctctagtacatacttaactgtacttggcttctgaccttaaacatcattttccaaacagtcttgatgtttggtaaaaccagtaaccatccattactctcaggccacatcagacctgcttacagatatcactgggtgaaacatgagtacacttgttcaccccaagttcctttcagaggccttgaaggacactgctaaaacacatccagtgagttcagggaccctgatcacaggaagaatgcctgcctgatgttggaggaaggggtaaagccaacgcctgaagctttctctgtgcttctctgtaacagtcaccagagctacaggccagcagcacttttcttttacatggcaccttcctctcatttgtggggaaaataaggactttattagttcttccatttctcttaccctctcaggattatagctttatcatccaaatgccaggaaagtaaaacaaaacaaagttagacaatctaaattaaactctctcaacattatagggatgaaggaccttcagagtactagaacttcttaaaaaaaatctcttgcattgctacatcagtttccaacacacatattatttcattcaaatgttaagaaggggaaaagaatgttacagtgtactgtaattattttaggttcatgatgaaaatgctttacaagggtgggcgcggtggctcacgcctgtaatcccagcactttgggaggctgaggcgggtggatcactaggtcaggagatcgagaccatcctggctaacatggttaaaacccgtctctactaaaaatacaaaaaattagccaggtgtggtggcgggcgcctgtagtcccagctactcgagaggctgaggcaggagaattgcgtgaacccgggaggcagagcttgcagtgagctgagatggcgccactgcactccagtctgggtgagagtgcaagactccatctcaaaaaaaaaaaaaaaaaaaaaaaaaaagaaaagaaaaagaaaatgctttacaaatatgaaaactcctccctggttttttttgaaagcttaatgtttgtctaacaaaaccgtaaataggattctataatattgatgttagaaatgaatttatatttttctagttttaagggaatagctgtatattactttagatggtggtactatataaaaatatgttttcccattacatccaaaggtgatgatattaatttattgctagagaaagaattgatattgagttatagagattttccagaaggtattttaagaccctttgctggtcctttgtgactggcgtcatgtatgttacacagcaggttgaaagtgacatgctgtgattctggaagagtgtgagtctattggccctgtaacccatgagcttgttttcactaacccagtgctcaaagcaaattaattcacccacgaagtttgctttaacacttatctaagcgttactatcaatgttctaggaagtaacaagtatcattgctgatatacagctctgagttgactcataaacatttctgatctcatgagatagttgcagtggtgttttgctgtgtttactagatgcaactaacaaacaccatgagatttacaaagagatttgaagatatctgtgtctccaaaattgattgcaaggtgtagcaggggccagtaaggtgagctttcttccactccctagaatgtcttcctcaatccagattttaaagtgtattgaaatgatagccggctgaatcaccaggtcgaaaggatcaaccaactatttattaagcacttcatgtattttctgtcccatagagatttcagtgaaagatatagtgtggataaaacaaagagaaaaaagtgtcctcatgcttatgacttaatcgcagaagtggaacttagacatgtgaaacaattaaacaatttcacaacaacagataagcaaatgggatgctttggagagacatctggtccctgtgctgtttatagccaattccagtggtgaataaaagaagtggaacgaactgcttttgaagggagtgcatcctgatcctctggcagcaaggtagaggttttctgccaggagggaacactagacggaggctgtttgttttttctccaaacagaaatctcttccatgctaataggagcttcaaaaggattgccacagcagatggaaagaaccaatatatattcatgcatttaattagcaggaattaattgaattgggggattaattctgtcattagagagaaacaaaacctatttttgtctcccatctatggttacacaatctaagatggatttggcacaggtggtgtttgaatataaagccaccgtagtatctaatggccttttgatgccactgatggattaatcccagggatgatgagaaggtagccatgtgagatgtgtgctctgcaccatgtttcagcagtggaggagaagctggtaggtggagtgtgaggggtataaacctagaattcagtgagtgtttgaaggaggaaaaaggggaggagattgggagagtctcttctcttacatctgatttttttttctttttctttttcttttttattgagacggaatctcactctgtcactcaggctggagtgcagtggcgtgatctcggctcactgcaacctccgcctcctgggttcaagcaattctcttgtcttagcctcccaagtagctgggactacaggcttccaccgtcatgcccagctaatttttgtatttttagcagagacaagtttgtaccacgttggccaggctgatctcaaactcctgacctcaggtgattcacctgcctcggcctcccaaagtgctgggattacaggcgtgggccacagtgctcggtcacatctgattattaatgagagattaaggacagacacacctaagacagaatttttaattcaatctaacaagcacccattgcctggtcttccccctgcttttctttttttttttcttctccaaaaatctgttcctccagaaaagcagttttcatcctttttaatttttaggccaagatactcatgacataaaccagatgacattgtatgcataacacattcccataagtgacataggtaaaaagactgttgattatacccctttcccaacactgacaagtcaacaccagccctccgactcaaagcacatcacaattcaagtatatgatgtgacagtttgtacttttcaaaaatagccatggcattttctcccacctacacactcatcttgcaatgtgactttgatgctctttccattgaaatgtgggatctacgctctctctccttgtatatgcgcaaacgtggacttcagcaggaatgataccttgggatttccaaggcgaggtgagttgatcactgggctctcttgggatggttgcttttggaacccagccaccatcttataagaaagcccaagaagcacacgggaagcccaggaatcccacatgagaggatccaaggctcctagccgataccagtacccagttactagccatgtgtctgatcatatttgaactggatctttcagctcttagtggagcagctccaactgctgccaggtataacaaagacaaactatctctgcagaacgctgccccaaatgcagatttttgagcaaaagaaataattgggttttaagtcatatactttaccatgcaataatagatagttgatacagagttgcatgtcattagaagaataatcttaaatctgttctaatatgttaaaaaccttcagtagtttaacttttattataacaaataatttgtcacatgtctttttactgattgtgaaaaagtcctctaggcctagataaaaatgcagaggtctttagaaatttatataattcattctttttctcacctcatcttggacttattcagtatgcctatgtagaataatattaattacagtcatttttcttgagctgcttcccatttatgcctcattagcataattcacagcggtcatccatacctgtgaattcgtgttagattacctttgctgtgtttgatgattatactaaatttcatttttttgcgagctaagccttcacagtttgttgctcatgtaccatggctggctgctcacaaaatagaaaaattggacagaatgtttctgataaggtaaatacagcaaaggctatgcagaaatatgtatctcagagagtgagctatggggcagctatggtataagttatctggtagccacgcaagaagtaacggattgaataaaggcaaactatgaagacttcagtcatgataagatcaagagaattatttgtgtcacatttgcgatggattttgtctctgttggcacacacaaaaagttgggccttaaaactgtaaatttactttaacttcattttgtatgtcatgcattcatgaaactttttccgggggttattttcatttttggctgtcctgctccaagttaaacagaggagaaacagcatcatatagtggaagaaactcagacctggggaaggggggaggcaagtaaatgaaacaagagtcctttgtctctcagctggattgctaagtaatctgtgtgatcctgcaaaggtcagttcagatctcaagccctactttcctcatctatgaaatgaaaggttagactaagaccaaatacacgctagaaagtagagtattattactcctcaagaaatagtttagggttgtgactcttgctttgcacatgaaaatatttaggagtaaaagttcacagaacttggcaaagctagatgcatttatgattcccagtgaatcaactgatgtttttccctacgtcttttcaagccattctttgtttagcagtttttatatttacttttatttttttcttctataattttggaaaaaaagagttagctgactgctactatgggcagacaacaatgtggtaataggatattatttttaaaactaaaaaaataactgaatatgaaagatcaaacttttaaaaaatagacataagtgttcagagttgtgattctattttgcatgtaacaatgtagttatttcagttgctttattgagaatcacaaacatatatatatggctttgccaagttctgtatactttttattccccaatattgtcttctgtacagcaataattacaaccttaagccatcccttcagaagtagtcatatgccaacttctaccttagtctaaaataattctttttctgtgtgatggggctaaaaacatcagttctccctgctgctctccacagatgtccaggtaccttaatggttaggttctctgtaccttgagcttatttgcaaggcagagcctcaaaagaactgctttttaaatttttccactgatagaactggagcttggtaaactaacttgcccaaggtcatagcagttagtgatactcacaggacttaaacccaggaggtctgaatgtagactcaattatggcatatcccttcctaataataagccagattttgttttgtacttcttgccaaaatgtaactccatgatgacatttgttttgtacattgctgccttcttactgcctcaaacggggcctggcatggtgggaacaggtggggatcttagtctgttcctgctgctaggacaaaatatcttagactggatcatgtttaagtaatagaaatttattgctcatggttctggattctgggaagaccaagatcaaggtgctagcaaattactctctgcttcaaagatggaaagctcttgctgcatcctcacataatgggaaagcaaaaagaaatgaaaactgtgtcctcacatggtggaaaagatagaaaggacaggcagctttctcaaggctcttttagaagggcattgatttccttcatgagggtggagccttcgtgacttaatcacttcctaaaaggccccacctcttaataccacactggggattaagtttcaacatgaattttggagggtttatacaaacatacaaatcacagcagctgtcttctccctttcctgattccacatgacagaagccatctcttccttccgcacatggatgtctgagcacatccagactcttgagagcccagacttaagagagagaggctgtgagaaggaagatggcagttctctcctggaagtcttgacttctcagtcccagttttctgtgttggtatgtgtactgaaaaacaatttatttgaagatacagcatagaaggaaaaataaaccatttcctatgaagtaatgattcaacttctaacctgtaaaaatgaaaaatttctcagttccctacgcccttgcattcctgtcttcataagtttgtgatttaattttccaagaaacttaatattcatatacttaaaaacttttatatccattaacaacttgactttccctgcttctttgaattttggagcattgtttccttagtatgaaggagttttgagaaaggcaagaagacaagctcagagcttaagaaactatgaagaataatattgtaatcataacaactcattatttgtttttaagctcaatccttcagaaggttattatctggagttgaataataatagattcaggctctttttatgtggaggaaatcttaaacaacagtgttcatagggaaggacattaatcaggagagagaagtgagccttgtttctaataatgtttgcataatagctacccttgggtgtattgcttgacttaaaataaatattcatgcttttcacatccagtacaattggaaactactcgtggttatgattctgtcatatgatcttctacctattcaaggggacttcaaactgggaagctgttggaaaccaacaaacataaataacaatgcttgggagcgatatggggtacaagctgaaagatgctataatgttggctatggggagaaaaggagcgaagagtaggaacttaactgtttccagagggggggaagcagactcacactgacatgcttaaggacatttatatgctctcctggtttgcttttagctcttcaatagcttctcatcaccaggagaataaaatttaagtgccttatcttggtgtcagactcactccttggagtggttcctgtgaaaccttggatcgcgttacctgagactactctccacctcagatgtggcaacacaaagctctttgcagattccctcagacaccatgacttacttttatctctttgttcacatccttccttcatcttgcgaggatttttcaaagcttctttgttaattaatctatgtatcattgaagagtcagcttaaacttcacctgcttcaggaagccttctatgaactccacacctagtcaagagttttacccagactgtcctatttttattaacttatatatttagtgatccttaaatagcctttgtcctggggagttttttcatcatcttgctttattgcttacatgtacctaattttattacataaatgctttcagttagttaattcatttttctttccttttctgtctcctttctcctttctttctctgtttctctctctctctttttattaacttttaaattctgagaaatgtttcaatacagtcttgagaacataggctattttgttgttgttttttttgtttgttggttggttttgagacagagtctcactctgtcgctcaggctggagtgcagtggcatgatctcggctcactgcaacctctgcctcccaagggttcaagcagttctctgcctcagcctcctgagtagctgggattacgggcgcccaccaccacacctggccaattttttatatttttttatttttagtagagacagggtttcaccatcttggccaggctggtcttgaactcctgacctcgtgatccacctgccttggcctcctgaagtgctgggattacagatgtgagccaccatgcctggctgagaacataggctatgttttgaacttctgtgtgtgttacaaggctttgcattaactgctccctcatgcaactttcctaaccttctttctctcctattagagacattctgcttcagtcaggagaacatcctatagtattaaagtccaaactgatttgttctcttggacctgtgattgctaatacagctgttactcagtatctgtgggggattagttccaggaccccttgcagataccaaaatctacagatgttcaagtccctgatctaaaatagctcagtatttgcatatagcctttgcacatcctcccgtacacttcaagtcgtctttagattacttataatacctaatctaatgcaaatgctatataaatagttgttatactgtatttttaaaatttattgtaatttttactgttgtatcattattattattttttgaatgttttcgatgtgaggttggttgaatctgcagatttggaacctgcagatacggagggctggctttactttccccagcctctccttccttgtccttcaacgcagggtttttgataaacaccacatccttggctcattatctgtgcttctaatccgatgggttctatattaacagagatatgtctgcccagcttcacatgccaattttacccttattggtaggctccttctgaaggtccatatgtctttttcatgtacttatgtgcagtcacaaaatactgaaaactgtgccttctgtttatataacatacctatttataaaacactttaaaaattttatcctaactaccgagaggtgagcagtgcagctgttaacctcatttgcaaatggagaattggttcaaaacgattgaataacttccaaaatttatgtgtccaataaattgtagcgattagaattagactccagttgagagcattgttcacattacaaacctgacaacagtgtttttttcactgtctgtaggccttgcagagcctagtagagttctgtgcatgatgaactcaatgggggcactggacacaggctcacacagggtctgtattatggtgctgatttgggcctctatacctccagagaattaagttactttaaactccactatggacatttataaaaggaagagtgagaccctgtgttttcatagggttttttttttttttttacacataacactttgttaattccctttctcttattttcatctctcttttcttctctttttctgttttcttttcagtcagttcaacaattaattggtgtgcacctacaatgtgcaaagcattatgctagggttcacaggggaatgcaaagaggatgctgcttatagcttgttatggcgaggcacttttcttctctccatttttctccattcttctcttcttcctaccttctttttcctctgatgttcaagtagccctcatcatttctataaatttccaaggcttcagcgttggtcaaagggaaggcactcagcccaggggcagtgagtaagtttaacattcttatggtcctttgcatctgctcacccaggactcatacatactcaatataaaagctttgggggttttgctcagtgacagctggggactctatgtaatttaatgcatgatacagcacttttggctaactctgtatgagagactactcaaataggaataaaatatcactttgcaaaatacatttaaattatttttcttctaaaactttgtgactttaaagccttaaaatctattttttgaaagccaaaaaataacagatgttggtgaggctgtggggaaaagggaatgcttatacactgttgttagaaatttaaattagtttagccactgtggaaagcagtttggagatttctcaaagaacttaaagcagaactaccattcgacccagcaatcccattactgggcatatacataaaggaaaagtaatcatcctaccaaaaacacatatgtactcactgttcatcttagtactatttacaatagtaaagacctggaatcaacataggtgcctatcagcagtggagcagataaagaaaatgtggtatatatacaccatggaatactacacagtcataaaaaagaatgaaatcatgtcctttgtaacaacatgggtgcagctgaagaccattatcctaagtgaattaatgcagaaacagaaaaccaaatattgcatcttcttacttgtaagtgggagctaaatcttgggtactcatggacacaaagatgggaacaatagacactgggaactctagaaggagacagggagggggacaaaggctgaaaaacctcttgttgagtactatgttcactgtctgggtgacaggatcaatagaagctcaaacctcagcgtcatgcaatatatccttgtaacaaacctgcacatgcatcccctgaatctaaaataaaaatgaattttttttttttttttttttttgagatggagtctcactctgtcgcctgggcaggagggcagtggcgcgatctccgctcactgcaactccacctctcgaattcaagcaattctcctgcctcagcctcccgagtagctgggattacaggtgtgccaccactctggctaatttctgtatttttggtagagacggggtctcaccatgttggccaagctggtcttgaactcctgacctcaaatgatccacccaccttggcttcccaaagtactgggattacaggcatgagccaccatgcctagcctctcattcctcttctacaccccacataaggtgcatgaatcattagacacgtatatttttttttccctaaggctacgtattcctaaaagtagtttaagttacctattacctctaggcttttttttccataagaatcatcaataaattaaatgccaaacacgtggttgttttctcaagcacacaattaaaatagacttgattcctctttgctgtctccagtcctcttaatattcatagcaataggtatttatctatcatcacaaaacacacaaaaagactggtgattgcttaaatcccaagagggcaaagtagaaggaactagaaagaaggaagcaagtgcaatcatgattaggcagttactccgcatctgtggctgggttaggaacattcataggacttcatgaaccctactaagttacaacctgctcttttacaaatgtggaaactgaggctcagaggggttaaatgatttgcccagtgtcctactgcttaaagtatcagagttgagatttgaacccaatttgcgtgactccagtttttaaaatatttactgtaccaaggctggagggggcacgcatgggccctagaagggtgcgtggaatgggtacctgggtggggaagggttaaagagggggcctcggtctgcttcaccaagatattttccttccctgattcctgccccaaatgtagactacttatccaaaatatggatccaactttgtgtaatattttaataagagggtcttctactaatgggacatctctcttttgtctttcacagcaattttgcaggcagtaatagctggtgatcttatgaaggtaagatatcttcctaccaaatctttggcgatgctttaagaactttaaatcaacatcattcctcatcaaaactctatgttcccatctatcatttatcatcccctgcttgcactggctgggtagaagaggcaggatgttcttttgagaactgagcagagatggtgttcaagagcaccggggtacttgtctcagttacttaaaatgaactgcatgtccccaggatgcaatgtgcacagtgtgcctgccctctagaagctgacatttgaagaatttaaagatttcctttcaggcaggtattgaaatgaatgtatctgtaagaattacctgggcaacactcagaaatgcatccttcaggccagagattaatctttccttgtcgtggttttatactttggggatcatagttagtcaaacaaggactctcatagttagtcaaacaagaaccctgatccccttggaatagtttaatttgtgtttgtgttttctggtgagttttgttcagaaggaaggaagcggtcaccactgccctgagggtgaatgtaaaatctgaagtcagactttctaagtttggatctcggctctaccattcactgtctgtgtgattttgtgtaattatttgattctctctgtgccttagttttttcatcagtaaaatggagtaatattacctctctctttggcttgtcatgaggaattaatgtaataatacatataaagctctcaagactgttcctatttcatggaaggggctctaaaatgttagctattttattaatattctgatagtgtagatctgtgttttttaatagctaaacatggtggaaatacaaatatttgttatataatataacatcatctatgaatattctaaagctatatttggttttcaggcatcaggctgatgactgcccatatgcccctgcaaaccccctgctggaactgatctgctctgtattaatgacagctgcctgaaggcagaggctacgcctgactcctcagcctgtggagtgaggtgccattgcagatcaaggaaccaatagccctaagagaaagctgaacagtcctaccctcagacataactttttttaggcgcatctgttggacaaactgaaggacacctgtgctgcatttttcaacaggttactagaggaaaacaaatggtgaaaatgtttgcaaacatcttgatcaactgccccctttaggcacataatcctgaaaacggtgcctgtgccactgcccagatcatagtgtcaatagaaattgttacccagaagagaagagtgctctccaagcagtatattgatgagttcagtgccgtttcttaccagtggattaagcccataccatcctgtactctgtgcaaggccttccattaggttttgtgggaaacaaaggcatgaataaaattgattcctgcccttggtggatttctacaccagaaaattttgcaaagcactgtacatttgaaacccttccattttattttctatatgcttttagttcaggcaactgatttcccaagatcctgagtttattatcacacttttttttgtacttttaaataaagaatcatttgcaatgtgggaaatcactatatccagctggttgtcttattataggttggtgcaaaagtaatttggtttttgtcatttcagtgacaaaacctgcaatcatttttgcaccaacctaatgcattctctgttataattctttcctaaatgactaaaacatgacttaataacaccttattttgtttttgtttttggagatggagtctcgctctgtcacccaggctggagtgcagtggcacgatctcggctcactgcaagctccgcctcccgggttcacgccattctcctgccttagcctccctagtagctgggactacaggtgcctgccaccacacccagctaattttttgtatttttacttgagacggggtttcaccgtgttagccaggatgatctcgatctcctgaccttgtgatccgcttgccttggcctcctgaagtactgggattacagatgtgagccaccgcacctggccaataacaccttatttactgagagatggaatatttactgagggcttaaggttttactttttctctcttacatattttcttattttccttctcaaatattcatgccctcttcctcttctccaatatcttttgtttctttcttctgagcagaaagtgcaatatatataaaatattaaatgggatacatgtgtatatgtttgtatgagagagagggagagaaagagagagagagagagagacaaagagagcgagagatagagactagcgaagagaacatctctggagccacccctgtgtgaaggctgtcacaaatagctcctggacaactgggctgcagaaagtgtccgtggactaactgaatgttcatggtgtctagaaacagcacaggaaggcaggatcaaggcagttgaccctgaacaggtcccatgctgctatcctttgtcgatctccccacaaagaaagggagtgtcattttaagacaacgcagttgaatggaacaggatatccttttagagttttgtggaaaattgctagctacttcttcctgccctcttgccccccagtttagggatgttccttacctccattgtccttacctccattcagctactgctttggatccatgtcctgggaggtcttccgtggctgtttccatcccctgcttcatgcttccctagtgcttctctgagacctttgtgatgttcctgtccattactgtgtgattctttacctatccgtctccaccatgggctgtgagggctttgagcacagtgactgaattgtattcacatttatcttcctggcatctagcacatgacaattctatggatgtatttgagtgaagacgtgaactctgaatttaggttctttttttaagaaagtatttttaattgacaaatgattatacatattaatagagtacatagtgatgttttgatacgtatacagtgatcagatcagggtaattagcatatccaccacctcacacatttatcatttctttatgttgggaatgttcaacatcctccttctagctatttaaaactatttaatatattattaactatagtcatcctacaatggtatggaacactaggacttattctttgcatttaggtcatttatgctctttcaccttatgggatgtttgattatctataatgtgtgccatctaacttcttgagagataatgtgttccttttgcttattacctgctgggttatttaattctcatttgtcctaaaattacctgttagaagcttcatgcaggcactcttgtcatgaaatactgtagtttggagatgagggactcattcacattttctgtaatgttcaatattttataaacttagaccatatcctcatgtagccaccttatcctcaggctacaaaattctgttttgttttttttttccagtcttctctcatatagaaactactacattttctgaatcattttgggtctcactctgtggattatctctagcctattaggtatgtgttggatgattaacagaaggtttgcaggctgggctgcatatctggatgaagaaggaagccagatgtgtgttcgtgtgtgtgcatgcatgcatgcgtgtgtatgtgtctatacttgtattcagtgatcttacatgggagaaaaagaagcagctttgatatttggtatataggttcataagactgaagaaaaactgaaggacacaggcaagaagcttagctacagtcaccaagctatttctgcttatagccataattactctttcactcaggagaatgctaagccaacatagagatgcttttgttctccactccacccctcactactccttcgagagagagaccatagagaccagtgctcagaaaataaatgaaaaaagtaattcagcatgattcagtttccctagcctgttcaatacccacagactctctccagagttagaagagacactggtcatctctgtgagtgataacacagtccaggaatgttacttcacctttttgacttttctctatgtcctctaaggctggaaacattgtggtctgctacatgactctcattttattaccggttagctgttatccttgttccgaattctgcctgagcttctttttgtatgtctctctttgcagctaatagaaagctataaaaatggaggcagtctgctaattcagggaccagaccactgttcactccttcactacgcagctaaaaccggcaacggggagattgtgaaatatatccttgaccacggtaagtaggcatagtgaacttaccaaggatcacttacctgtgaaatccattgcattttgcattttctaagttacccttcatccaggcagttttcagaatggcagaaatactctcgaacttttagcagactctgcccctgcttatttgaggcagtcgtggttgcagaccactgacacatacgggccatcctatccaagcaattagtagaaacagtgttcataccaagctctttacaggctatttttcagactaattagtttttttttttaaatagaggacaaaaataaatgcagcctggcatcgtgtgctttatttttttctagagctcttctgtaaattaatgggttgggattccctacctcacctgtatttgcggttcatcgttgtgaagattcatgaggataattgttttgcatctttccagtttctcatttttttttctgtttgatctcatttatcttttccacccaagttacgctttattctctttgaaaatgtctggtactattgtgttgtctgtggcagatcatactaaccttccagactgctttctaactggatttctaatagttggtgccagatcgtttgcaggaagtagcatgcgctatagcatctgcctctaaaaaccctttggaagcataaacatatttaatgaataccaaatctaaactgttacattgaatttatcatgttttgtagtatttctaggaataaagaacaggaataaaggggaaaaatactgcctagctagtctgttttaaatgagaaggaatgaaagagtctaattctgctggatcttggtatacagagagattggaaaagtttctttgagccctgacagtcagcctgtggctgactccttttgtacccaaattcagcctgtagatagtaagcatactcataaacattcacatcctttttgctccttttttttttttttttttgcaattcagcaagtatgtcttattccattcattgattcattcatttaacaaatatttgtgtagtgcctaacaggagctgcctgttatagatggtacacagacaaaaataaaatacagtcactgttttcaagcaattgcaggctaaagaaaaaaataagatcatgtgtataattaaatttaaaaccgatatatggagctgttttaagtcctatggtaaagccacagatagataacatagctaccatttatcaagcacatatttgccaattgtttatagtaaacacatcccgtcatttgacaaggtccttgcaaggtaggtactaaactatcaatcacgttagacaccccttgctttgtcttcaacaccttctcactgtgaagattctgcttgaacccttggtctgaaatacggtagaaagggtgggttagaaaaaggaaagaccatgaaaacaggagggctgcgatgacagcatttctttactccttgtaggctgggttggataatcccaaacctgtctgccctggaaagcctaggtagataggatgtatttttggtgctaagtctggggcttgtatcattccatctcctatttccctggctattcagtctcttgcagttaaaagcgttcctttctgggcaagagtgaagccacactaatatctcaggatttctactgcacaaagctcaggtgagggttagatgtatactgtcactttatttttgtttagctcaggtttaaaattctcctatttgctgtcttcttgatcacttccaatctactctctttagtttaccctttacccaagagattgaatgcttgcttggataccttaagccatttggtgcccacctaccctctctctggagttaggtgagacactggccatctatttgagtgacaacacaatccaggaatctctctctccacacccccccacccatcttttcacctttcctggagaagcagtatttcctcccctagtcctaggatcctctctgtatccaccgtctcacttggtctcatttaggaggctgcagtcagctcctttttttgatgaggctttgttgaagatggactctcacatgtttggggctttcagctgggagggctgtggaaggccaggacacctaagcctttctcaacacctcgtctttttttcccaagatccttcacagcatggtagtgctggggttcccaggggtgagagtggaagctcccagatgtcctgaagctaagctgggaagttctggatgatctctactgcattctattggctaaaacaagtcacagggccagcccagatttaaaaggttgggaaacagattccactgtttgatggcatgagctgtgaaaaattcatggagatatttaatctaccacactcccttatgtcccggtctctgcagtttaaagtgaacaatgtcctaaacttctgactcacctggaatcccttagagcttcgtttttctatttgactttggttctgggtcttaagaaccccagtttcacaaataaaaataccagatggccgggcatggtgggcccatagtcccagctacttgaggctgaggcagaaggattgcttgagcccaggaggtgtaagctgagtgagctagaattgcaccactgcactccagcctgggcagctgagccagactctgtctcttgaagaaaaaaaaatgataacaataatgaaggttttaacataagtatagcccatgcaatatttgaaatatgattatactaaaaatgaaaacagcagaactcctcatctgagttgccccagggacatgaatgatgagtcctgtgccccagggacatgaatgatgagtcctgggatgatatcaccttaacacagtagcttttcactttctctacttcctctcttcccctgcgtccaaaaatagggcctttaaaagcaccgttcatccaagctcacaggccttggagtttctaaccccaaatatagatcagtacacacctactttgcctggcatcaattcatctggcacattagtctctgagggccttgatcaaaacctaacattccaatacaaatcagtttctcatcaccccgcattgactcttgcaagactgagtcacacaataccactccgcccaaatggaaggacacaaaggaattcagtcttttttaggggggtgggggtgcttatttttccagtgctttggttagatgttataaattaatcagcttaatatttatgctcacgagaagaaacacaatgttcacagtaatcatcctaacttcacttccaggcaaacaatttctgaggtctcagaaggcatcctatacctttcctgcctcaccaggatctctaatagcacaggaagaaagactgtggagatgggagagcacaatccatctcttttgtttgtaaagaaaatgttattatgatgttcagtccaaggatcaccgcatttttgatggatggcaatttttaacactttactactatagctgaatatggagacttaaatgcaattgattcttactgaaattagtttttatcaacattgatagacattgtcaatttcatttttgatgtctatcttatcttttttatttattcagaaatacggatgtaaaatcatttgatatagcctaattcacctcattccacaagagctaaacacttcagctcaactgtcgttttgttttttaatatctttagttgctgattcagtttatattaacctttgcattttattgaaaactatcatagcaaaaccattcctctcttttagatgatagaaactcctttaaattatagtgttcttgaagtcagagacaagtacacagaaaacattaccctttttcaatactgtaatcaccttcttaaggtgatctctcttgattgaaatactctctcctaacttagtaatgatgataactctggaatatcctgacctgacaaagaaatcagcctttccaagaggcctcagtaagtctgggatttagggatgtataccagactatggcattgtatttttaaattagcatcagatttgcagtaggtaagtctgatcagtttgaattcatgtaaatgaaaaaaaaaataacaaataaaaattttacactatgccgaagatcaagaaagacattcctcctggttattgaatattgcaaatctcttaaagcctttgttgtttatttacttattttttacaatttggtttatgtctgtcccatggtttcatatgacataaatctgaaaaattgttcaaagacttgactgtaaggatgcctttagtaatagcaattctgaaggattcacaggctctttgccaggtgcacagctgatgttgtttgtggctcttgagttgacacttcctttgcttcctgcagccttactcctgagcccctctcccctctgctctgccctcttcttcattggctctggtcaggagtgtgggccgccaccatcaagaggacacctgaacaagagtcctgagattagttattctcccagacacaacaagcagcaactgatttctcttctatgggctcttttaaagcaggctgggggctgtgccacatgagatctgcggtatgttctgaaagcgccatgggaggcttgaatttttttcggcttgcatcttcttcctttggatgtcttctctcatctatacagcatgctgctttcctttatgaaaaactggaatttggacatttagagagttgaaaagagactcggggaggaagagttaataattccacagagactgggagagagactaaggatgcagggattccagctgagattcctctcagtgcttcccgcttttcagctcctttcaaccatattttctgcccgctccctcccccctcgtttgcccctccaaccctccaagggacttttgtgttgtttctttccttcgccaccctgcacactctgctcttttgtttttattctccccacgcctaccccattgcctcctactggttttcctgatagaaatctcactcatgcatttcctttttgatttcaatgggttattttgtcttccctctttttctgtcttcagtctttcttttctctttttttaacccccctttttctgcctctggtcccagagagaactgaccaccatcctgctgggacaggatgacagtactgttagcattcccagtgccagctctccccacatctgtgcagcttttgtcctgtggcaggggaggatttggaatggtctgctggcagcgtcagggagactaatgggaaatgagggcccagagagaggccatgggaagtggaaggaatagcaaaggggatttggaggcattggtgtgggaagcaaattaaaggatgcatgtgacaaaaggcacgtcatatataatacaaatataatattgatgacaaagtcacatcagcgggagctggggtatccaacagaagagcctatggaatgagtactgggcagcaacattgtaatttggaaggcctggctgcttaacacgatgttcactttctcattttgaaagatttgtgaagttttgcttcctttcgcattccctgggtgtctcctgaatactgatgtgtatgtccacttaacagaattttctttcccttagctttcagaccatttcccatatagcacagtcttttgaatccatatttcaattgtgaatctttctcttaaagtgatattggctgggatccaaaatggctttaaaatgtcgtttattcattcattcattaaaacattttaattccgtcccaggcacttttgaggaaaaaaaagtttctgtaacaatcactgctaacctctttgttctaaatgttctaaatgcattatcatatttaatttttacaaccctatacagtaagctctcatctccgtttgacaggtgttgaaaactgaagtatggtgaagttaggttccttgccaaaactcatccatacgtgagagatggtctgtgtcctccatattcctaataccagcaagggaaatgaaacatggataaataaccacaatgcagggtggcaccacgtgaatgtcgtaagcagagttcaaatgacaactgatctagggttctggaagagcagaggccgttttcatctgaaattttcatggagaaatctgcacccatatctcctcaatagggattttatagtattttttctggttcaggtcagccaaaggatgaagggtggacatttcagtaaaccctggaagagacagagacctgagatttccttttctattgaggaaacaacagtgaattctctgctgacaatttgatgatctccctcgaaattccttaggggagatggcatagtgtctgcaatcagaacgtatgtgtatataaaacaagccccaaactcaaatgttacccattcatatatgttgaaggaattcaattatctttatttttatttttttgagacagaatctcactctgtcacccaggctagagtgcagtcatggctcactgtaactttgatctcctgggctcaagcaatcttccctccttagcctccctagtagctgggactacaggcatgtaccaccacgcccagctaatttttttttttttgtagagttggggtcttgctatgttacccaggctgctcttgaattcctgggctcaaacagtcctcccacctggctgtcccaaagtgctgggattacagacgtgaaccaccgtgcctgactagtctttatttttttctctcttgtttttctccttttgtctcgtttcctttattagtgagactcaaattaacttttcaaaaatcacaggtgttattgtttctacactaaaagtcacagggtacagttaaactccacattgtacagttaaagcatagctccccattgggcagtgcaggttcaaataaggagaagaacagccttgtcttaggcttctcctggcatccactctctgtaactccttccttgctagcattatgcaaacagttatcctaaagcaggccaaaaatgattagaaaatgtacctgtgcttttaaaaatagctgcccattcccatctgtagtcagctggctgctacttttgcctcttcttggccagtgttcagaacattctgctattttgtgattatctatgttgatgggagaataaggaaagttgaagttaattaaattgattatttcagagccattccccaaaccttttaatgggcattttttttttagatattaattatgagcaaaagtttcttgccttgttattagtgcctctgcctctcacctctgtcagctgcagaggatgaaagggcgtggagggaaggagagtgatgggtagccgcgggcatgcctgactcacagactggataatcagctctggaataattctgggtagtgactctggtcagaaattgtgaagaacagctttcttccttgtccccaccttcatattgtcaaattattgctgtgctagctcaattaaaagccttgaggatcccctcacttgcatagaggcttagaccctggataactgtggactcaccgtggcatggctctgagaacaccgaatgacagagctgaatgaaggagaaaagtaaacaaggcccctgttgcctaaatagttgtgcaattagcagtaccaatgggaacagagctactaatgagtgtaggctgctcatgttcatggaatttcttccaaaaggagtggcttagaatgttcactgaaggcgacaggcactctttaagaggaccattgggtacttaagccccttgctgacgtgaagagtgccctgttggcagctaaataggcctcaggtgcttgtttctcaggacatagaatttgagtcaacaagtgtcttcacatgtaagtgggagtaaagtgaccctttcataccacattccttcactgatgatcccatatcttgatgtagtgtgacctgctgtatcaggacagagaataggacacttcatgctatctaaagttgaagcagtacctgtggtgtgccaggcactgttttaagcacactatgtgtattgactcttttctttctttcttttttttttttttgagaagtcttgctctgtcacccaggctgtcacccaggcagtgagcacaatcttggctcactgcaacctctgcctcctggattcaagcgattttcctgcctcagcctcctgagtagatgggattacaggcacacaccaccacgctgggctaattattgtatttttagtagagacggggttccaccatgttggtcaggctggtctcgaattcctgacctcaaatgatccacccgccttggcctcccaaagtgctgggataacaggcgtgagccaccatgcccagccctcttgaactctcacaacaaccctgtgagataaatattattattaatttgactttacatgggtgataaacaaggagctgagagattaattagacttggccaagacctagtctatatagagctgggatttttaaccaagaagggacagctccagaaacctcgcccctggtcactgtcctgtgctgctctgcacttttgtatgtgtgtgggaggataaggatcattattcatgttttcatagaatcacaggaccaaggaacaaagaggtatgagttaaatctttgttgtttccttaatatagggtaggtgctagaaggatacaaaaaataactgaggtgttcttatattcaacaaatatagaataatttatttatggaaggcatgcattcaaaaagcaaatacatagtatgaggatagaaccaaataagtgctttgggagctgagagaaagaatacattccttctgtcaaaggtcatcttttgagaggaccttgtcacagactagcctttgaagaacatgtcagatttagataggtggctgttctggatagggagagctgggaaagcctgagaaatatgtggttgagtgtgcaattaccactttagcttttgtgaaaaaaaaaaaaatggaaccctgggaacaaattgaggaaatgtagttccagatgaaagactgtgagctccagtgtttaaatacttgcaagtaagcagtagatatgatgtattggaaacctagaaatctagatgatataagaccttcttatctttcttggtaactacttctgcatgctaataatgttccaggcagatactggttaggaagtctatttgtcaaataggacaagcagaaaagacaaataggagagactttgcaagagaagattcacctggtcccagtgaatagcaggtgtgaaagagaagaggtcaagatgatttggatgaccaggagaattatgaaatcccataacatctctgttatgttgtccttggccaatgactttcatggtaagagtgataacctcttccaccccttcttactatgcacaataagttaatttttaataataatgatatccaccaataaagagagcaaattcccaggatcgtctttctaaagacaaaaatactcagtaccttgaactgtgtttggcacttacaagcatatttattcatccattcaatcaaatgtttaagcatctacttatctccaggctctacactagacaccaaggaatgacacaatgctagacaaagcatgggccaaaactttaaggggttttctggagtctagttatagggagagataaatcagtaggttattttaaaacggtttgttacgtgtcatgatcagtatcatgatcatatatccccccttgcctggggtggtcccaacttggatgataaatcccattacccattcaactataggaaatagggtcagtacataaagtgagggattgtataggcaggtgtttaataagctgcttgaagtgggatcatgaagggctttatggggaaaaaaagtctcattggatacccataggctgaagagggcaagagatggcagggagagaagcagtggtacagagctagaaaggaagacattccaagcagtgtttgtagattgaatggattaattcatgaatacacaaaacattgtgaaagggaaaattcacagaatatttccattcctaaggatgcatctatagtcatttgatgtatatgcatagtatttctttctggtctgagaagggaaattttataaaaactggaattgtaccctagatgatacgtatagtatcttacagccttaatattttgcttcataagacgccatcccaagcaactcgtttgagaatgagaaattgccctgattcctaaagcccacctaatcttcccctttctcccttgttagccacttaattatttttcagttattctattccagttttatttcataaacttgatcgaaagctgcttgacagcagagaccataccattcttttttatctaccattctgtacatattggttcatggagattgggagtttggtgatgaggaggtagaggaatccttttatttttctttctgtcttattattcctatccccaaatttagctttccaaggcattttaattctgtgactatagattttctgttaatgtttagtttttgagcttatttttgacggtcatcttgctttcttcttatttaggaccttccgagttattggatatggcagacagtgaaacgtgagtgttgccttttattacatagtctaggttattttcttcagaacatatctgggagaagaatgtaatctatagagcatatcataggtaattttaacttaattaattcaaagtccactttcaactttgttcataaatgtgcagggctaatagcctaaataaaaaattacggaatagaaattgatgacaattgtcataatgcttgcctccatagtcagcgctaatcatcatttagagcttgcttcaaacaatgtacttctgcactggtgcatcttggaatgttgagaagtctaaataattacacttaccttttaatatacccatcacatttattctttctcaactggagtttctgaaaaaatggggccctactgccctaaggcattattcacatgtagtgacataacttctctctgttagtctagaacaggacaagttatgaaccaccactgaagaactgagaacatagtcactctattttctgtcttctgtggttcagagaagggatcctgattgaaaaagtcatcagctctgggatggtgcctaaactgatgataatgtttgttttcaaccttatttctaaagtagcgaaatagctactgctccccaaacaggaacaaagataggctgtacaactaatcctgaaagccatatttgaaaaggtataaagatgagttggtgtggagaggaatgaggtggtgagtagctaagcatgtgggaaggaggagaagtagaaatgaatagaatggaggacgaagagaagcagtagagctgtggaagaagctgtctatcactccatagagctggtccacatgccagcacatcctattggcaagattataagtggtgccatcacttaccccattttgccttctctaaaggctgctattgatttttcctgaaacactttggcgttaagcatcttggtgcctttgggctcaggataggaataccctcctccctatagagcctgtcagtgatggggaaatggccagtttcccttgctccttcccacactgagtggctggcctcaagcctgctgcctcctggggagagccctggctctcaaactctcccagggtctcactgtgcctctcagatatcctctatggctgccccctccttccacctgccactcacacagaatctaaagtggatagagcagagtgggtgttggcctggttctttgaacttgggttctcaggagatactccactgcaggccgagtggccatcaaccaagggctgcgtgctgtgcctgaagggccagaggcgctccacactgctccctgttctttcacccagtgcctttctcgctctgctcaaatgtatgcacagagagaatggcttcagtattcagatacatctagacaattagtctgtttaatactgcattgactatcacctaaatcaaatagtagtagcttttaaaaaaattactaaacttaatcaacactatttggaaagggggctagagtcagatattatgatcagttgatggctagctcaaggaatttttagaaatccccttccctacctccccagaatgtaccctacagccaaagtctcagcagcctacagggaaggaggctgaggagcaccctacatcagctcccctcacccattccctgctgcctccaacccctttatgggtggtttcccatttcatctttgatttaggggtgagactgcactgcacaaggctgcctgccagcggaaccgggctgtgtgccagcttctggtggatgcaggagcatctctgagaaagacggactccaaggtaactcgatgagtgagtgcaaacatcctcccgctgggcgagatcgcaggcgctgttgcctttgcttgtgaccatagcacggacatcctttctgtgcttatggaagtgcctggggctttggaaaaaggaggaaaaaatagagtgcttcatttagagaaactgtgatttaaatgtataagcacaaagggagggcgtgtgcttgcctatggggctttataaacctctgaacacgttgaccttgggactttggggttgtcctgctgagcgctagcagccaagtcatgggagttgaggtccgaagcccaaggagaggggtcaggaccattttcaaagactttggcctgactactgagaagcccctttggggttttccttcagtacttactccaacgtgttttaaattctatgatttatatggccccttatatgggtgccaaagggattctttcccagctcccaggatggtaggatctggctttgagatggtcatagtcttaaatctggtgtgtttatgtagttcttcatttttaaaaaattctttccatttgttttctaatattattctctaaaagttaacctcaggtactagatagcatgggaattactgtcatttataggtataggagctaaaagcctagagaaagttacacatacccttggaccagtagctgaggcttaaattaaattgagctcttttgacgtccagcccagtgttgtatcagcaggttggtggttctcatttggtgccagaacaccccagccacataacaaaatcggtttgtttatggagtctgttttgttgaggtacagtgatacctgtggcacttggcttgaaatgtggttggtttctccacagcaaaagttatgtaaatctgaacttaaagtgtccactttcttaggactatcttaataagagggcagtgaggccagatattgtactgtgacatgtatgccaaccttgatagcatcagctggcggaggtgaggccttaggggaaactctgtttaggagaactgagaacaagctgcaccacgagttgtttaagtttatagagagcacccaagagaaagggttgaaagatagagggaaggaggagttgtagcttagtagagttgaaccagggctcagcctataagaaagaagagagagaaagaggagttagtttacatagaagatcaacaccatagagcaggggtgtccaatcttttggcttccctgggccacattggacaaagaagaattgtcttgggccacacatgaaatacactaacactaacaatagctgatgaactgaaaaaataaaaatcacacacacacacaaatcttacgatgttttaagaaagtttacgaatttccattgagcctcattcgcatccatcctgggtcgcatatggcttgcgggctgtgggttggacaagcttgccatagaggattctgataagctctgagagttttagaacactctcggtagactccaggaaagaatgaaccacttacctatagacacttacagagaagaatcttgatatatagttgaggccttcattaagcaggtaccgagtagctcaggtttggggccaatggttgtaaccatgacacatacatagattacttagaagcctaattaatggcttaagctccattagatttatttaagtgataagaatctgcctatgtgcaatttttttccctggggcctcctcaaactgcagtccactttatgaaataactttgccttcctagtggactttctttcctttctgagccagttgtattacatagaactctccactttcctggcaacccatgagcacccttgctctctgaagtccctggctgcctaggtatatcaaacacacttgagctgtgtcctggtttctagtggtctgttacctgtctggctagctaattgggtacactatttcaaatggcagataattaggttggtgtaaaagtaattgtggtttttgccattaaaagtaataatttctcaatgtgatgttcttcccagatgttatttgcactcagatgttttgatgtttagcctgattgagaaacacacaacttatattcaggattaatggagccaggttatggggtagggttggtcttgccagggccactcagaccacagcagcacaactgcctctttaccacacaaaggctggtcctacactcaactcagatcattttaaaaacagagagaagccatgaaaaagagggacaaaccaaacaggaatcaggagacctggctcttgagcaggtctgcttttttatctttctaagtttctgaatcagataaaagactcaatgttcatggaaacttctttctgttttgtgttgtgtatgtgtctgctttttttaaaaaaaaatggaaatagcttgtttttataattataaacccctcacatagaaaactagtaatgtaggaagatatgctccaaaaagcaaaaaattgctggaaacctcacaacctagacctagatatcattaaacttgtaatgatcccccttcacatgtagatatgcctgtttttctctcttgttgtttttaactagatgaagtcatacatacatgatatcgtataacttttcactcaacgttatattctagaggtcttaccacatgaaataatatagctatacttcattactttttaaggatttttaaattttgccattctgtaacttgatgctagtttaaagttgaatgtgatcattacaactgaatcttctcctggaattttttggagagaagcagcatcctgagaatttctcctattagagttcagttcctcagaaatcacctcaaaggcccacctcagcaacctctctgaatatttggaacctggaaattccaacctcattattatggaagtaaagacacaattatctactaaggctgcaaacaagttgaataaaaattattcaaggaacttcaaactagtggttaacggctaaatcccaagtgaataagtaacattttagaaagattctagagccattgttacttcccttttgtcctctccccagtaggctatgtagagcaggttggattgaggtcgccagtatctgttgggatagccgagatgaaagctgagaagtctctgataatatttataacacttgtgtgcatttgtacatggagctatttatttggtacaatgatcatgcctctacccttcctttggaacttaacataactttttaaatagttaaaactttatcattcaacaaaaattagaaattttgagcgatgccaagtaatatatacaggcattcaaaagaatggacactctttctccctttactgctgacttcttattcagtggcctcatttaaaaaatagcaatatatatatacaaatatatgtgtatatgtgtgtatataagtgtacaaaaggcattatagtagtctgtaagaaattatatgatcatttaacatgttgatgtaaaaaattaatgacaaatttatgatatattactaagaaaggttgtaaaacagtatgtaaatgaattgtggttttgtttttataaaaatacgtatagaggcatataaaagacaaaatctagttatcaatggaaggttagtagtggttatcttagtttggtggaatgattagggatattccttttcttctttgtgcttttcaagctttccaagatttctttaatcaatatctaccacttttgtattgagaaactagcttagtttttagagagatgaaatagcccaagtctgaaaccaataaagaaaacctttcaatttttttatgactatcccttccttttagtttctgtatgttgatttcccaagtttagaataatagaaagagtcctaaactagaaatctaaatgcctgcctccctattttttaaattcagtaatttctacctccccatcttccagaaaggctctgggtttcaaaactcgctttaccccactgtttccttctgtatactgttaacctctgtgaacttctgtttccctagtataaaccccacccgtcaaaagtgataaactctttccctttcatttaccaatcgcacatgttcaatttaatgctcatataagacaatagatttgaaagtgtcttgtaaactctaaaacaccaaatgtgaaaggatccttactagcaggtatccttgcgtagttctgtttctgtgatttttgttttgttttgttttttgtttttgtatttcacgactagcgcttgtgtctatctctctctctctttttttttttctcactattttcgtatagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgc

SEQ ID NO: 74 - DNA, 15109 bp, Homo sapiens
cttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcaggtaagacatgttttttttcctgccctggggagaccctgaaaacagaaaggctagtttcctggggcttagctccttcaaacatcctcaagttgctatattatctttctaaaacatagacctactgacatgcctcccttcctcagaaaccttccgtgggtggttcttacagccttcaagatggagtccagactcttttttttttttgagacagagtctccctctgttgctcaggctggagtgcagtggcatgatctcggctcactgcaacctcagcctccctggttcaagcgattctcctgacttggcctcccaagtagcggagactacaggcgcctgccaccacacccagctaaattttttcttttctttttttttttttttttttttgtattttagtacagacggggtttcacatgttggccaggatggtctcgatctcttgacctgctgatccgcccgcctcagcttcccaaagtactgggattatgggcgtgagccactgcactaggcctaatttttttatttttagtagagatggggtttcaccatgttggccaggctggtctggaacccctgacctcaagtggtctgccctcctcagcctcccaaagtgctgagattacaggcatgagccattgcgtctgacccagactccttaatgtgactaactcaaggctttccttgaactacttcttacttgtctttccagctttgtcttttcacctctcaaattgagataaaataataacaacctcttggagttctcatcaggattacatgaaatgagatatgtaacatgcttagcagtgcctgtccatagtaaatctcaataaatgtttgtggaattataatatcttgtcatgtttgagactttgctctgcataatcaggcaccagtaggtttttataaaggaacccggctgtcacgtgcagaggagaaataaacagaaagtttcccatcctcagggagccacctgactgacagaggcacagtgcatccactctccaggtctaggggagaaagcagccttatttcttagtagctcagaatctgacttgagaaacacatccacatagaaaaaaacaaggaactttttcgggtcagggtccgggagccacagtgaggtggaagatacaggggaaggaagagggaaatagagccatccccagggtggaagatctcagaagagaatttgggaaacaaggtatgaacaaggactgaatagtgagaagtgatggagagacagttaaagtagatggagtgacaaaagcaaaacctctaagggtagaataggcagcaatttggccaagtcctaacagggaggcccataggaggattcaacctcaagatgctgtgccacattccaagagggaacctaaaggctgggctgaagagtcagagatggctacagctggcaaaaagatgggcagatgctgagaggagatgattgctaaaatgttctgtccaggacattcacagtatctctataaccagagtcttttttgtcgttgttgttctcaagaaggaaacttgaggccgggtgtggtggtttatgcccataatcccagcgctttggggccaaggcaggcggatcacctgaggtcaggagttcgagaccagcctggccaacagtgtgaaacctcatctttactaaaaatacaaaaattagctggatgcggcggtaggtgcctgtaatgccagctactcgggaggctgaggcaggagaatcacttgaacctgggaggcggaggttgcagggaggcggaggttgcagtgagccaagattgcaccactgcactccagcctgggcgacagagagtaagactgtctcaaaaaataaatgaataaataaaaaggaagaagaagaagaagaacaattgcaatcctccctggctctagaatgtcatttaaaagtcgagtgtcttcttccttccctgttttgaagcagcccttctcatgacaggcttgcttgccaaggttccctctgaccttaaatctcttccttttggtgtcttggacagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaaggtgagtagtgccatataatattaggtattaactgttgggtggccaagaacaattattctctcaactgagatgagatccctcaacccaaacatctcagtcctgggaatgatttccataaaaatgtacacatcaataaacagaaactcatgcttagggatgtctgttgcatcattattcagagtagcaaggaaattgggatcaaaatcaatgcctttgagtaggtaagtgacagaatgaacaatggtagccatactgtgaatattatgcaggcattaaaaagattattttagcactaggccagatggtttggaggccttctataaggtattattgagtgataagagcaagctgctgtaggatacaaaaacaaaaacaaaaccctagggcatggtggtttgcctcgcagctactcaggaggctgagacgggaggctggcttgagcccaggggtttgcagttacagtgagctatgattgcaccactgcactccaacccgggtgacagagcaaagaccttcacccccactccctacccgtctctaaaaaaaacaaaaacaaaaacaaaaaaacccttgggcccagcgccgtggctcacgcctgtaatcccagcactgtgggaggccgaggtgggcagatcacaaggtcaggagatcgagaccatcctggctaaaacggtgaaaccccgtctctactaaaaatacaaaaaaaaaaaaaaaattagccaggcatggtagcaggcgcctgtagtcccagctactcgggaggctgaggcaggagaatggcgtgaacccggaagcggaggttgcagtgagccaaaatccttccactgcactccagcatgggggacacagcgagactccgtctcaaaaaaaaaaaaaaaaccctgtatttgtgagcgcacacacacacacacacacacacacacctgtgcttggtcctagtgaataagcaagtaaatcaaatgtctaaatataattatagaaaggagatgtcactttttggctgtacctccactatttcattctgcagaattgcagaatttctttttttttttcctttctttcttttctttttttttttgacacagagtctcgctctgtcacccaggctggagtgcaatggcgccctccgcctcctgggttcaagtgattctcctgcctcagcctcccgagtagctgagattacaggtgcccaccaccacacccagctaatttttgtatttttagtagagacagggtttcaccaggttgtcaaggttggtctcaaactcctgacctcaggtgatccactcgcctcagcctcccaaagtgctgggattacaggcatgagccatggtgcccggcctcagaatttcattttcaacatgttttgcatgatgggtgattttggagaatattttttgctctatcgcaggatgattaagatgtggacaaggtgaagccgatggagggggagctttgaaagttacttgctatttaattgaggaactaaactgctttgagagcctgggggtcagatcctctgccttttcctcctccccacctgcagtgcaaacatcagacaattgatcactattgtatcttggaggtgggagtgaccattgcagtgctgggaccagaagatggcattgtatgtggaacaacaaagcactatttctagagactgcctgcagggatatggaaatagctttatgtgtctcagaatgttcttcatacagctgtttttattggggaaattctacttgccgaaaagtttgatagtgagaccctctccagtttgcagatttttctccttcctgctcaacaacttcctagctcagtaactgcctctcccaacaaactccctcagtttcaccacaccaaaaaaggaagacaagccggttgcggtggctcacacctataatcccaaaactttgggaggccgaggcgggtggatcacctgaggtcgggagttcgagactagcctgaccaacatggagaaaccctgtctctactaaaaacacaaaattagcctggcgtggtggcgcattcctgtaatcccagctgggaggctgaggcaggagaatcgcttgaaccccggaggcggaggttgcagtgagccaagatcgtgccattacactccagtctgggcaagaaaagtggaactccatctcaaaaaaaaaaaaaaaaaaaaaacaaggaagacaaaaagaaaagcagctaaagactttgcctcaggggagaaagttctcttttgggttgctatccacattccaacctcctgttcccacctcttcgtctgcatgcctaagaaactgttttacaagtaaataagggacgctttgtctaggctttggagccaggaagttgagacaaatttaggaatgagatgaagtaatggtattattgcaagtctcaggtgtaactacctctgctctttctctgaagagtttctaatttctcttgtttacttatttttttcttgtcatttttgtgattttattactagttgtctctaatcctttctttaaattcttcattatgaaacataaaaacaaatgccaggcgcggcagctcacgcctgtaatcccagcactttgggaggccgaagcgggcagatcacccgaggtcaggagttcgagaccagcctgatcaacatggagaaaccccgtctctactaaaaaatacaaaattagctaggcgtggtggcacatgccagtaatcccagctacttgagagactgaggcaggagaatcgcttgaaccgggaggcagaggttgcggtgagccaagatcgcgccattgcactccagcctgggcaacaagagcaaaactctgtctcaaaaaaaaaaaaccacatacaaaccagagataatattataatgagcctccaagtgcctaccaccttgctgcagcacttgtcaatccagggaccacccacctcaccggctccccactcattaccaccctcccctactcaattactgaggtaaatcctaggcagcatgatcatttcttttttttctttttatttattttgagacaggatctgtctctgtcacccaggctggagtgtagtggcatatctctgctcactgcagcctctgcctcccgggcagaagccatcctcccacctcagcctacatagtagctgggaccacaggcacacaccaccacacactgctaatgttttgtattttttgtagagactgggttttaccatgttgatcaggctggtctcaaactcctaggctcaagcaatcctcccacctcggcctcccaaagtgctagaattacaggcgcgagccactgcacccagcgaagaacactttttaaaaaataaataggccgggcgcggtggctcacacctgtaatcccagtactttgggagcccaaggagggcgaatcatgaggtcaagagattgagaccatcctagctaacatggtgaaaccccatttctactacaaatacaaaaacaaaattagcctggcgtggtggcaggcgcctgtagtcccagctacttgggagctgaggcaggagaatggagtgaacccgggaggcggagcttgcagtgagctgagatcatgccactgcactccagcctggggcaacagagtgagactcaaaaaaaaaaaaaaaaaagccccccctccccacacacaataatataaataaataaataaccacaatactattatcacatcttacaaactcaacaaaaatttcttaatatcatcaaatacccagtttgtgttcaaattttcctgattgtttcataaatatactcttacagttggtttcttttagcgagattcaaatgagacccacctgttgacctttgcccttagggtttcccagggtctgaattttgttgacgacattcccatgttgctatgtaatacggtcctccatgccctgtgtttttctgtaaactgatagatgtggaggtgcaatgacatttgtgtttgatttactttggcaaatatagttcatcagtgatactctatacttcttgttgctttacatccggaggctgataatgtctgcttttctctcttttctaattatttgtgaaaggaaaaatgtggggggttgggagaaaaaaacccttaagtacatactcgctaaatcacattgctacaggtaacttccattaagaacttgaaagtaaaggtagctgcattttcccctagggaacacaatgatagacaggagccttagtctacagcttgaaggattgtaattatacctaagcaaccctcctggaccagtttaatgttattagctgtgatgtatccctacctttgatgtcattatccttactcagctcccttaaagcagagatcaagatgaaaagggcttcagctgcagcatggcacatggagattagagtggggcttttggatgctgaggagcagacctagaatgggaaatagatgggagccacagaagtgaaggtccccctccctcattgctcaacctactccacatctccaggtctgcacatctgttcagttactgaatcctgtgtaagctaccttctttttcttttttcttttatttatttatttattttttttttgagatggagttttgctcttgttacccaggctggagtgcaatggtgcaatctcggctcactgcaccctccaactcccaggttcatgcaattctcctccctcagccttccaagtagctgggattacaggctgcaccaccatgtctggctaatttttgtattatcagtagagagagggtttcaccatgttggccaagccggtctcgaactcctgacctcaagtgatccacccaccttggcctcccaaaatgctgggattacaggtgtgagccaccatgcccgctgtaaactaccttcttaaaagctctagaagagggctcttaaccttttgttgtgtgtcatgcaccttccgcaagctgatgaagttgatagacccatctcagaattttttttttttttttgagacagtgtctcactctgtcacccaggattggttgcagtggcacgatcatggctcattgcagcctccacctcccaggctcaagtgatcctcctgactcagcctcttgaatagctgagaccacaggcttgtgtcaccatgcccaggtaatttttaattttttttcgtagaggcagggtctcacattatgttgcccagtctggcctcgagaactcctgggctcaagcaatcttcctgccttggcctcccaaagtggtgggattacaggggagagccaccacacctagccagaagaatgttttaaatacaccaaataaaacatttataccaaaatacagttatcaaaatattaaattaacaagagttagggtgaccctattaattagtgtaatttcaaaatagtaatgaacataagtgatagtttgagatttctgtgacttttctaatgtgacgtgaaaatatttgtgatttttctttttcttttttttttttgagatggagtttcgctcttgttgcccaggctggagtgcaatggcaagatctcggctcacctcaacctccgcctcctgggttcaagcgattctcctgcctcagcctcttgagtagctgggattacaggactgtgccaccacgtccagctaattttgtatttttagtagaaacagggtttctccatgttggtcaggctggtcttgaactcccaacctcaggcgatccgcccgcctcggcctcccaaagtgctgggattacaggtgtgagccaccgcacctggccaatatttgtgatttttattgacgacaaagtcaaaggttctcttcatattattgtggtgtatcgcctacaagcataattaaaataaacactaaatttcagtttaaagtttactgaaaataaatatgtattttttattccctatttaagctttgaatcccctgacttcctataccattaccactgtcctagttcaggttcatgttgttttttactttaattgttatcacagtctcttaacatttctccctatgttctccagtcctgtaggtgctaaatctgacgtggtcacttctcagcttggaatccttcagtgcaccaccacagccttgaactacatatttgaaatacatatttattttcagtaaactttaaactgaaatttagtgtttattttaattatgcttgtaggcgatacaccacaataatatgaagagaacctttgactttgtcgtcaataaaaagtcccttgagggacttcagatgtaagtcccttagctgctcgttaaaactcccccagcctgacccaatacacaatcttgactttaaaccacttgtcattctaaatcactagcatttcctggaaaaaaaagccatttttccttcagggctaagctcagggaccaattctgtgtcaccttctttgaatcctgatgatattcacttctttatttgacctgatttattgggccccagacaccatgctgagtgttggggattcagctctggacaatgtcaaatgtcagtcctgcctttcagatcctttctactgggtgagccctggagtgctggttctcctcgcggtgctgcctgtgctcctcctgcagatcactgttggcctcatcttcctctgcctgcagtacagactgagaggtacagggcagagggtgggtggatcaggatcctttctttaaatgagctggcttcttggagctacaccacttaacatgtatttgtgagtgacttctgggttcagaagttcttctcactattgagtgataaagaaaaaaaataactccatgatgaaagagttttacatcttacggaatgctttcatatgaataatcggacctagcatttccctatgagctaactatgccatatagtaaccccattttacagaggatacaactgaggccaggagtagttcagtgacttactcaaaccgatataacttataagtggtagagctgaggcctctgtatcatacctagcagctccatgcaacttgggagagtgtgagcttcgaagtcagacaggtctaggctattaggagttttgaataaagatactgaagtgaaagtctctaccacacagtaggcgttcgaaaattgtttcctctttctccattcaacactgaggactcaggttcagctgctgatgaagctcctcttttttgcctagagctttcattctgagccttctcctcctaccaagtgtctccccaatgccagagcaggaagagtcttcactcctccccatgccccacctcccatttgttactaagaggagaggagaaagtagcaaggagggtatggggaatgttctgggggaatgggtgttggtgcgatcaacaacaaagtcctttctctcaccttgaattcatcccagatgcctgcttgtttacttcttccacacaaaaaaaggccttcagccctcatggctgagcagaaagaatctgaatgttagagtcaggcagcctgggtttgaattccatctcaggtactgaactctatagcaaaattcttagattctccaagcttcagttgccttgtctgtcaaatagagaaaacatccttcgtcctaaattgtagggaggattaaagtcatgcaaagtgcctactacaaatccagtcacaaagtagctagctactcactaaatgttcagctcctccctcctcattcagatgggaagtggctttagataaacaaagtggcaacgcagtgggctggagcagctctgtgaactgagaatccaagaaaaggggcgaagagcagctgggatgtattggatgcttgtgctggcttggagcattgctcacattctttattcgctattgtatctagactatagctagagaaagagccgcaaccattggctttaaatccagtgctcttcctactctcctgaggttgtttccaggctgcagagaaatagcctgcacaaggggcccaggcgctgggtgtgggagggtccccaccgagagccagaacatgcaggaactaaaatgttgcctttttctattttaggaaaacttcgagcagagataggtgagttccagtcatcgtttctcccaattcttgccttttggttttttggcataacggaaatggtcccgttcttggaccgtctctccctctcaataccctgttttcccctcagtttccctttctctacagtgggtgtgtcgtgcctagaacaagttttaagtaattaaataacaaagactcaggataaaagatcctttttgagtgccctactaaatccatttccatttgtttctctttcagagaatctccaccggacttttggtaagttccggcatgtctaggccctcccaggtcaacttggtatttcactctagttccagtcacctgggggaacaaggacccctggctcctggttgagtcccttcctctcttctcttttctttctttaaataagaagtcatttgcatttaggattggtaaaatcataataaaaatactcatgtactgtttttatgtgccaggcactattctaactactttacaaaaatgttatcttattctgtttaactccttatgcacatgatctctcttttcaggaatggcaaaacagaggtaaatagatcgtttacacgtaaacctgatgtctggttggggaggtgaaacaaacagaaacaagacacaactgtatcacctgtacttatatttctgctttacaaactcaggatgtttccatgagtacagaacatgactaatcagagaagacctcatagaggaatagaaaagccaccaagccccactaggaattgacccctcaaggacatggtttctagcctttttgttcactgcagattgcccaatgcctaaagataatggcaacagaagagcacccaaatatttgttagataaatgttgcagacactagaaggtgtcattagggcacagatggtaccttctctgagcaaacttccttcacagctcctcctcccgaggctgtaggtgactctactcttgtcacctggcacacagagttctatcgtacgatttaggaaattagaccagtgtgtggaccacacacacacacatctttacacacccaaagaggaggaatagtatctttgttttggaggacttgactatgaaaggtcttaactcctttttgtaccatgaatctctctggcactccagtgaagtctaaaggacccctttgcagaatgtttttaaatatacacataaaatagaacacataggattgcaaaaacaatcattgtactaaaatacagttatcaaccgataatcacatttgtgatatagtaacataaatgtttctttttttttttttttgaggcagagttttgctcttgtcacccaggctggagtgcaatggcgcgatctaggctcactgaaacctctgcctcccgggttcaagcgattctcagcctcctgagtagctgggattacaggtgcccgccaccacacccagctaatttttgtatttttagtagagactaggtttcaccaggttggccaggctggcctcgaactcctgacctcaggtgatccacctgccttggcctcccaaagtgctgggattacgggcatgagccaccgtgcccggccataaatatttctttagccaaagtaatacattaagtaatgtagcagcaagtctaataacctgtaatttctttctttctttctttctttctttttttttgagatgaagtttttttgagatggagtgcaatggcacaatctcggctcactgcaacctccacctcctgggttcaagcgattctcctgcctcagcctcccaagttgctggaactacaggcgcatgccaccatgcccagctaatttttgtatttttagtagagacggggtttcaccatgttggccaggctggtcttgaacccctgacctcaggtgatctgcctgccttggccttccaaagtgctgggattacaggcatgagccaccaggcccagcccaataacctttaatttcaacatactaataaacataaacagtatttcaagatttctgcaataactctaatgggaatgaaaacatctgtggcttccattggtaattaagtcacaggtactgctcatattgtggttagttgtaaaatgttttggtttgttttgttttttccaagacttgggggaatgggtgttggtgggatcaacaagagtcttgctctgtggcccaggctggagtgcaggggcaggatcttggctcactgcaacctccgcctcccaggttcaagcgattctcctgcctcagcctcctgagtagctggcattacaggcatgtgccaccacgcccacctaatttttacatttttagtagagatggggtttcaccatgttggcctggctggtcttgaactcttggcctcatgatccacccgtctcggactcccagagtgttgggattacaggcatgagccaccacacctggcagttgttacatttttaatgaaagaaaatgttaaatccagttattgaaaataaggaggcagtacttttctcatccaagttcatggactttctgaattttgtccccagagtcctttggtgttctaggaccccaggttaaggaaccaaaaaagacaggtgggtggggcatgagggggaacacatgttaaccctgtttgttctggtgaacaattcagatccccactttctgagggtgccctgctggaagataaccctgtttgtaattgtgccggttcttggacccttggttgccttgatcatctgctacaactggctacatcgaagactagcaggtgcagtggctgggcagcaggcaagaccaccaaatagtgggggaccaagtcagctctgaatgggaagccaaaagagaatagaaccaggactcaagattaggggagctgggatttccttattcctctgtccccatgcccaaccccaggctcttctgagaaactgtgaagagaaccacttactggatctgtgggatcccccagtggaaagggcagtgtgggtcactccaaatgtccatagggaggatgtggggaaggtgctattcatcttccactaatcacatatttgtttctttttgttttcagggcaattccttgaagagctacgtaagttctcttctctctgttataagcagagaataaaaagccaggaaagggagacagaagcaacaagaggaagaggcgggctattgagggatcacattcccagaggaaaggaggagctggagagcctgggtggagggaagactcctcctgggaggtagagggcaaagaagccagctgttagagacacatttacaggtggcagagaagctggaggcactcctatctgccacctgatccattcctccttcactgcccctaagcaggaatccaaccctagctggtctcattgcccattccacagcaactgcccagtgcctcacctctcagatcaaccattgaggcaggaatggagacaagatgaccccaagggcttttcttctccctagttcaatggttttatgatacaaactactgacatacgtttttcaagttattttctccttcttctaggaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaa

SEQ ID NO: 75 - DNA, 515199 bp, Homo sapiens
ggagcccagggctcgaggtgcgcggagcctgagtctgggctttccgaggacggcgagcagctgtgcccagagctctgggaaagtcccctctctttgcttcttataaattaagttcctttccaccagttagggcaagtccgccaaggtaaggcttcaataaatgacactttactctctagtgacatgaatatttttgtgtacagcggggctgctttacccagttctgagtcaaagcaatattgggtgaaatcttcatctccgatgggtttcacaggatcgagggctgaggggaaagttgtagctaatgcaggctgccttatcgctggtatacatttgaattttcttatgcaggaatgctgccatagagcctatcgaatgcgagtctcagaatccagctgcgtgtctgtttatgtttatctgtgcctgtgctgttgtcttccctgaagaagttggaagaatactctgcaaggcacattgcaataatgatggcatcagtataagctgtcatttatgtctatctgtaaaagtgaggggacgcatggtcagaatagaaacaggggcactgaaattgaattttcgatagtgctttttttaattattgcctttccagtatcctctaaaattacgtgatttctgagcactgaaactgcagcaggacaagcctcatttatattctttcattctttttttttttcttcccacgaatccctgccttaaatgcttattaaagcttaagatgaaacttttgcttcttttaaagggcacttataaatgatgcatgaaaagaaattaggtaggctcctgtgatcagcaacacactttatttatgtttgttaactctcattcatttctttttcttaacttcttgttttagtgtggaagtaactattattttgtcttgatttttatgtctgcaaaacaaggtaaattatgccttatgcgtgtgtgtgtgtgtgtgtgtgtgtgtgtgtgtgtgttgtctgtacagatgtggctctaggcaaacctctcatatgtaacaggtgaaaaaatagaattttattagctagggctattaaaatatttttatttcaatgtctcattgcatttaatgttgtagtcaagaataaatgttccttgcttttttcctgttggaagtcaagaaaaaataaaataaaaatcttagctaaaagtattatggttttcggtttgctcaggtgatggcatcactgctttgagccgagagacagatcagaggaagattttgttatgcagccaaaaaaactaactacaggctctgactgtgttttcaaacctttatttttcactctgggatcacccacagatttttcaaagcaggggactttgctcctgcaataattgttcttttttattttagtgtatttgtcttaccagagaaaatgcttaattctaaatcaggagtttgaggtccagcctagatcttacatataccttgttgggatgtgggaggaagaagataggatgtgatactcgtagataatgagttccattgtgtaacactctggtgctatcacctattatgattgcagttgccctcaagcctcctgttgtttatttaattctggatatcttaataataaattgacctggtataggtcaactgatgcacttcccctagaagacattcacttagtgcaccttggtgagtattttatgaactatacttctgatgctttttctcagagatagccaacttaaaaaaccaaccaaacaaacaaaaaggaactgataccaatggtcaagattgattgcctctctgaaaacaatgggaggtagaaaatgagcattggctattatacatgcaacagaaatgcccagctgaagataacccaatagcaaaggagaatataatagtagaaggacagtgagtggcaggaaactctagctgtaactgtatccagtgcagactgattataattagctatagcagtcacaagtatgagcaatagcacccggtgctagaatgaagtccatacattgtgcaatctggaaattattattcctctcaatgactgatttcaaatagatatagtggacttgtgagaatatatgagtcatttattccaactttataaattatttagatgaaagctgctataaatataaagtactttttgtcccattggctgatataaatagcattattatgctttgcattgatttttgcagtctgatgaatacaaaccacatgtttgcaagtttttgggtcccaacagctctgtatttaacttattgcacagaagtataccttaagtatctgcaacctgacttaactgtctttcagactctaaacatgcatgtaacacttcaaccaagctaggataaaacatattgaacttattgaccaggaaaaacttacttcttttgaatccatatatctgacacagtgaagtctagtgaagaatgagagagattgagacattaaagacaaagcatgtatatggtgttctttgtctttcttttttttttaattaagtacagaactttaggccctcatgtgcttaattgtatgacttcattatacttgcattatacatatctataatactgcattttagattaggccttcttaaccttggtgctgttggtattgtgagctctatcattctcctgggggacttttctgtgtattgtaggctccttagtagcatacctattctctacccactagatcccagtagtagcacctccaacttgtgtcaataaaaaaatctctctatacattgttagacattgttaactatcccctggggaggatgcaaaattacattgagaaccactgcttagagcaattttgagcagtggttctcaatgcaattttgagaaccactcagtgggaaccactgctctaagccaaaccaaaggatgtatatagaaaaaagttcatgcatatgctgtttgagtaggcaactgcccagtccagtttggatgctctacagataaatcccctccttttgctttgataatgaatggttttcaattggtaggtgttttactagatccctaacacagtactgtggaagatcttgccagtaaactgagagacgagggctatattatcatatgctaacatttttgggacaaaaggaaatgaaaactgagagatagtataaatgttgaggttgaagacaaatttcactttaattttcttcagatgatcctttaatataaataataaataaataaagatactggttcttctctataattgcttctactattatattttgggagtttgtatatgtgtgggttgtagggagggagcattcactctggttattctatatgcttggagtagtttctagtgtttaaagcctccagaagtaaaatgagaacagtttgatttaaaaggtacagttttagacaagtgctgatgtgtagcacaatggaaaagaactgagcttaatgatttgaagacatggcagagggtgcatactgacatggattaacgcatcatgcgtgtctgatctgtaggccattttctttatccataaaaggtgatgataataggtgtaaaaacccaatatacaaggttttatactggcttacaatttgtaaaggtctacactaatgttggtaaattatcatagattcagtgtctttgatgatttgtctgattaaaatggattaagcatgctgagtctttcagttattctagcgtggttaaaaatcatctacaagaaaggttaatattctctgctatattattttcatggatgaaagtgaacatctaaatttctaatattttcaaatctaaaatttgaaatatgtaatttaagattatgaatacacctcaatttttttcttatttccatccttcctcatattatccacatttaaaatttattataaaaatgtagacatataaaacatagaatgtgacttgagatttactcttaaacagtaaccattattaatgcttgatgtatattttaaaaataatttttcaatgaatagattaatatggatatatacaactaaaattatatatttttagaaagatatagtgatatacatagagaggcatacagtcacataaacccatgtgcacaaatatatatttaaataaaataaatacaatttcataatattatatgtaactaattttgtaggatgtttgtcttccatgtgaatagtagagaggatacatgatttttttatgagtccagtgtgccattaggcataggtctgatgcttagttcaatgttgaagacatccatttgtttacaggtcactcattaagtcaaggaactttgaattggtgggtgtccctaccatatttagtattatgcattttgattattgcatatggttgcatagatatactatttatttaaataatcccttattacaatctttttaaatgacaaagagaaggccaacacaagttaaacaattaagaacctctatcactgctggtagtgttttgacttctaagtgtggtacacgttccaggaaactatttctgggaaaattagcaggtagagaggaaatgtaggagcaggtgtaagaggagcatttgccctagtgcaccctgacatgctcagatgttgcttttgtggatactagaaagttctgatatataaatttctacattgttgagccacataaatttagaaatttcttggtaggtctgagaacaaaatgaacaaagtttgatccctaaaaatattgagtgaaatatttgctttaatcaacgtccttcaatgccaggactatgtcttattcaagattttactcaaaacacatggaatatgatagatgaattgttggtaaaataaattgaagatgtgcagacgcctccactgaaagggaattcaactatcatttctgtttcattttatgtttagatgatcataaggattctcaaataggtatttattgccattattttgaggcctttaggattaatacagatgacttacatatgacttatatgtaactatgcacaattagatattactgataatttcatttgatccaattattttcagtctacctgatattaaaagtattttaaataaaaatatctaggttagatccacagttaccagtgtgatataaatgagatagggtgccatttcaatccatcaaattatacatatatatatttttgatatgagttacagatatttctccattatgtctttaattttggctttttttttttttttttcgagatggagtcttgctctgtcgcccaggctggacgacagtggcgcactgcaagctccacctcccaggttcaagcgattctcctgcctcagcctcccaagtatctgggactataggtgcctgccaccaagcccggctaattttttgtattattagtagagatggggtttcaccatgttagccaggatggtcataatctcctgacctcgtgatccacacgccttggcctcccaaagtgctgggattacaggtgtgagccatggtgcctggcctcgaattataatatttaaaagaatttctgaaaccaatgttgacacagttatgataaaacttttacttgtatttactcctgcctggtggaagtgaaaatcaatatatcgattttaaaaagcaatttgcaacccattgtgagagataggaaagtgtagtttcccttatatacaacttgtgggaataaattaggaaataattaaaaatatcacaaaaatgaagaaactctttaataagttaaaattaatttaataatttgaatcaaagaatgataaatgtatggcaattaaatataatttactaagcttgatactaaattttatgtatgctataatttttaaaaaattttcagaaaaattttgagagaaaaatgtgagttttctagatttttctgtgttgtttatattgtatttattttttaatgtctcattagtagtttttactaatgtgatataatttgaatgagccatgatagtgtccatgaaaatctattttggttgtagtgaatttttcttgttatggagaacccactttttgagtcatttgttctatttagcttagcaatagatgggaaagcgttgtatgattaagattataaaataaaccagttcccaaagaccaatcagtaaagttcctattttgataactaaaattctacctgtagaaattttttaaagcaaaaataaaatccaattgcatattaaattatatttttcctgttatatagtaaattaaaattttgtattcattcattcatggaggttgccatctgtttgggaagaaagctggtaaacaagggcataattagtattttgtagtatttgtagaaaattgttaaagagaaaaaatgaaaaagggatgcagaaaaaaattgtcaagagatagatggtggtttgatattttatctatttggctaggaagcctgggaggaagtgtggatatgaaccatgttgctgtctcaggaaccatattccagggagagtgaaaagcaagtgcaaaagccctagggaaggagcacccctggctatctgacacataacaagaacagcagagctgagtgaaataattgaaatggagtgttatgatctgaatgtgtccctcaaaattcatgtcttggaaactttacctccaatgcaacaattttgagaagtggcatcttttgaaaaatgcttaggtcataaggatgtgaattacagcccttattaagagagcttttgggagtgggttcacttcctcttgccacaacatgaagacccagcaagaaagccctcaccagatgccagtgcctcaatcctggacttcttagccttcataactgaactgtgaggaaataaatgcctgctctttataaattattctttctgtggtgttttgttatagcagcagaaaatggactaacaaatagcatacaggaggtgataatgttaagaaataatagaaacccgatcatgtgtagatcctgtagatctgtttaagaactttggatttttcctacaagagtatggatggtatttgatcattctgagcagagaggtgacattatctgatctatatttcaacaagaaactcttgtcactctgttgcagatagactgaagaggagcaagaacagaaacagggagccagttacagatctatcccaagaattctggggagagatgatggtgtctgcagcagagtgacagcagtggagattgagagaaaaggtttgattctgtatttatcatgaaaataaagttggcaggatgtgatactgcttaagatataagtctgatgggggaaagtgatgtgaaaggataaattgtgatatttgtatcctaaacaataagagggctgcaactgatattccctaagaagcgaaataattgaggagaatcaagttgggcaggagaaggagagaggcagtagaagtaaagacctgagttttgcacatatattgattgagatgtccaagtggggataaaatgcagtcaatggaatacgcaactgtagcgttgcagggagagctttgtggtgcgggtataaaatacaaatttgtatgcaatattagattgcacttaaagtgaagagactgaatatgagagaaaatgttaaaaacataacggcctggaattggagcagcaaacacctgtgggttcaaaagatggggagaaactggcaactaaggagtagctgtagtgagaggaggaagctccggtgagtgactgtcttgaagcctgggaagatggacttcaaggaagacactgtcttgaaatacatttaaattatggaaatggaaactcacaaatacatatgaacacatattcaatatatatttagtggaatttttattttaggtataaagagtgtatttccttaattaaaaaaacatcttaaaaatttttatggttgcttactttttctgatgtatgtatttatgtaaatcattctatattcaaggtgagtccatttgtttgtgtcatctatgatttctctcagcagtgttttatagttctccttgtagaggtctttcacctccttggttaagtatattcctaagttttgttttgttttttgctgttgtaaaaggggttgagttcttgatttgattctctgcttggtcgctgttggtgtatagaagaactactgatttgtgtacattaattttgtatctggaacttttctgaattatattatcagttctaggagctttctggagtagtctttaaggttttctaggtaaacaatcatatcatcagcaaacagtgacagtttgacttcttctttaccaatttcgatgctttatttctttctcttgtctgattgctctagctaggacttccagtactatgttgaagtggagtggtgagagtgggcatccttgtcttgttgcagttctcagagggaatgctttcaacttttccccattcagtattatgttagctgtgggtttgtcatagatggcttttattacatcaatgtgaatctgctattagaaacaaatggaacattcttgatgccataaaaacagctattgccacaaagtactcatttaatcatctatgtattttattagtcaacgtatttttatcttctattacatttattaggtttacctaaattggatgctataattattgctttttcagacctgactaggtagcagcataaactctcatttagtactaattcttttaaaatgttgtttcctgtcaacctcaatttatgctacaaatgattatagtaaaagaagagtagacaaaatatgaagtttccccagccaatatatcaattaaaagaccatatgtttttaccttgccatttcctagtgatttatgcccagacttttaagtgcaaggtaaatcattaggaaccgagatataaatctacagtttcagcagaaggtctgaggtgattaagttgtgaaactgatattttagcaaatatacaagattactatattgcaagattatttcagcattgttcatacgaattaaagtattccttcatacaactatcccaagacacactctgcttcaacacacacacacacacacacacacacacacactccatccccaccaacaatcaccttatgactttataatcacactgtttattaaacttaagagactataatcagcttgattagctagttctttatcaaccaagcttcactcagaatatttatattctaagataaactaagtgaagtagcttctgaaactcactctatgagtgaagttacaacaatacttcaaacatattaatgtataagtgctgcgtgtgactaccttgaatgctagcatggtaggcagcataatggtccccaagatgttcacatactaatcgctgtaacttgtgattatattacatggcagtggagggttatggttgcagatggaattaaggttgtctattagagagcctaaagtagggaaatgatcctggataaacttggtgcgtccaatgtaatcccaaggctctttaaaagtgaaagagggaggaagagaggaggacacagtgatcatgtgagaaggactcagtctgattttgctggttttggagtatgaaggaagagggccaagtgctttggtcagcatccagaaactggaaaagacaaaggaaatggattctcccctagtacctctagaacggaatacagccatgctaacactttgattttagctcagttgagacttatgtcagacttcttaccaacagagctgcaagataataacttagtgtttttttaaagcactaaatttgtggtgctttctggcaatgggaaactaataaaactagcatattgagtttctgaagttcctgcatatatataaacagcacatcatgtgaattttccaaggagaaacatatagaatgttatttaatctgtaataattatactatcagtctggaattgttatattgctcaaaattaaattgatgaaaaagtcatatgaaacccaaaggttagtttcctgaaggatgctagttgcctcaaaaagaaggtaaatgttactcctaatgaaagaaaataatttatcctccctaatgaatacgttcttatctctagtaattatatattattagtgtttatgtgagtttattgaacttccagttcctgtgtccaaacatgattaaaatagtattgaattattttgtacagtcttaggtaaattattcatccacgcaaacaataaacaaagtaaaatatggaatatttgcaaaagaaacatattaccctctctgctttttacttttgtagtgcaggaaatagttacttaacttttgcacaatgtcattaaaaaaagtgaattcaatcatagtagaatattctatagctcaattaaaaaatgtaacctcatataattaacaaagattggcttagaatgagaatatagaaatctgtgtgtttactgatcaaactaatttttaactaagagactagaatgttgctcaacctttttaaaactgctaaatagggaaaaatttatccttccagtttgaatggccttatctcatgtttaaatcataacacctatgaaaatgttcatagaaaaatgtcaaatttcaagggtataaaaaaataaaagaatggattaaggcaaattaattaaatttggctaatatcaattttatttctttctttaaaatgtctcatggatattgtttgcttatacctggttataaaagccctctttagcataggattctaaaagcagttgtatgatttgcctgcctgcacgtgaaacaatcctagacatgatggagtatgcaaatggagtgacatatgccagtcttctttaatctggcttattggtgatgttggaaatactggcacaaattgtccatctgagtttctgtattctttatcagagtgcctcattcaaataattgaattctaggtaataaaaaacgtgcaaatgagccaaagctttggggaataacttcagctaactgcaaagcctgtgaaagcaccagtttgccgagattacatcagcatctgatctgcttccaaagaccctggctgggtactcagaagcagaaccaactcccaataatgtgttcatttctgacacacaaggaagtgccattttatttttctcttacatgtttactttcctgaattatttttttgttcctttaatttcttaagtgacaggtgtttattgtaacaagtcaaattatactttgtttccctttcttcaatcccactgagttgaaatatctacaaactatatatccacaaattaataatttgtttatccacttacacctttttccataaacctgaaaagcatatatatttaaacatgcaaacattaattttattcagctttttaaaaatcaagtgttatttaatccatactactctacttaatccttacttaatattagatcattaaaatctctacaaaacaatatgtcaatctgatgcgttcttgtctttatttttgcctcataactcattttcatccctgtttctgtctttatatcctgtcatgttgccataagttagtcttatcctttgaaatttgtaggtattcttttgttttcctattttcaactctgtatcattatatttctaacaatattatttctttcctctgtcactctggattctaccaatctttctaatcctcccaatcccctccagtcctcattaatcctcttttttcagagaccatctaccttatactactaaataatatgcctgagtaatagagccatctgatcttctgaaacccctcagtaagactaagtccatatttcttccctgaaatactgcagttgacaatctacaattggtgattctttgagactgttgaaaggtcataaccattagtttactactgtgtccactctgtactgaaacaacaaatgtgtgtgtatgtgcgtgtttgtgtgtgtgtgtagataaaatgtgtttttcccctcaactcttttttctgtaattatgtagattgccagaatctgtgagctttttgcattgtctgtgatatctaaagacctttattttcctagatctttttaatgtattatgtaaagtaaaatttaaaatagtttttcttcagagtttttaaacagaatttatggaagtttaattaagaattatttaatttgagccatttaacactcactcaggtaataaaagggaaaagaagcatgaaacaataagaatcagtagaatatgaatttcactgggtcgaaatttgctaagtatgaatcaccgtttcagatgaggtgctctcgccaacttcagaggcagttcttgtgtgactgtgactctggaaataagtaaccgttaggaatagctgtttctctgagaaagcatctcactccattttcagtccagtgctaaagaggatttaatgtgtatgcaaaaaggtatttttaacacttaaatttggtattagcatcctggatgtgctgactcttccaagtgtaaaattgtgctttcagaaagaagtaaactaggacactttgtcagcatcctagaaatgatagccattcttttactaaaagaaatgccaaacatttaaaatgaaaaagtaacacattaactaaatggaaaaaccagattgttctaatcaataaactctacaataatagtttgttcttagctaatatgtgtttatatctctaatttattaccaacagcaaaaaagtattatttataaaaatttgatttcctgagagacataaaatatttaaaataacaattgcctcaaatcaaatcgtgtttaattattattgaagtttctgctctaaatgctcaacctagaccttgcctttcattgaaaatacattcactcagatattttggtagtacacaatcctcctacaaacctcatcatttacttttcttcatacttatttttcatctagcactactcaattttttcccaacatattgaattttatttaaaaatcactacctaagaaaattacagctttatgacacataaaagtatattattttggcaaaatgagtttcattgtacaaaaatatacaaatttaacataatttttattaagtacgatgtggagacatggtatgctgaaaaaatcatagaaattatttaagtaaaatgtatactttgaactgagattttatataacttattgatttagttaatgttatatttatataatgtatcatttataatttacttgtgcatgcatagtcaaccagattaactgccagttttctctggaacctcaacatgtagtaatcattttttatatgacatttccttcttggcctactgcacaggagtgtaggtagatattgttaacttcattttgtagaagagtacatttaagtcatagagttcctagatggccctacgggacacacttacttaaaagtagccgggtcagaatggagcatgcccagctttcctcttccatccataatgcctcttcacaggccagcacccacaccccctgcaccctggatcccagctgatgggctcatatcacatttcagaaataaatttgctaaatcaacgggacagtgacaagctcacttccaccaatctatatgaactagtaccaatattcctatctcttgcctctattcaaattataatgaaggacaatgcctgctatatctgcacctccttctcaggattctgtccccataccctccctgacttctctctttaattggttacatcattaaagtatcactctctaatggtccttcccataagtgtgctctggaaacttccctctttttttttttttttttttttttgggagacaggatctcattctgtcgcccaggctggagtgcaatggtgtgatctcggctcactgcaacctctgcctcctggattctgcctcagcctcccaagtagctgggattacaggtgcacatgaccatgcctggctaatctttatattttagtagagacggggtttcaccacattggccaggctagtctcgaactcctgaactcaagtgatctgcccgcctcggcctcccaaattggtggaaacttccatctttaaaacacatccagggacaacaccgcctatttactctgctcagatttaacatgtttctgacatctgagtaaatgatcccatttgtaccagtctgaaaactgagaaagatcctttacacctttgtcacccttatacctcctaccactgtcagatcctatatgttctaaccctaaaatattttaaaaatatgttcactatgtgtatctttgctaccaccctactggttcaaatcaccatgatctcttctataatgatttatttcatttggcttgcatcatcaaatacccttctcgaatcattgatatattcatatgacaatcagcaaatactccctctaagtgtaaatcagtagatgttgttcctctctttcaaaactcttccaaggatcccaatatgaaaaacagggggctaaattcttgccatcacctcaaaaactttttatattctcatctagccttcctgtccaacttgatccctatctatgctcattaagtgacagttttatactttcccctcctcaaatatgctaagcagttgaactggcttgttcctttagtctgaaatgtccttctctcatattttttatggtaagcttcttgtccttcatgctcttctcatcctattaaaaacagaacccttttccctaaagtagttctccatcacactagccaactttttccatgttcttcaatactgtttattagcttattcctttccttttttctcacctccaagtaaaaagtaaaccttccttaacccaggatattgagcattcacttacctttggatttccaaggtttaagagatttcctgctgcacagcccatactatatctcagaaaataaatttgaagtacatcgtacatagataataggacacaagtgaataccatacacaggtaaccaccactcttacaaaatggaatattacctgcattcctgaagcctaccttttgcacttttacagtcctattctcttccccagatataacctttttatcctcacttctaacattatatgtggcatttgcctgtgtatttaaaataaaccaaattatacagtatttttccattgaaaaatatttccacagtgtttttccattggctttttaacattacttttgttaaaagcatccattttgtggaattaatcagttgtttatgcattttcattcctgtagattattccattttataaatataccgtaagttatttgttctactactgaaaggcttttgtgccatttcttttattaacgattaactgtaatattattaattaatattattgactattacttcagataataatagaaacggcacaaaagcccttcagtagtagaatggataatttacggtatatttactgttgtatttactatttactactattctatttactatttctattaaaaactattacaaataatataactgtgaacagtcttgtatttgacttttggagaacatatgtgtgcctttttcctgagtgtatattgtaagtagaattgttatgttataagttatgtatatattcagctttaatagataaagacaaatcatattccaaagtggttctactaatttatgttcctacaccattatgagatatatttttgttattgtctgtcttattcattttagtcattttggcaggtatgtagtggtatctcattgtattattcccctgctatatttttaatctttaaaactacagtaaaatttgaaagaataatgcagtgaacattcatactcttaaactggagtcatcaattgttttaatttgccactttcgctttattgataatgcaccgccttcatttttctaactgtttgaaaacaacttttaccatttggatgcagactttcaatggtagaaaattgaaaagctttctgaatttatagacttagtaattttgacatttagtgaacattttcttgatttactttaatagttttgcaagtagaatggtaagatgcagtataaatacaatatactaagtatatttatttcaagatgctaaggaaacaaattttgctttgcaacttgtgaggataatatataaatgagaaaaacaaaggctgtgctaaaaataaacaaactcattcaatttgttcatcatatttaaagcatgaatcaggtttgaaatgccatttgcagataatgccaccaccaaaagaatatcgcattttctttgtatcatctttgtttacttagtacaaatacagttattgacaaccaaagaatggtagtttagacctcagaaagcacatttgtattttttaaaactaggtttccctttatatgtagttcttactggtataatggagactccgatggtgaagctaaattattgcactatttggcagatcacctcgattcacatttctttctctctctctctctctttttttttttaacgtttaagtttagaggcacaagttacgtttgttacataggtaaacttgtgtcatggaggtttgttgtaccaattatttcatcacccaggtattaagcatagtactcattaattgtttttcttgatcctgtcttcctccttccaccctccaccttcggaaaggtcccagtgtgtgttgttctcctctatgtgtccatatgttctcatcatttagctcccatttataagtgagaacatggagtatttggctttcatatagtaggtttcatggtatgttttatgtttcatagtatgttttaatgaccaataacctccactgatgtaccaagtttcgcaaatgatctttctgttgcctttcattcttttaaacaaactatctttttatatatacattaaattaatatgtgaagctctggtaatatattttaaactttgcttctaacaaaacttttctgtggcattgaactttttttgctgattaggtttataagtgatgtatgtgaattcatccctatacattagctcttgaacaattgaaggtgcaagtcacttttgagtacttctattttaatggttattttatactggaaaatgttatttttatgatatttacttgagaacaagcaaactggataccagctctattatatattctgaatattttcagaattttactttatttttgtctggtagactagcatttcatcaataagcatgctttgctttaattagggttaaaatggattaatttgctttaaaatgagctattttcaagacatcatgttaaaaatatatttcttttagaataaaatctaaaaataagaaagacttatgctccagcagctagagaagaaatatgggattgctgcacaaactttaataatgtattttgttttcttgtaaaatagcatcactccgtctccaatggagatattcttcactatctgtttttaaaaagttttctgtattacctatatatgtcaacaagttagttttcactaaaattctatttttttctatcttctttattattttaaacacttatatatatttaatatatgtagaataatatttaatctcaaagattaaatattattttacggtataaataaatgtatgaataattattttcctgatagggattttcaaaaaatcttatgaactgtattcccatgagtctcgtgaacttagcatttaaatatttcttcatttaggttttttatagttgtcttcggtttacccacaacactacatagccttttaaaagaaaacgtaatacagtaatagttccaaaaccttaagataatgatttagggagtttcctatataatataccaatttacctaactatattttaaaattttgatttttcacttgtgatcttaaatgaaaaatattcctgcaaaagtgtaaaatgcttaaatatatattgaacagaaggatatcctctcttattgctaaatttaattttaaatatggaaatgcatgacatttattattaacaaattataaatataaagatgactgtaccatggcagtatcagtaatttttagggaaaatacttattattcatgtttatattcttgtgatatttatatataatatgtattaatactataatttattataatttattcattgatgaatttgcttctttctgtctatttcattctgagccttttttattcttgctgccctggagcagtaggtgtttctcaatggttctttactgaccatttgtttctcactcccctgttcagctcatcaactttcatggttatcactcatgtaattttagtgctccatgtatctagctctgtcctttaacctctaatcgggtcttttatttccaccaatgagcagatcttctccactgtcttatactgttctactccttaaacttattggatgtaaaacattcttggatttttaaatgtttatattactataataaggtgttaatttataaactctttaggacaccttctttttttattttattattatactttaagttttagggtacatgtgcacaatgtgcaggttagttacatatgtatacatgtgccatgctggtgtgctgcacccattaactcctcatgtagcattaggtatatctcctaatgctatccctccccgctccccccaccacacaacagtccccagagtgtgatgttccccttcctgtgtccatgtgttctcattgttcaattcccacctatgagtgagaacatgcggcgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgggaatagtgccgcaataaacatacatgtgcatgtgtctttatagcagcatgatttatagtcctttgggtatataaccagtaatgggatggctgggtcaaatggtatttctagttctagatccctgaggaatcgccacactgacttccacaatggttgaactcgtttacagtcccaccaacagtgtaaaagtgttcctatttctccacatcctctccagcacctgttctttcctgattttttaatgatcgccattctaactggtgtgagatggtatctcattgtggttttgatttgcatttctctgatggccagtgatggtgagcattttttcatgtgtattttggctgcataaatgtcttcttttgagaagtgtctgttcatgtcctttgcccactttttgatggggttgtttgtttttttcttgtaaatttgtttgagttcattgtagattctggatactagccctttgtcagatgagtaggttgtgaaaattttctcccattttgtagtttgcctgttcactctgatggtagtttcttttgctgtgcagaagctctttagtttaattagatcccatttgtcaattctggcttttgttgccattgcttttggtgttttagacatgaagtccttgcccatgcctatgtcctgaatggtaatgcctaggttttcttctagggttttgatggttttaggtctaatgtttaagtctttaatccatcttgaattaatttttatataaggtgtaaggaagggatccagtttcagctttctacatatggctagccagttttcccagcaccatttattaaatagggaatcctttccctgttgcttgtttttctcaggtttgtcaaagatctgatagttgtagatatgtggcgttatttctgagggctctgttctgttccattgatctatatctctgttttggtaccagtaccatgctattttggttactgtagccttgtagtatagtttgaagtcaggtagcgtgatgcctccagcttttttcttttggcttaggattgactgggcgatgcaggctcttttttggttccatatgaactttaaagtaattttttttcaattctgtgaagaaagtcattggtagcttgatggggatggcattgaatctataaattaccttgggcagtatggccattttcacgatattgattcttcccacccatgagcatggaatgtttttccatttgtttgtgtcctcttttatttcattgagcagtggtttgtagttatccttgaagaggtccttcacgtcccttgtaagttggattcctaggtattttattctctttgaagcaattgtgaatgggagttcactcatgaattggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcagacagggacaatttgacttcctcttttcctaattgaaaaccctttatttccttctcctgcctaattgccctggccagaacttccaacactatattgaataggagtggtgagagagggcatccctgtcttgtgccagttttcaaaaggaatgcttccagtttttgcccattcagtatgatattggctgtgggtttgtcatagatagctcttattattttgagatacgtaggataccttcttttgtgatcagtgtatcagtgttccttatgatgtaaatgaaaatatgtgctatgccatcttctatttttctgagaccaacatgattttatataagtatgaatgtgagaatcagtcacaaattgttttgaagcttagtaacattaaagtttatatcaccacaggcaagttatataatttgctctctgtacaatatgtacaacacaaaccaaaagaatgaaaattttatgattctagaacagaacacagtgtcaagcacacagaaggcactcagtaaaacaggtttcatcatcatttctattcttaacagttgaatgaatcttctatatttttctaattataacattggaatcaccatgatttctttaaggtcaaaagtctaaaataatattgaatatttctcctctaatctgtttctatttttttcatttttgtaattaatgtatcctttagatgcaaatttctgaatcaagtaactatcacatcaatatcgttaatctctcctatttagtttactatagcttttatagcattcattctcactttcctttattatagattttttttacatttttttcttttaaacctaagtgtagtgcatactgcttcagaataaatatgacattattattttcttttttatgtcacctagacctggtcttgttgcaaatatattatatggatgtgctataaattttaattaatgggtttggtattagtacattttttcactaatatttgatattaacaattatgtacattcaatataactgtaatttttgttatgtagccatcttttattatgttttattttaaaataaactctcaaagtatgagaatactctgaaatgactttaaaatagctcatcactatgttaatgaagtgaaattctttatctatttcttcattatttattgtaggtgaataagcacgcatatataactcttgaaaataataactagtagtttactattggaaagaaaatctgctccagaaaaaaaacaggctttgagctgatttccatcagtaaaattttctacatatagaatccctttattaagaaaaataattgttttttcttttaatgatttagcaattttgctactttctttataccatgtgactgatatggtgatttgctaaatatatcatctccatgcttcaggtattgtatatagaagaaaataaccaatctataacatccagttggaatatacaattatgtggatagctgatataacattgaatgtgataaacctttctctttcttatccagatttatgagctcttaatcttctctcaggccttcatacttttagtgattaaagattagaagcctaactaatatccatgaaattgtgacatgtttttctctctgagcaagagcattattggatatattatttttaatctcatcataattgaattaaataatctgaacacaacagctgtccagaaataagcatatagtatgttttaatgatgaataacctccactgatataccaggtttcacaaatgatctttctgttgcctttctttcaatcttttaaacaaattatctttttatatataaatcaaagtagtgtgtatagtacgaagttcaaactcacacaacaaaatttattcgttttctctcctgaaagcctttttctttttttatgaaagccacataccatctgtttgtatttactacaggtttttgtcattgtagtaaaagaaaagcaaattgtgtgttctgttgtactgcatgcacactgtctctgtcatgtaagtgtcgctgggagagaggtagctgtttattgacatggcgggacaatacactaggaaatcctgtcctctgtccagttgcacttttgttcccacaagaacctcacacctgtctctttctacctgcctctctctttctacccgcctctctctttctacctgcctctctcttcctccttcctccttaaatgtaacctggtggagaaatgtagccttcaggacagtgaaactgttgacatactgtatagtttttgtacttttccccagtaattatcagaataaaagaaatctaataaatcactcctgtaattctagcacactgattcaactttaatagatattttgctaacatataatgctatttattaaatctacaaattataattatctgcttgtcatttcctgtatcaggggagtgtgtttccatattttaaacatatagtaaagtcagatatagtttatgtaaagtcatcaagccatttaaaacattgaatacagcaaagttcagatttagagtttttcttatttgtcagaattgtggagaaaatccactctatgtaggtcccattatattcctacatatgtggctacatttattcacttgtatacacataagacttatgtttattatacatttccagaggattgaaacttgtgtttttataaaatagcttatggcattgttatgcttgcatttttaatttaattttattttattcttcatagagtgagatagatctattgtttaaaacgcgggtatagaaaacatataaactacaaaataaagatatcatgcaatccccccactcatagataatctccacaaaaactttgataaatattcctttaagcaaatgtactctataagtacaaccattttatggtatatattgcatatgtgtggattttgaacaaattttgcacctgataatacatcattgaatgttttaataaacttaagtatttcaatatcatgctatttaaagcccttatatctttaatggtcatatcaaaatttattcatctaaattattatgtttggctcttttgtttatttctattgctactaccaacattgctatagtcgttttgttcaaattgttttgtatttctgattttttcttagtttaatttctataacggaattagccaaaatatgtaaattttttcaggttctaaatacatagttccatattatacctcagaatttacattcaaggtcttttctttctttttttttcttttttttttttttgatacagggccttgccctgccatccaggctggagtgcagtggcacaatcccactcactgctgcctcaacctccaaggctcaagaaatcctcccacttcagcatcttcagaagctgagactatcccaggctcaagcagtcctcccacctcagcccctcaagtagctgggactacaggcacatgccaccacacccatataatttctttttcttttcttttttttttttttctgtagagacagggtctcactatgttgcccaggctagtcttgaaatcctgggctcaagtgatccttccaccttggccttccaaaatgctgggattacaggaatgagccactgcacccaatctttaggttcatttcaacttgtctgcatgacaaaccaaatttgcgcagtcattaacaactcatgtagctgaatctattatattatgaaacaacatatatctgatatgtactcttttttatatcatgttctagttttcaaatttttaaatcaaatgatagacttcataaacatttttaaaaatctgtgttttagcttttgcctttgtcttttgatatggtttggctgtgtcctcactcaaatcccatcttaaattgtaattcccatgtaatccccacatgttgagggaaggacctggtaggaggtgattggatcatgggggcacttgcccctatgctaatgtcttgatattgagttagttcccaggagatctgaaggttttaaaaggggctcttccccctttgctcttttatctcttttgatctggccaccttgtgaagaagatgtttgtttctccctccatcatgattgttaagtttcttgaggcatccccagccatgcagaactgtgagtcgattaaacttcatttatttgtaaattactttatttgtccattctcatgctgctaataaagacatacccaatactgggtaatttataaaggaaagaagtttaattgactcacagttcagcatggctggggaggcctcaggaaacttataatcatggttgaaggggaagcaaacatgtccttcttcacatgatagcaggagagagcagaatgagagctaagcaaaaggagaaaaagccctttatacaaccaacagatctcacgagaactcactcactatcactagaacagcatcataagtgtaaccatccccatgattcaattacctcccaccagatccctcccatgacaagtggggattatgggaattcgattactgcaattcaagatgagatttgggtggggacacagccaaaccatattgattatccaggctcggacagttctttatagcagtgtgagagcagaataatacatatttcatatcactattatcaccttccaacaccattgtagttttaataccttgaagtgaaaagttggataggaatgaaaactgcttaagaattgttttaaaccttcataaatggaaatactgtaaaattatgacggtatgtaaggaattgtgtgatttcagtgaatgaatgggtacatagacattagcttgtatttgtgggctatgcttattgaggcttgatgttcatatttcagtttttgtttttcttgtcagatctcttgttagcaatgattatggatcaattttaaactagaaataagagaatacatttaaaaaatcaaatacaaagaaaatacactgagttgttttgtcaggctatagtgtcaatgagtctcaagagaaaggatagcaagctcaataatgtctttcctgccttggtgaattagatgggacattgtatcatcttaaatgaattatgcattatgaatactttaaataatattctctgagacttaagtattccacagaatctccttaagatgtatttatttacttttttattttttgagaccgagtcttgcccaggctgcagtgcggtggtgcaatctcggttcactgcaacctccgcctcccaggttcaatagattctcttgcctcagcctcctgagtagctagatttacaagcacctgccaccatgcccagccaacttttttgtatttttagtagagacagggtttcaccatgttggccaagctggtttcatactcctgatctcaagtgatctgcttacctcagcctaccaaagtgctaggattacaggcatgagccaccacgccccgcccccttatttttgaaaaataaaatacaatgctatgcaatgtaaaattttatactgagtctaaatatgtcaaatattcttaaaggaattgaattttcttttttttttttttttttgctttttgacgtttattctctaaattacgaagtaatcactggttcatattatctcttcaatttaatttattaaatgtttgtaaatagtaaatctgattagcaaatatatttttccatctttaaaacccaaaatttgatactcatgtaaaatatgagaaatagagataaaagaatattccataaataatttacataaaaacatttatcaaacagtggagaagacttcccactcaaggttaaagaagagacattatactaaattatgacaatattggggaaatcaattaaaactctatttcttcaaacaaaataatgtactgagaatcaattatgaaaagatcataacatatcaaaaggaatgataacagaatatttataatatctacaggagagaaggttaacaaaagtttccaaattttatttaaaaaacttgcagagaaaaaattgtttggtttaaaaaatacaaacttagaagtaaaaaaaataaaaggtaaagaaagctaatgcaataattactgcaaacgagattaagggccaattattttattacatgaccataataaaaacttaaaaaagccttttgagctggaatcaggacaacaaaatgatattattggatatggtatgtatcgaaacattaaaattaagagaatcatgaaagacaacaggcaacagacaaaataatgtaatcatgagtaatgtaatcactataaatttcaggcttatgtgaaattacaataattatattcataatgaagataagatactatctttctaattttcaatgtgaaacaaaatccagtgctggtgacattgtgctgaagtgggtacactccatcattgccagtggcatcacaatttcacaactgatattgaccaataacatatatacagttatgtgccagataatgaagtttaggtcaataacaaacctcacatattatggtggtctcataagattataatgtagttggctgggcacggtggctcacgcctgtaatccttgcggtttgggaggccgaggcgggtggatcacgaggtcaggagtttgagaccagtctggccaacatagtgaaaccccatctctactaaaaatacaaaacaaattagcgtgctggtgttgtggtgtgcgcctgtaatcccagctactcgggaggctgaggcaggagaatctcatgaacccaggaggcggaggttgcagtgagcctagatcgcgccactgcactccagcctgggcgacagaatgagactccatctcaaaaaaaaaaaaaaaaaaaattataatgtagttgaaaaatacctatcacctagtaacatcatagccattgtaacatcgtagcacaatgaattactcacgtttgtggtgatgatggtataaacaaacctcctgcactcccagtcttataaaagcctagcacatagcacatataattatgtacactacataatgcttgataatgataataaatgactatgttattgggttatgatttactgcagtatagtttttattgttattttacatacagtgtttacatatatgtatgtatatttgtgtgcgtgtgtgtgtgtatatatacatatatacacatatatatacacgtgtatatatacatatatacatatatatacacgtgtatacgtatatacgtatatacacgtgtatacatatatacatatatacacgtgtatatgtatacatatatatacatgtgtatatatatatacacgtgtatatgtatacatatacacgtgtatatatatacacgtgtgtgtatatatatatatacacacacacacacacacacacacacacatacacacacacacacgtatattaaacatcctcaggcaggtccttcaggagatattccaggagaaagtgttgttatcataggagatgacagttctatgtgtgttattgcccctgaagacgttttaatgggacaagatgtgcaggtggaaaacattgattttgatgatcatgagctagcataggcctgatttgcatgttagtgtctttgttcttaacaaaaatgtttaaaaagtaaaaacaaatgaaagatagagaagtgcttgtagaataaagagataaagaaagaaaatattttatacagctataaaatgtgattgttttaagctaattgttatttaaaacactcaaacgttttaaaataattaaacagctgataatgcaaaaacttacagtaagccaaaattaacttactgttaaagaaagaaaatatttaaatttagtgttacctaagtatacagtgtttataaagactacagtagtgtagagtaatgtcataggtcttcacatttactcatcactcactcattgactcactcagaacaactttcagtcccacaagcttcctttttagcatcctatacaggtgcatcatttcttatgttttatactgtatttttactgtacctttaaaaatgttcagatacataaatatttaccgttgtattacagttgtccacctgtacatgctgtgcagatttgtagcctaggagcaataggctatatcatacagcctaggtgtgaagtagcctatcccctctaggtttgtgtaagcacaaatctgtgatgttcatacaagaatgaaatcattgaagggtgtatttctcagaacacattcctgtcattaagggatgcatgactgaaaatcatttttcttgccccttctccttctggaaatctgtctccaagatacagcactcaatatggaaaatatatgtttaaaccacctgtatttatagtaacagaacattagagataatctaaattatcaaacaatttaacattattaaataaattgtaggtagaatgttataagcagaagtcacaaaatgagttttcttggaattaaacatggaaaagactgaataagtgggaaaataaatacaaatgttaaatacagtatacttacaattatgtttataaaatgtatttgaaaactattttaatattgtaccccttatttgcattttttaaaattcccataactaaatatacattagtatatcttctgagtttatatttaatggcatcttaaataatatttttaaataaataaagatatttaatagttttacacacactcacctacagttatacacacacaagctaatgaagatatgtgaatattaagcccagtaaaatatttactgctttcaggactctctgtttcccttctcatcttcaatctttttctacttttctttttcattcactcttccctcccttcatccttctttgccttgtctttttccattttacaaatatctttctttgtttctctttcatgactgctatattttaaaaaacgtttaccattgtttcagaataacagaaagaccaggtacagacattgttgagttaatcaaataagagtaaattatttaatggtgcagaagatggtatggcagtgaggatacctagcagaatggtcagcaaatttcttcaaggccactgtcaccaatgacctgatgaagtgatgccacttcacactgctctggaagtccaaacattctccataagatagaaccataaaatgcgatgcaacacggaacatcacacatgttctcatgtctcgtttgttacttccagactttccaaagttacacaaactggttcaagcatattccaggatatagagatgaaaggatgagtgtcagttacctggggcttcccaggctgacactaacaggctcttggtgtggtatagagactattttacctgtcttctcctcttttacatgttttcttttatatttattcattcagccaatactgcttagtgcctatcaagttcctggcgtgtgctaggtactgagggtataaacacctggcccctggccacaggtcatttacagttcatacagtaaccttgatggcagttcataatgaccttgatggcagttcataagtcctaagtacattaactagaatcttttagcttctcctttttttttttttttttttttggtgaaggaaagatcatcctattgagtttctttatctagtataagaaataagctccaatattttaagctggatataatacaagtttatatgtttgtttgtttagttattgggcatcgcaacatggcttagatcaatggttgagagtgtttattctactccaggcatttagggatccagggtgctcaaagctctaccattatcaacataaggcttcgttcacactggatatcactatctagtctgctgaaggggaaaaacaatgagagagatcccttggaaaatgtaatggctgggccagccatcataagttcatccccaaacacaaaggaggtgaaaatggtagtttatttgtgagccaacaaagaagagaaaaagatttatttcagaaagggtcagctgtatctgttatacttggtcataaaaggcactcatcaatgtgatgttttggcatgaaaattatcaacatagattttgtatttttcagttatctacatattacatttttgtagaaaatagctgtttagtaaaaacatatatgttattttctcagcagaatcctttaactctgaaaataaatagtcttctattgtacatcatctcataaattacaacagatgatggaagcaaagaaaaaaatgtatataattcttctcgattggacaaagagtaaggccaatgtctactcttaaataaattgcaaacatatttttagctcaaaaccaaatactagattattggagttttgatggtaatttatttctaagtgtacccaaaattttatttccaagtgataaacaataactaaaataactccatgtttctaaatagaaacattttggtcatactaactgcaatgtacatcttaattgaaaacttagaaaagattattcaaaggctatgtagatatttttaaatatacccttatatgtacctaacacatatacacacacagatatacataacacatagagctgatatattattccttctatgtatatgatatattattattgatgtatataatgacatataaatataaattataattacatatataaaacatatatatacacatacatatatgcatgtttgtgtgtttatgtttgcagatgtttgaattcactctgaaagtacaaaaataattatcagtgattctcttgtccatgcttggtgaaataaaacagattctccagatgccccagggctgatttctccttaaaatagccagagaaagagattagagatgctcaattctatgggacgtgaaacatacaaaaaggactttgcagcactttactaaactgagaaacagattttaatttttcccagaatattccaaacacctaccagggcagaaattgttagtatgtaagtaagtggtattaaaagtaattatagatagctatatagagacataaagtttataaataagtcacatagatttacatccacctctactacttgggattttactaaggtactcttagttcacagttttctgctcttgagattcttatacgaattatgcatgacaactgaaaatgttaaccaatggtaacatttttctaatacagtgatcgtgcaggagaaaaagataaattaaaaacatatatattttactgagcatcacaaatattctataatactttaagaagtaaaatatatactgtattatcaatactaattggaaggcaataactatttatattacaagagacttgttagatatattgttaacaatttgataaagaatttaaaggcaggataatttggtaagaaatggtttcttagtattcataactgaaacaatcagtattgaatgtaaattatcactaaatattttaggaccttttttgttggcaatcctgtacagaaaattataaggagcatcactctgtaatgaaagaatttaccagtaatcaatatatttaacactaactgctgatgattaggaatgatgttgacctactcttttagcctaagaaaggtaatcaaagtgttatcttttgattttcctcccacaaataaattatttagagagtggacagatcaaaaagattaaaattgaacatatatacttttcactgcataaatgaaattacttagaaagtatggaagaagtaaaccaaggttaatttcaatttagcatctaaattagacatagaattggctttcaactgcagaaacattctccgtttgcaatgatacctttttatttgtttccttcatttgaataaaacttagcttatttaaagtacatgtttcttacaattatgccagagtaatgtaaataaagatactataaaatcagttttcactaactactatgaaaatatcatgttgttctaaggtagccccttattccatatgttcataatttgatactttgggggaaactaaactgtgtatttatacttggatatctgaaactttacatgtaaatttagttccttatgataaaataccttgtaatgtatgtattttcaattggtatattttcttggtgagagtaacatcctggtcagcaagttaatttactggatgatgggatccacaaatctgttttcacacctgttatgcctggcagttactctttgggaatgtgtagttatttgtagcttattattatttctgttcattcttaacttttctcacattgtactctattttttttaactttgctatctatctacatatttcattaaattctttagcaactaggaatgtccagtatgtgctataaattttaagtgttacctcttcctttgtttttaagtttgcctgggcactctattatagttaaaactaggagcagcacttatcttttaactgtcctcttaatgtgtattctttaagtggtataaaatctatacaagtacatgctacaataaattcatacagggaagggaataaaatttaaattcatcatctcacagctttatcagaattccattgttaaaatacccagtgtttttgcatttagttctttttttgcttttattgttgtacttctgcaattgattctcattccttttacctttaccatcatatttgatgctattgtgaaatgatgagcacattagctcactgtattagtctttcttacactgctaataaagatgtgcacgagactgggtaatttatgaaggaaagagatttaattaactcacagttcagcataactggggaggcctcaggaaacttacaatcatggtggaaggggaagcaaacatgtccttctttatatggcagcaggaaggagaagtgccaagctaaggaggaaaagccctttatgaaaccatcagctctcctgagaatgcattcactatcatgagagcagcatgggagaaaccacctccatgtttcaattatctccatgtggtcctgcccttgacacatgggggattattacaattcatggtgagatttgggtgaagacacagccaaaagatatcactcactatctcctaaacttcactccacttgtgcagtcgtatcttcagtcccaataactctttttttttttcctgagattgttatttttcataacaggtgcttcttgtttgggttgacgtaagtttgaaatgtatgtttgtgaatgcattgtgtatgtgtgagttagtgtgtgtgtgtttgtatttgaaagcatgaacatttgaaaatatatacatgaatatatactgaaaaatatgtatgcattttttttcctatttactttttgacacctattcagattggttatcttggtctcttctttcttcagcgtgctttctttaaataaacacaccttgtaatttttgatgttccaacatgtttatgattaaagacatgtttaatataaatctctataaggttttatctgtaatttcattgggctattttccaaatacatcagtctaatttgggatattttgtagcactcaataggaatttctcatatttcaaatatgaattgatatgtgtagttttctcttaatttttgtcctgaatatacttttttaccacttaaattttaaccgttgcttctcttttattcacagtattaatgcatacatctacaaaattaaaccaaagaaaaacagtttgatactgtttttagccttttcacctgttcttttcctaaaattggatcaattatattaacaaaaatcagcatgaaagataaaagtgattagaaattgctttttgaaaagcagcacacattattcataatatcagttcataatcccagatgatccaagtgctagatttgagtggtatttttaggatatttagtaagtacagaaaatataataggtcctgaaatgaatgcaaagatgtggtagaatcaacttctgtaaaatgaccaattactgtctcctaaaaataatctgaattgtatggctataattttaatagtttttcattttgaaagtctcttcaacttttttgtgaaaatatattcctttttcaaggaaaaattataactctagtaactagcttaattaaatcttttttctttttccatttaactcccctccccatacagataacacacagaaaaaaattaaagcaggaaaacaacctcatagtttgactattatttagtgttccaattcaaggcaaaaggctatggaagaatgacataaagcaatatgctgatttcctctgctgctttctagtccacaaaataatcaacaccattaaatctacttcaggaaacaaactatatatcattatgtcaacgctaaagatacaccacaaaatggatttatttttctggcagataaacatgtatttgatattcattactttttaagtcttgtctgtaattatttttaaactctaatcattttattttttactttatttaattggaactttcctgcctaccaataatgcccatgaataaaatataataataaaaatatatcagtataataaacaaacagaaattctaaggattgctcattgttaccctatactgcatcagtcaacataacagaaaccaatagagagacaataagcagtactctagttctttaattgattaataaatcttcctctatgtaagtactaaactcatttattattcagtcttaacatattcagtattgattctgtacacagacttcctgtatttttgttgtatttaacaacatcctcattttaaataatttataaatatttgtgaatatgtttttcaccataggtattctagactttaggatctagttgagattgtatgttgtttcaatgtgctctgtgagtactgtttgtgtctttcctcctgtgaaccccaaaatagatacttagagcacagcagctcatgtcaaatgttttcttagaagttgagtcttaaaatatcacccaagtaattgctttccataattgtgtagataaatatgtgtttgctagtctaatttccttgtcagataagtgaaatgaataaaatagataattgagactgaattcagatggtaaagtttctataaatttattttctgttttagaggctctagtttcaagcaattgaacaactgtataactacattttactattgtgacaaatcctcatttctccaaaatatttcccctaaatgcctctcatatcattgaatatgttatatgaggtttgaatatatattgaatgtcttgaactatagatttactagctgtgttatatagtggccagttctatgtgttgtaaaaatggtgacagcttaaagtgcaatgaaatataatttcacaagttatttcagcaaaatagttttatttttaaggatattaatatgtttatttattctgtgaaataaaccaaagagattttatgtgctaataatgaatggagagtattaggaagaaggacacataaggtactggactgatgtgtgtttgtgtatcatatatatttggctttggattgacagcagagcaacagagacataaaaggatcagttaaccagactcttggaacactcactaacctaggaagcagagttattaggttagggttctgcctctgttgcaatttgaaattggaaaagtataggctgggtgcagtggttcatgcctgtgatcccagcactttgggaggccgaagccagcagatcacaaggtcaggagattgagaccatcctggctaacacggtgaaaccctgtctctactaaaaccacaaaaaattagccaggtgtggtggcgggtgcctgtaatcccagctacttgggagtctgaggcaagagaaatcacttgaacctgggaggaggaggttgcagttagctgaaatggcgccactgcgctccagcctgggtgacagagtgagactctgtcttaaaaataaataaataaataaaataaattggaaaagtataattaggataattacatagaaaaataaggaaggatcttttcagatacagtacttatctttttggcttctgtttctctctatgttcaagtaagggataagtgagttgagaattagtgacttgctaattttgtatttagaatgtaacagatttgatatttttgaaatgccttcagattcctaaatatttataaccatctggatacccctaagtggggagaagacaaaagcaaaatagaataatgataacaaacagctggcacctttcctcctccccacctgcatagttgaaaaaccctgagtatcctataatgcaaatgtgtactcttaggtaaagcttccagattttcctaaaaacgcaatcattttaacacttctagaaagacatatgtattaatcccagagttctatactctataaaataaggtatcataattaactcagttttatgacatcagagtcctacttgactctgtttaggtttctttgggaaaaacatacacaagttccaaattggatagactgatgcccaacactttctaaactcctgtggataatgctaaaaatgccctatttcaaatagatactgtcaattactcatctacatatttgttagagaaaaaaatactagagaaaatacaaatactaaagcttgttagataaccgtcctttaaaggatgtcctgcttgttctagttacatgatttctactgtaaatatacttttaaaatgaagttttagtatgccacagatatataagcttttattctcatttatctgtagagaatttaagtgccttacccagagagaaaaatacttagctgatgcattatgacactctgggtctcaaacaattgccagacatttctagtcttttccattgagtcttggatttcttcccaaatctgtgctcatgtctgccacagccaattgaatggaactgacactgaagttgaagcctattcaccccagatctaatcaaatatatttggtccatgagaacatgagataaactgattcactcttaaaatagccaatcactgccattgaaccaaagcaatgaataacctaatctaagtgaaggagaagtatcctgtttattttgtgtggttcctgttgataaggttttagcagagaagtgtgggttttaaaataaatgctgtgtgctgacaaagttttgaaaaacacttttaagcttcatattaaaattaatatttcatttctatccattaatatttatatgcaatgtaacataacattacatgtcaaatatttgttattttcaatagctatttgtggttaggttctcaattttataattaaatactttcaattatttctcgatatcaacttttatttggtaactttaattccagatagtagttaagataatcagtaagaagacaaaatttggttcaaaatattttctcaattttagttaatgtttttcacatatcatgagatagaaatatcttcctttttaaaatattttctttatttcaatttaagaaatttcaataggttttgcagaacagctgttgtttggttacataggtaagttctttagtggtgatttctgagatttttgtgcacccatcacctgagcagtgtacacctacctgatgtacaattttttatccctcaacccactcccaccttttcccctgaatacctaaagtccattatatcattcttatgcctttgtgtcctcatggcttagctcccacttataagtgcgaacataacgatgtttggtttcccattcctgagttatttcacttaaaataattgtttctaactccatccaggttgctgcaaatgccattatttcattcccttttatatcttagtagtatttcatggtgtatgtttgtgtgtgtatcacatttattccaatgtgatattccagtagtattccaattattccactgtgatatatatgtatatatcacattggatatatacatatatatgtatatatctcatatttattcaatgtgatatttagtagtataccaatgtgagatatgtatgtgtctatttaatatatatatatatatcatattttctttattcacttgattaatgggcatttgggctggttccgtatttttgcaattgtgaattgtgctgctttaaacacacgcatgcaagtgtctttttcacataatgacttcttttcctctgggtagattccaagtagtgagattcctgcatcaaattgtaggtcaaaatttaaaatgttataaaccagggattcatcattttcttttataatttgaagcaggtggtaggccaaaactggccaaatacattgccatcgtattttatctattcagacaagtaaatgaattattgtttagcaaaaatttttcataatctttttgcactttccagaaaaattaaaagaaaaattcaattacgaaaagaaagatgtacttgtttgaatattctatttccagactgacattctcaaaagttgataatactaagttgtcttgcttacattctttttagaaatttgggggcatattgttccagtccaaaacttatatttggttttgaaatggacaagactgagctgtgagggcacagtctgctttatatattgttaagctttttaaaataggagagaaatattatttgtttctgcctctacatgaaatattatgtccagaggcagggaagtgacagtgaaccctaatctgtcttatacctagatgggtttctgttataaaaccttgaaaagaaaaaatacacatatctcaaaacttgttttctttattctgaatacaccactgagatctaagtaccagatcaagcaaaacccatttcggagtcttttgggagacattgagaatagacttaatgttatttttctgcgcccagagaagaaacatcctgagaaaatatagtgtgatggctatggctaatgaaatatttgattccacatgtgtagctgtgcttacttttattcgttactgtcttatgattacaaagcaggtgaagctttcaatcatgtttgaaaatgtatgcttaagttgatctattgtttagagttaggcattgtgaaaaaaagcagtcttggctacttcagtataattacatttttcctaatacactagctttccttaacttgcttgagttcttgagcaaactctgggcacatttaatatattttcttcacccttttattttgaaataattagatatccacagaaagttggacaaaagtacagggagatcccatatactctccattctttctcccacaataacatcttgcataaatatagtatgccatgaaattcatacttgtacaatctacgaagcttattcagatttctaaagttatttgtacacttatttgtgtgtgtgtgagcgtgcatgtatatatagttctatgcaactttgtcatccatgtagctatacgtaactacaatcaagatgcagaactgccctagcacaagcctcccttgtgctgcactaaacagaaacccttacagagggcaaccgctcctatgtatttcatctctatgattattttatttttaaaatgttatatagtttccacgaggtttgtccaagtcgttgcgtgtatcaacatatcatttctttttattgttgagtagtattccatcacatagataattcagtttgtttaaccattcacccgttgaaggacatttgatttaacttttgacttattataaacatttgtgtacagatttctacaataacaaaaattttcatctctcagggataaatactcctgagtaaaattgctgctttgtgcgataagtctatttataagttaaaaaaatcctgacagattaatttaaggagtggatgtcttgttttacatttgtaccagtaacacatgaatgatccagtttttctatgtcttcatcaacatatttttacattagctattctaaatggtgtttgtgatactgcattatggacttaatttacacttcctcgatagctaatgatattgaacatcttcaatgcttacgtactcactgtatattgccttcagtgaaaggtctgtttatttcttttgcccattttctaattggatgtatttgtttatttgtttactgtgagatttgagagtttattatatattctacataaaacccttttgtttgatgtgtggtctgcaaatattttctcactgtctgtaattttctcactgtctctttagcctgctaacagagtctgttgaaaagcaatagtttgtattttctttttttcttttttttttgagatggactctcactctgtcacccaggctagagtgcagtggcgccatcacagctcactgcaatctccacctcccaggttcaagcaattgttctgcctcagcctcccaagtagctgggagtgcaggcgcaggcgccacacctggctattttttttttttttttttttttttttttttgtattttagtagagatggagtttcaccatattgcccaggctgattgcgaactcctgagctcaggcaatccacccaactcagcctcccaaagttttcagattataggtgtaagccaccactctcggcctgtattttcaaaagagtcaagtttattctttttttctattatggatcatgcctatatatatcctgaagattttgttcaatgtcttttttcctataaaagtgtgattttataattacatttgagcctttgatttttttgtgggttaattttcatacaaggtgtgaaccttatactaggtcatttccagtgtgtatgcttttaattttttttcttaccttatttccctagctagaatgtccagtattatgttgaataaaacttgtaagagaaaacatccttgcaattttcctgaccttaggataaaagaggaacttagtcttactttattaaatacaatgttgtctgtagggtttttgtatatatgctttatgtagtataggaagtatcgtctaattctaaatttctacaagtttatataataaatgttttgggattttattgaatgctttttctgtatcattgatatgattgtaaataatttttttctttattctgttgatatggtggattacatggtttgatttttgaatatttaaccagcctgcatatcttgaataaaccccacttgaccgatgtaaattttatacgttgctgaattaattgcataatactttgttaaggatttttactcttaagtttatgagacagatcagtatgttattttcttgctttgtactatccttttctggttttggtatcaaggcaatactggccttataaaatatgttgggaaatgttccttccccttctatttcctgaaagagattgcatacaatttgtgttaacttttctttaagtgtttggtaattttcttaaagccatctaggcttgggagcatgttggatattcaggtgacatattccaacttggttaagtttctttctttatcctccccatttttaaagtataatattctcaagtattttcttcggattcatttagcaccatatcagatgatgttcattttgattaagcagggaaatagggtctaaaaaactcataaggagtaacacagtctattgcatagatctctgtttttacacatctcattgtttttctttcctttcctctattaacatattatttttgtttagagtgcttcctttagctatgatttaatggtagatctactgagagcaaattatcttagtttacttgctctgaggatgtgtttatttccccttccttccggaaggatgtttcattgaatactgaattcactgttgacagttcttttatttaatcacctgaaatatattatgctacttccttcaggcctcgatggctttagattagatatctgctgtctttcaaactggtattctctttaggtaagacaccatttttctctttgcttttatgagttctttccacattcttaccttttactttttaaactctaatttgtcttggtgtgggtatcttttggttttatcctgtgtgagcttctttccctttcttgatgtattacatatttggtggagcgtgcagcaaattatttctttgagtaatttttcagtttcatattctttctccttatttttctaactccaatgacatgaatattagatctttttgtgttgtcccaaaaaatcaaaatgatttttgagtctgttagttttttagtcttttatttttctgtgttgaccaaatttttttgactggttctaaatttcactgattctatgcactatcatttccaccacttctaaggacatccagcatggtttgttgtagtagttactgtgtttttcagttctataatttccatttgtttgttttccaaaaactgttatttttctgagattttctatctcttcttctgtttctgagaatttataatggattgatgaaacattttcattatgcctgttttaagatatttgtcaaataatactaaaatctgattcatctcagtattgatgttagttgattgtctttctcatcagattgtggatgtctccctccctgctatgatgacaggttttggattaaatcctggacttctagatacaatattagcagacttttgatcttatttaagtcattgatttcaccattcagttgcccttctttggcttagtgtgtaggttctagccttcttttgtgtgctagaatttcaatgtagttttcagatcccttgcactctttgcctgtctgcttcattttcctagcacttctgtatccccagcttgatccctgcttgtgttgcctataggtttcctgagctacctcctggaggtggaagggagcatgtaggaagaagctgctgggcttgctaattctctttcactggtagaggactggcagacattgggcctggatatccatacacctctagatggagggcttgaagataccaggctttaccactgtaggataatcagccttaccaccaccatgaatgtggagcagagattgggggatccacacttagtgtctattgggctactccgttctttgtcatttggccagagaggcaggctgtttttattttggtgctgatgatttgaggttgtaggcctccctggtgcccaattcaaatgtaatggtaaatgaacagaaaacccagacaagccactgcaatcccgtttcttgaatcttgaagtccccagcctggtactatttgtctttccagcttttggaatccttttatggctgtctattgtgtcatttcttgagtagttaaagttagagggagctaccaaaaaaagtgaatctataccatctcatctgggcatgtgtaatacatattgaagaaatggacatagcatgtatgtatccatatcaataaacataccagcttaatatgctgatattaataagacaggtagctcattttcaacaatgatattgagtgcaataggcagaggacagaaagaactacaaaaacagaaactactatcataaagtacaatgcatttctccaggcatgtgcaatattgaagggagttgaagatttatatctctatcttctcagccagtcacagtaaacattcaccactcaaatcaaaaacttagttttaggaatggtgaatctagtacatttaataaattatatacacactttagagacttaggtttttctgagttttatgttttaccaattaaatatatagtttctttgttcccttcaatgttaaattaagtggaataggtagactttagctgtttctatttctggtaaaatgtaataatattaaattatataagacagttaaaacttcaggtaaaaacaaaacaaaattgatagcaaatgttttagtggaaattccattactaaaccagaggagtagtgggaaacgaacaatcatctggagattagaagaaatatattaaattggaaaaggaaaaaggagaagatgtcaaggaggtacattcatcctgacctcttcaattcacctagctctttaaattaaaagtgaataacattttgtttcatcttattggttgaattagttaacctggtatttatgttcctggtatttggtatatttgaagtcacaatgaatacatgtaactactgatttttggtaatacaaaatagctattagaaaaaaactgcttatatttcattgcttttagaatttattttttataaattatcaaataataagatctccccaaatagcacagcattgggtatatttctttaaggggaggttttaaatatttattttgctatctttttcatgttaagatttaattacaaatagaacactataatactctaaagggtcaggtgtcaggatattcgagtgtttttttaattattcattgactggaatcctttggtcccaattctctctaaaagactcaggatattatacagtttttacatgttggtatgaaaaaaggttaacttgtttgtttttattttctgtaaatgagatcttaaaatttatggcagatgatggatcagaggactgttattcaaatatgacatttaaatcacatctcagtttagagcttgcaatggctttcatatcttgacaagattggttatttacaatctgagctctatcttgggattcatatgtttggattccttctatatctccttgaaatattacatttagcttcatgtttcctcccaattcactttgagaactgaattacttagatagatatggtgtagtggaataaaaatggcatttagattcaagagaccacatttgaattctaacttcaccatacagcaactgtatatgcttgtcaaatcctttaacttctctgattcttacttttcttacccccccaaacaacaacaacaaaaagattattacaatcattttccctctgggtacctcacagtcttgtcaggaagatgaatatgggatgatatgatgtaaacacactttgggaattattatattatgatcactgtttctaaaactgtctctttacaagtaacttgcagctagatagaactaagctcaaagaggcatcatgctgtcatgaggcacgagggtcacctggcagagagtatatcagaagacagccttagcccccgacatgggtcacccagtcccatctccaaggcctgtgtttgctatgtgccagtaattaagccctaacagtgacaagaaatccagaccagctgcttcctcgactgctgctgagagtcggggcatttcttgacaggggctatgctcctgaggtttgcctcatacttccaccttgacctctattttctgctcacactttgctctatcttttgaactgatgtcaaaccaaagcctcattctttaatctgtctccagaaagccttaaaggagataggtcaaaattagataagaagggtgacatctatcagcttgtggaattcatttggaaggactcaacctgtgggcttacttgtttcaggaaaacatgagtaaaaatggcagattgaaaaccagaagtcaaggatcaaagttaccctccagggatttgtagaatggacatattttccgtggtaaatttgaatattttataggaatatcgctcccttgataaaaagcaaaaggatattttatttgtatatgaattgagaatcaaagagacacttctaaatggtagcattcttcattcagccgtcagcaattcacagctgaagtagattgtacttattggcaagggccaaactttaagcactttgatgctaatttaacatattccaggaaagaatgataatccattgaaggaaaatcatatgtgccttagtgcagggaatatgaccacactgaaattcttcttccaaaagggtgtctgtatcctcctgatatttcaatactagttgggaatggaacatcatcccctgtcagagatcttcataatcttgatccctggtttaatatacttcttgaccctgaaccattatttatctgctctttaggtcttatttttttgaagtctgctttcctgattatgtcttctttgtgacctggacctaaacatatctgccatgtctaggctcatataatgctccagaaggtcaacttgaagggagacagtagtgtgcaatgaaatgaacatgattgagaagatggaacattcactttagtctcagtttttcaactagcttcatttatgatcttaggcaaatatgtctgtcaatgaatcacattttttataccttaggagttaggcagggtagatgaggattgttttttgttttttgttttttttgagaggcagggttttgctctgtcacccaggatggtgtgcagtgacacaatcacggcacattgcagccttcatctcctggtttcaagtgatcctcctgcctcagctttccaagtagctgagactacaggtatgtgccactatgcccagttaactcttttttttcttttttgtagggatgggggtctcgctatgttgcctaggttgttctcaaactcctaggctcaaatgatctacccatcttggcctcccaaagttctgggattacggacatgagccatggcacctggcccaaggaagttcttaaaacataattagcaaacagtacagagtacatgttcacctcactggcagtaaagttggactacttctactcagtcccgtctcaaccaaacatgtgctatgtgcattttaacaaattagttatcttattccatttgtgctgttatgacagaataccaggaactgagtggcttacgaacacagaaattcatttctcacagttttagaggctgaggagtttaaggtcatgatgtcagcagattccatgtctagtgaacacccttttcctggattatagacttctcactctttcctcgcatggtgcaaggggcaaggcagctttctggagtctctttataagagcactaatcctattgatgaggactccaccctcatgcctaatcacctcccagaggtcctacctccaaatactatcatattggggattaggtttcaacacagaatcgtggagaaacacaaacatttagtttaaagactttactctctctgaacttttctttcaccctccccctttaggatggggatactattttttaaataatagactggaacttttattaggcattaaaactatagaactaaacaaggaaaatatagttccattctgtatcttgaattctacttggggaaaaaatatgcaaacaatacagaataattggagactttttgttgctattgttgttggtggtaagtgctatgaagaaaataaactagtacttggagaaaagacactagaggaagggctctatcttaatcggggtgattagaggacccttctctgaggagatgacattgacaggaaccatgaaaactgagaaggaactaggaaaaaaataatctctagatccacaaaggccagtaagtgaaaatttcaacaaaggtcttcttggtcagtggtaggtactgaaaaaaaattgtgtgaataagacacaaatgatgatttatgcaggaaatgatttatacagagctacataagccaaatagtaaatttggatttttttcctaagtgtaggtctcttcgatacacatttttgaaatagcagtctggctgatgtgtggagaatgagctggaggcaatatctgaaaattgaagatcagttaagagaagagtgcaatgagttaggacagagaagcttctgctttaaattaggaagattgtagaggagatagggtcacatgtaagctatatttttacaatatttagaacctattgacttggtggaaaatatatattattattactataaatactataaatatttactttatctttaatattctcagtaatcagatgaatagtggattttatcttcaaaaagttaaatatgctaagcctctgttatgaggctttcttttttgaggtataaaaataaagttaaaagaaaagtactggtctctatatacataagtaagaaaaaagtgacaggttgatgcatgtagatgcaaatattgaaaacattcagcttttcttgcacaatcactaaaaacttgttaaaataggaactatgcatttttgcttgtacaactagagtaagtcacataaaagaagaaagaattcccaaattttggaagcctatggattcttatctattacctcacaaatatataaagcatttaaattaagtaaagtctcctttaaattgatgagtctttccagtccaaaaactgatgaaaattttatggtattatgaactattattgagttctcaatttaacaaatcgaaatgatcaccagtatacatcattccataccacaagatgaaagctttgctttacattatataaatttcattctgtttcaagaatggaaagaaaatatcttgagtctaattactctataaaagacaaaatattttccagcagtatgctttaattcatgattagtgaacacggagttgcaaatataattaagacagaaaattgtatcaaaaattgtcagcactttcaatctacttaagtacaataaaaaattagacactttttaatcagtgatgcagtggtgaaatcagctttaaagctaaataaacctggattataatttcaaaaatagacatttttagaaattaaataagtatataataaaaggctagactgcctttatttggttgcttgtaacattgagaaaggaaattttttttattgaatttcacaaagacaagaatcacatttaaaattatgccattaaccttcaaaaaatatatttgctatagactactgctagatttaaagtagaaaagaaaaagaaaaagtataattattaactgttgttgaataattcatttcaaataaaatttactgacaaagtgttttgatcctcattggtaaaattaacaaaaaagatttttcatttatgaaaggacacttaaataacatattatatctgaaagtattagttctatcctctaaatattaattacctttcttggtatataaattcagtttttaatgtaattaaatacatttggagcatctctttgtttatgaacttcttagaagtttaaattaagattaaacaaaaaaatggtccaaatgtatttaagtacattaaaaattgaatttatattaaatacatttggaacatttctttgtctataaacttattttaaagtttaaattagaattaaacaaagaaatgctccaaatgtatttaagtacattaaaaattaaatttataactattgaactactagtgatttttttaaatgagaacatgtctgtatacagagtacctttataactttaaaaggcatataataggcaagcatgtttattttttctacattttttggtcaacatcatctaaaaataccaagatatatactttatgtcctgatagttatttcaggaacaaagcatgaagtagaaagtcaaagttagccatgacattgaatatggtaactagaaaatatgaataagaagaataacaagtcatattcatgaaatttctgatgacatatgtgatttattttggtaatatttacttaattattctagctataaaatgagattataaatgtatgtaccttattgggttatggagtgcattttatgagaaggtgtctaactgctgaaagttgccattgctaaatgctcaatctaggatatcggaagtcataataataataaaaaaattaaaataaataaacttgttgtttcagtcaggaagtctgaagtctaaaggatatgagcagaagttaaccatgacaatagagtaagttttccataacccagcatcattgagtccctcatccctaaaatttctcttttcctttttccacaatcttggaaggtttcacaagtttccatgaaacatggtcattacatttcagtgactccactgcttcacagtatacaccctctaaatctctaaattcagttatttttaaacaccatctcccaaaaaaagtctatgtatccattgtttaaatatatatatttaaatatataaatatatatttgctatgtatatgctatatatatagcaaatatattttatttgctatttatatacactatatatatatatagcaaatatattttttcaaggttagtgacataatttgaaatgtgattcttgtctttgtgaaattcaataaaaaaaatttcctttctcaatgttacaagccaccaataaaggcagtctagccctttattatatacttatttaatttctaaaaatgtctctctctatatatataactgctgaaatttttttgttcttcaaggatgtagtatttctaagaggaagtctcatttctctcaagccctctttgaaaaaaaatatgtacatatatataatgcaatagaataggaaatgtgtgctgcccatagtgaggctaggtattgttcggttatactttctttgaaattgtacattgtgtgtttctgtgtatgcaggtcagtctatatgtgtgcatgtgtggttatatgtttgtgtgcattcgtttgctatagaaaacatatttgcaatcaaaactaattgaaaaattccattgtaatgtctgtttattttctgcagatattacttagagtttctgttttcaatattggtattcagtttaatcctgttcagccattgtgcctcacacacatcagggccatatgtaaatcacatcttcactaccccaccataacacctccttgttactttcttgttgagaatgccagttcatattacattgcaagtgctcaagagagactagtatacagaatgaaagaataattgcctaatcaaatgaatgagtgataggtgtccagaactggcccttttctgtaaccataattatatagttacaaaagacccttcccacctcagtttcttaaatttctgtccctcaacagtgtaaacatgaaggatataataattttccaaatgtctataatgttttaaactaataaaattggtcatctgatttataacattggttttcaaaaaattgctctaacttttaatttatagtaacatatgagtgtacataaatacttgaaaagagtatatatggccatgtttataattacagtggtattattactctaagaagtattttttgaaactgaaaatcacaataattgcagtatctgtatctatatgtataatattattacatctatattcatttctaacctattttttaacttatttgtcagtttctatattttatttttaaatcttgaaacatgaaatttctattcacataaaataagtaaatgaattggacatatattttaagaggagagtgttctaaagataagtttagggctattttgtttaaaacttcaagaaatatattcagaatctcaacattttacccaaaatgtaaaatttatgttatactagagcttctagtttttattttttttctttaaagaaaaacatgacatctaagaagcaaaattgtggcatatttgtagtatctattaattataatgaaaaccttagagtacctatttgacagctctttttgtgaaagtatacagcacattatttttaatcattgttgtattgctttaaaaattttaaattcatggtatacagtgtttaaaaacataaaattcagagtagttcaggttaaaggactttctgtttgaacattcccatggctttcctcaacattttgtcctaatttttagccagagaaacaaacatcatttataattaattatttttttaaaaaagaaagtgctctttaactttcaaaacatttcttgttgaaaaattaagctaaaacaaaaacaggctgttgcactttttataccgaaggggaaattttaaaaagtaacaaggcaacaaatgactcagaaaaacacattttaaaatacattggaatcaattgtgtgacagaaagagcacaggcaactttcagtgttactgagaataacagaattattaaaacttaaagcctcagtgttaagatgctgtgttgtatcacgctaattatatatggattttttaaacatgagttttcatcactatgattatgcagaacttcctatatgtgatctacagaaactgggaaaataacagctatttcaatcatacagtctggaacaacagtactaacaggtgtgactaaacaattaagcgaaacacatcaggaacaaaaaaaaaaatcacaagtttggaaatgagcattgagaagacattgggacagagagagagtgagagagagagagagagagagagagagagagagttcctgactgtatgtaaaagctagctcagtgcttatgaacaaccaatacattaagattctttattttccacagtaaaaaaaaaaaaaaagtttttaaatacaaaggggataatgaatcacttaacaaagaagatacattctgagaaatgcgttgttaggtgtttttttgtccttgtgttaacatcacagaatgtgcttaaacaaacccagatggtatagtctactacacacctaggctataacgtattgcgtattcctcctaggctacagacatgtacagcatgttcctgtactaatttctatgggaaattgctatacaatggtattggtgtatccagaagtatcaaaacatagaaaaagtgtgtacattaaaatactgtattaatagcaaaatcttataggaccactgtcatataagtggtctgttggtgaccgaaacctcaatatagggcacagaactgtaactgaaatcgcctagcttacttaagaatgtctatagaaaatatagggaaacatactaaaagtagtcaaatcaaaacctgttaattctcatctttccaagttgggacaagtaaatgtaaagttgccttaagatgtaagaagctggtcatgaacaggtatatttctaatgaactgtaagggtccttaaagtttttgagggtattttcttctggaggtgccggacaaagagtcagctaacaatgaaagaacatcccctgaaataacaacttacttcctctttctcagcttccaaactaaaagtggtatttgaagactgagacataatcataggccaagaaaacaaacttttcaaaacctccttatacataaggacatatgctaaataaacatgatgtatggatccaattgttttcctctcctctttttatctgggtttattttaacaaagcaatcaggacttaggataaaataaaatatgaaagaccataactagccactttgatagatctagagttttttgactctattattctgtgcaaggttattaataaaatgaaatccattgtctaaacatttgcaaaaagatgataactataaacaaaggcaatcctcagtgtgaccacatagcattgctgagggagttaactaagacccctgtatctttacatcaaagccaaatttaatcaaagagcccctagtgcatattctcagtgcatgtaaaagctcttttttagttttatgaaatggaagtaaaagtgggcctttaaaaaacatgtttaaacatttcctctggcctgctttaggcttcattgttagcaagaattctttagggaaccatctgtctgtgtgtgaatgacctccccatacctgttagaaagggaaggcttgtgcataaatataacagaaacatttaggaaaggtagaatgagagcccactgggttgtcattatccctaaaagagggatgcttagacccagaaatctgaaatgcaattgacagttatatatgaattcagacttatgtcactggacgtccatgaaggatacagaaatcatccagcacattaagtccttctcacatctaatgttcataaaataattcatttattcttttatttcctttcttccttttctctctctctctctttctctttctgtcttttgtttccttctttcctttctactcttatttattgtattctttgataacacatttttaccacctgttgtcctaagtactaggatttacaagtggggaaaataatcctggctctcatggaatttatatcttttggaactaccggaactggaatgaagaatattaaaatttaagatgctcttagacatccaagtagctatgaattgttgcaatttgaacattttagtctagttcaagggatagatccaaactagagataaaattggcaagtcaatactatatgtttgttatttgaagccacaagagtacattttatctctttcctaaatgacaaaaaaggaaagaaccctagaaaatggtccttttcaccattttaaggatcaagggaggcatcagaaatggacgctaaaatgtgccagaaagtaagaagaaaattcagaatatttcaataactaggaagaaaacagtaaggagaaatttgaatcctcctatttggtcataatggatgaaagcaaaaattaactattggattgaacaatggaggttgctgatcttgccaagagtacattaggtggagttatgatggcaaaatactgattaaaattggtgcaaaagagaaaaattgagatactaaatataggtaactccaaaagttttgctttcaaggcaaaaattgggacaatagctggagaaagaatttaggtcaatactgaatacattcatatactggtaaaaatatgtaaagaaaaggagaaaaataatgatggatgaggaaaggggtgcaattgatgggatgcttttcttgagaatataagtgaaatggaacttaatgcacaaatagattacatgaaattgcacaagagcacagatatgtctactggtaaatttttaaaagaggaaaaaggcagataatactagaggaggtgtaagtaggtgggcaaatgtggtagagcaagcttataaaaatttcacttatggttgtctcttcttatcctggttaaatgggaaatatgatcatcaacctagaataaggattaaaggggagaattggtgaaggtttaagatagttcaaaggacaaaagtaccagccagtagagaaggatattgaataaagacctgcattacagttatgattaggtatatatacctataaggtattaggtattattattacctattactgtatgtaatacagtattagaagcctatgttaagggccatatatttaataagaaacaagtaaaaattactatgtggattctttttcagtcattttcagttgtatgtacagatacatggagtagacagagttgcactttatcagtgtcacaatttagtctaatggtatatctaggtatgtaaagagctaattagacaagtggtttgagcatgtatgcaagggaatatttttaataattaggcatgggatgaagaaaaaaaggcagacaggatggatattaagtactatgaaaaggtagtaggatcattggactattgggtcagggacagataaagatttgttaaaaattagtataacaaagtgaatgaactgcaaagattggagaaggtggggaaaaggtgatgcttgtaaattcaaggtgtgtgtattgtggggagaggggcggattgtaattattgttaagacaaggcctagtggatgaccattgtactgttgcagagagggaatgagataggggatagacagctatctttgatgaagaggaagtaaagacattgagaaacccagcatgttaggaggggcatctacatagatttttgatgggattgttgtagagaatatctgagtgagattgttttttaaaaaggagctaaataacacgcgtactttaataagtttagattctctgcaaaatattctgcacatgagtataaaacatcctttcccatgttgatacatttctgtgaaaagctttgtgcattccagtagtgtgggcttgtgtgtttattgttttctcatcctccaagtgccaacgtgtcttatagttctcagagaactataagatatcccatatgccacatatggaatctacagttcattctcattggtttggaaagtggtgtattcaactttttcttttagttcatacatgttctttcaataaatttaacttcttataaaaaatgtactttagtggagtgaaagattgagtgaagagaacagagtgaggagttggagtgatctttgcttaaagataaagagaggtggcataggatagagggaacaatgggaggaaaaggggaaaatgaaacttaaacggcagggaaatttagatgtgtatatagagagatgaacactcaaaaagccagttaaacaggtacctaagcacagggagagatggatataggagttaatataaagcagagagatatataaaggacttggggaaagagaaagaaatttggagcaagtcttatatttcattctgtgttaaacaaaggaaaatattagttgttgcattttcccatttctatatatgaaaagttttttttcacttctcatgcatttgcccaataaacaaatattaataatatagcttttgtatctgatctctaaccagacaccaccaacagtttttagactttctactttgaaatgctgtgtctctgagaagttaaaggaatcagtacttgtatttatagcagaaaaatttttattaggtagtaacagcaatggccctaaatatttagggctcaattttaaccacattacagggaaaatatttattccaaatgttttaatgcatgttcacttcaaaggaaaataaaatttcattgttggagtcagaaatgacttttatttcatttaggaactgtaagacagaaaaaaattagctgtagatatgtgttagcatgttaactaagttgacactattttgacagatgaaatcacaactcagattagattgaggagacataaaattgccattgaagaatcttgtatttgaactaaaaggaataattttattaatcaagtagataatatgaagggttatgatattcttaaataattcttaaatgtgacaaaattagtgatgtaatttttttaaatgctatacctcatgtgagctcactggcattgtttgactaatactatttgtctacttaagtatttcaatatttgagtacatcgtgaaccaacccatgtaacatatatctaaatcatatctgccaagatgtagcaactgagagtcttgatcacacttccattcttaagtttataaggacttataattcttaattctgtgtttcgaactgagtttctgttattaagctgcagaaacatcttaagactttggtttatttagtttgactgtttcttgattttttaatttgtcttcctttgtaaatgaagacatgatcatctttaaatatattacggatcttatgcactacaagcaagggcagtttcataagcttagagatagagtttatgattcgttttcagccagctgtttccttgacagcacactaggcctcttgctattgagctgctctgaactctacacttgctaccttacccttttatttatcttctcacgtacaagtgtcccccggagctttgcggagcctctcccatggtaaccacatgatcaatatttcctccttgattgatatgattgtagaacacaaaatgctactgtggaaaatataggagagccttctctgttgtttttcacacttccataatatgagagagatttgtttttaattttcattttaataatggttatttccatctccaagtcatttttcttctcttttcacctttttctttagccctatgttctaactctgcttcttcagtgtgtacacatatgtttctccttgctcgctctccatttagctttttaacacagtccagaggcaatatttgatagtaattaagaatgcatactttggcagtagattccctgagttggaatcccagggttactaattagggatgtgtgtatgtgacctttagtatgtcacttatcctccctttgttccgttttcttcatccatatgctgagaatgataattataagctgtgacccttaaggttctttaaagattaaatgaactagtgtttcaaagagctttgaatatttgcctaacttatgctaaaccttttatcaatgggtgttagctgccattcttatcttttaccctgtcactgtcattatacatctgaacctattttttcttagtttctacttcaacctctacaggagcctaaaccaacgtttttcctgctgcagaaagccattgtgttttaattttcagtaaattattggaaatacagtcatccaatgatgaccatttatgaatataaaatgaaagttcaacatatataaataagttgggctgattccttttactataatgaatgcaaataagaggtaaagcctagcctacaaaaatcaacttaagatggttacattcacacaccaacatttaaggcattgatgtattgaggcctttttttgtgtttaaagtccttgcaagtcacatcctaaataccatgcagactagtcccaaattctggatttctgtatattattagggaggcataacacatgtacatcaaaattaaaaattgtttgacaaagccaattgcaagggtatgaaaatactctgaaggtgtccgtaatgcctcctgtctactctgggctgataccatctaaatatttattcttcgtctcaacatttcgtatttcctccttgtgatttcttgcactaattttgcacagaaaatgtttgattcagtcttgaggagtcagtctgtttcctaatgcttgctgtgtcctctgcatatagtaatgctcttctgttcttatggagcatggagcatttaggtgccatcaatacctatgtctgatgccaaactaaacctaagtgattaagtcatttgattaaaaggcctgtcttttgtgttgtctaatactgaggagaggaagaagtgatgactcataaccatgagattgctagtcacgaagatgagtcagggccagttttcttttccattgatcatataaaacatgaacacatgtgtactttgcagtcctagaaactttcattaattatgaaaagttagaaaattttgtttacagtatttataaactctcaaggaatattatggaagcttcactcccatgatgtaattaaggatgaaaacgatgtgtatgtgtggccaaaatctgaaaaacaataaaataaaaatgatttaggtctctttcaacccagtctccaggaatgcctctgactaaatttcttcatctgtaaaatgggatattgctagtcatcatctataagactgttgtagggactaaataagataacatatgtgaagagcttagcagtgcctgagccccactgtgcagccaatgcatttattcagagatcctgagtgccaaggtttaagttcagctgatgatttgcggcagtacacactctgggctgttttcttcccaggttcattcctgccaatcctcccagtgttctgatctcttttgctactcttagcccattgttcatttctttcttttaacacattctcaagctcacacaggagtattgtgtatcctgtatggatatgtatgttacattcctgtattgtgtagcatgtatggatatacatgctacgttccatgtactgatagaactttcaggatgatcatttatttcttccaagtgaaatttatacatatttggtgacttctaaatcagatacaaaagtaagtcatcttgaccatgcgtagaattcccatcttttattttgtttagcaaagtctcatagtttttgtataatgctttctgtgtgccgggccttcttttaagtgtttgcaaacattaattcatttatgtcagtagtttttagtaccgaaaatacaaataacatgtggctgagcagcatattgagaagaattctgttttaataatattgcttttaaatgttttggcacaatttaatttggtctaagtgtctttggactgcagccattgaaagccagggcgactctctgcaggtaatttgagggatcttttgtcctcacagtgtctggttcttgtttgagcttctccatgacaatgaatcaggacggagccctggcaggctgtgtttttcagagctctgcatgaccaaagagcaagttgtgtaaactaatagattacctcaaataaacacaacaagataggatggatttaatagacatggaatctcttgtaggcttagcagccaaattctctatttaaagactcagaatcacaatgaagcaaaatttggaaaaggcttatgccatctcaagggtctgtcagaacagagagtacaatttacttgcaagctccctaaatgaataaatataacatcatattggttgtttggtattctgggaataaactaagaccacatttctcaggttttttctgacacatattagattgataacttttttctttaagaaatgaaatatttttatacataatctccaaaaaattacatgtctgcattagaaaatagctgacctgcagtaacattcataaaaatatcattttgctaaaataatatacatcataataatttatatatatgtgctttcatactttatttcagaatcatacatctttattaaaggaaatatgttactattattaaggtactgtctatatacatttaaaaagtcagtacagtgtggtcattaagaattcagtatctggagttggagacttttgagatcaatttctgatgctttgaagctttttgaatttggcaggttgcgtaacctcatcttttaagtgagggcaagagtcaaaactacctcatagagtattgtgagaatgaaatgagttaatatattctcacccaaacatgtaagaagctcatgccgcctgctgtgtcctgagtaatgatgtccttactctctgaatgtcatctcctgtcttgtgccaccatttctaacactttatgagcaggttagcatagcatacaagcaggataaaatctcaaacccttcaaagttattgactatattgtaagtacccaataaacgttatctagaattactattacaaatataatcaaaagaagtcataaaacaagaagtacttaatgtaaaaattctcgacactgtcaaggccaacagtatggcaactgactaaaacaattctgtagcaattctttaacgcttattttttctttataaatgacagaatgtttaatttaattagactatggtttaactatttgactccttcattgaggtatacccttatgcaaaccttttctatcctgaaaatacaagttatatatttgtatctatatacatatttatatctatatatagatacgttttatttctaggcatgaaattgtgaaatatcttggcataccttttcagaaaaaaacaaaattggaaattgatacactgatttgtatttgggtagcagaagaaaatttcatgccttaccaaatcatttgtaaactatctaatggaaaataaatcaaaacaatgaaatcatacttgagagtcaattttattacctataatatatattacattatttagttagaaagatgaagctgttttgcttgatatggaaattaaatactggaatttacaaatcaaaatgttagccttatattaacttcagtctccttttgttttgtttcactttctttttacaaaattgagaatattttgattaccaaagataagtaagtacatgtagtccctgttttaagaactcacttagcaaattcagatagaaacacctttgccctgaggtctgtacaaaagttggttaactggataatacaatgaattgatggttgctgatgtgttaaaagttgttataaaacatatttgacattttatttgttttatagttttaaaagtatttcaagcatattaccagtgaaattaaaatcactgatttattaagcctctaaagctccttcagactttagtgaatacacagttgaccctttaacaacataggcttgaacggtatggtcaacttatatgcaatttttttcaataaatacatggaacaaatttttagagatttgcaacaatttgaaaaaaaattgcaggtgaaccacgtagcttagaagtaccgtaaaaatatttttaaagttgatatgtcatgaataaaaaaaagttgatactattccattttattattcgctactataaaataaacacgaatctattataaaacttaaaatttatcaaaacttatgcacacatagaccatacctggtgccattcccagttgaatcaacaaatgtaaagatacagaattaaatcagaactgcataaaagaaatgatagtacataccatactactgtagtaatttcagagccacttcctgtggcttatttcagtgagctcaattgtcgtgagtatccacttaaaatacagtgtaatgggaggctgaggtgggtggatcaaaaggtcaggagttcaagaccagcttggccaagatggtgaacctttgtctctactaaacatacaaaaattaaccatgcgtggtggcaggcacctgtgatcccagctacttgggaggctgaggcagagaatcgcttgaacccaggaggcagaggttgcagtgagccgagatcatgccactgcactccagccagggtgacagcaagactctgtctcaaaaaggaaaaaaaaagaaaaatgcagtgcgatgctaatcatccccatgtgatgagttcgtctccccaataaattgcggatcacagtaaaaagtgatgtcttgcgttcttgcatatttttcatcatttttactgcaataccataaaccttgaataacaccagaagacccacagggagtgccactaatgatcctggaagtacttccggaaacaaagcactcacattacaataaaatcttatatgaattgctttatacatactgtagcttgaggtctgctgctgtgggtgccctcctcttcaggaagactcatcttgtaaatgggtgatgtaaacttaccttatcgataaatgcaggaaagtactgtacctgtgtcttccttatgattttcttaacatttttcttagctagctttattgcaagaatacagtatatattccatataacatacaaaataggtcttctctgactgtttatgctactggttcacagtagactgtcagttgctaagtttctgggggttgcaaagttatatgtggaaatttgatggcttagcatcggtaccccaatccctgccttgttcaagggtcaattgtattttaaatgccactttgtcaaatagagaagagggcacaggatgttgaagcttaattccacctaaagagttgatctatttgcacgctgtggatgcttcctgggctccacacttctccttggtcactctctgctctgtgttcttatactcagccaggtgccaccattcacatgacctgtctacttcatagaattcactggtgttttaccttgtatgaaatgattcctaatgtcctattagtcaaaatttaaagtcctattgttttgtttgtttgtttgtttgttagttttgagacagagtcttgctctttcgcccaggctggagtgcagtgctgcgatctgggctcactgcaatcaccgtctcccaggctcaagtgatcctcccacctcatcctctggagtagctgggattataggcgcctgccaccactccgagctaaactccagagatggggttttgccacgttgaccaggctgatcttgatctcctgacctcaggtgatctgccctcctcagcctcccaaagtgctgggattataggcgtgagccaccacaactggccaaagtcctatttttaaaaagctaaagaaaaataaaaagtaatgcaaaaagatatcttaaaaaaatagagagtggcactgaggaggagaggagaggacagactgcatgctgcattgttgatttagagacaggatttctgtgccaaaggagcatgactctcaaagcttacctctcccctgattgttgcccttttcaactgagtatagtttttgtttaataatgtgtttatgataaattcatagttgaaaactatgatatttatagctttactcattgtatgggttatattccatgcaataaaatgtaagccagctatgacaatgcttccaagaaagtaccggtctcatagtttcactgaaacacacactcttcttgccttttcagtacacagtacagctcctctgattgccacatctcaccgggggatggggtggcacttgatctgcagccacttttccacaagaggtgaacaacagctttaggcagttgtcagaatttctgcagcctaaatgtgaatcttccacaagctatctttttgagaagagtatattttgatataatacgaaatcctttaagtttggctgcagatttttaaaaggctttgagcacaatatttagggctttacaaataaccacactgtctgtttacatattatttagctcagttgtttgttctgagttagagatatgattataagaaatataaggaggagagcctgttcagcttctccatgactactccataaggatgtattcttatattttaattagatgccagagtctagaatcatattctttgcattttttctgctacacatgtgaaattggaggtgcactaagaatggaaaagcaaattaaatctgtaggtaaatgacaaagatagttagtggaaatgatctcttctagatgtctattgatgtgtaacaaaccactccatacttaccggtatcaagcaacaacttttatttttatgcttaaaagtttctgtggatcaagaaatcagacagggctcagagaggataacttgtctctgtttcatgttttctggagccttataaggaaaaaatgtaaaagtctcagggttgtctaattggttggctgctgaaatcatctggaggcttcatcattcacatatctaggcttggggctgagatagtttgaaaactgggcttagatgtgcctgtcagttaaagagcctcatgtgtcttgggcatccttacaatatgacagcagtagggtttacattatgtctcaggactcaaagacacagtgtcacttataatgtaccctattgctcgaagaaatcataggtctgaccggatagaaatagatggtacagagacgtcactttatcattagaggatggtcacatacttcaaattaaaaatgccattgaatctaaatttttaaaaaggatatttgagaggagatattaaacgaatatataatttgttttcaggtaagtcaatttccttcccttcctccaaaaatagcttgaaatgcaggagcgtcttgagtatgctaccaagaagaagatgtatgatttttcttgttcaattcttttattcttcaataattattcatgtgttctccagtagaataatggaaaaataaatgtctcaaaggttagtaaaattaaacacagagagtttaaacgaatgtccagggatgaaagaacaatttcccggtatagaaaaaagattaaaagtaaattcacccaagtacatagcagctcagtgattttacactttttctgtcacaagccaacaaagatcttgttaacagcagatagagaaaggaggtttgggttgattttcatgtcaaaaatataaatctgacaggatcaaagatataatattaagctgcatgatagcatttgatgcttatatgacaggcttgatctcttgtaatatccacaaaattctttgggtgaaataagtttcatgctcctatatttaacatttgtgaacattttgatcatgttttcaaaagcaccattttgtagtaatttcaagctaatttaaccatttcacaacctgatggattaaaatattaatattgcttcagttcacctagctaaagcagaaacatgcataacacaagaaatggtttagtttaaacccttctattaaattattatcactagcagtttattttatattagagggattggattaattgctcaaatgaaaaaattcagtctccttacaaactgagattcattttgacaactgactgagaaaaatcattcattcatgaaactgttaattcagcaatgctttccatcttccaacccctccaccttcacattctcagaaatgatctgatgttggtattaactttctccattagtaaaaccaaagagacgtgtgacagacctaccctctaggccagaggttttcaaaggttttcgatttagaatcctttatacttaaaaaaaaaaatcatcgagttagcctttggttatatgggttgtatctagtgatatttattgtattagaaattaaaactggagaattatgagaatttctctcttcatacttgattatcaacataattttaaaaattatctttactaatttatcaagtgaaaaatatgctaattttgaacttttctacttatgactgatgttgcatatccctttttaagactttgtttctttattggtaaaatctcatatacttgtctcatttttatattgagatttgaagttttcctcgtttttacaggatttatagtttttaatataattaacaattgactttgatacgaattacagatatttctccattatgtctttaattttggctttttttttttttttgagacggagtctcgctatgttgcccaggctagagtgcagtggagcgatctcggctcactgcaagctctgcctcccgggttcacaccattctcctgtctcagcctcccgagtagctgggactacaggtgcccgccaccactcctggctaattatttgtatttttagtagagacagggtttcactgtgttagccaggatagtcgcaatctcctgacctcgtgatccgcccgccttggcctcccaaagtgctgggattacaggtgtgagccactatgcccggcctgttttgttgtttttaacggaattttttgaaatgtatataatcagatttatcaatctttaatttgtcacatccagttcataattacaatttttttctgactttaagggacaaaaagtttgttctattgtttcctcaagtgcatttttttgtgtctagctttttggtctttccagaatttattttcatatcatggttgaggtagtaatctaattttatttttttgtacatgactaaccaagtatcacaatactattttttaaatgactcatctttccctcattgcttggaaatgatatttttatcatgtactctatccccctgtggtgatgtgtgtgtgtgtgtgtgtgtgtgtgtgctcttgtgggtatacatatatataatgcttagtttgtcctctacccctaaatttcagagatgagaaaagtaaggttaaatggggccgggcacggtggcttacgcctgtaatcccagcactttgggagaccgaggcgggtggatcatggagtcaggagctcgagaccagactggccaacatggtgaaaccccgtctctactaaaaatacaaaaattagctgggcatgatggcgggcatctgtaatcccagctactcaggaggatgaggcaggagaatcgtttgaaaccaggaggcagaggttgcagtgagccgagatcgtgccattgtactccagactaggcgacagggcaagacaccgtctgaaaaaaaaaaaaaaaaaaaaagtaaggttaaatgtcgtgtctaatctgtgtcatttaataaacatccttttgtaggaatgcaaatcggataattggtgattctaaaggaattgatggtagtgacagcaatgaccttactgcatagcttgggccaaaactgttgtctgttcatatccagttttcaagtcctacttgttgctatgttatttccaatgaattaacatctgtttctgttattgattatttagaatggctgaaattaagtgattggtttacttattaatttctaatgtctaaattatataataaagtcaaaataggattttctctaagatatgaattataacttcgaaatttcaaagatagcaagattttaaccaggttttaacaaaataatgttatagtactgaaaatattatgggattcaaaaacagtgcttcctaatgttgtgtctgctattactttaacatgtttctgaaagataaaaattgagccataaagtgatctattaatatagattttgcaatttattaggccttggtcttcctttatagtatagaaatgactactatctagatatagtacaaaagagaagataattaacatagatatgacactttaatatggttagtcttttgcaggactgcctcttctttcaactttttttatttgtatatgaaaaaccctaaagcagaaagccaactgtatgtccacactatataataatccctttctctttattattatattatcaccattatttgtttgctcacagtgaattgaaatttcatcacatattcaaagtagaaatgactgttatttcttccatcaaataagttgatatctgtaaaatattaaatagtataagtggtcctctactagaaagacaaattccatatctactacccttataatttatttcaagttacaatatttctgatatcaaatgtgtaggttttccacatcaagcaattctccaatcctttgcaaacatcaactggatgttccacaatttaatttgattctgatagtagctacccgacgttagcacagatcccacaggttatgggcttagtccacaaaactgctctaaacttcagatacctgtcacaagtagtgggtattcagctgtccaacttggctgcaaattgggagttcctacaacctattcctcaagctcaataatttgctataaccattcacagagctcaaagaaatatttaattgatgttgacctatgtattatacatataataaggattataatatcatagatgatacaaatgaacagccagatgaagagggacacagggcaggcctggctgggttctgtgcacagacgcttgtgagtctgtgtagtgggggtgcagctcccttctggcacgttaatgcattcaccaacctggaatctctctgaaccctttcagttagggttttctatggggtttctgttacatagtcagagttgattaaatcactagccattagtgatttactcaatctccagtcactcaaccatttccagtctgggtggggctgaacgttctaatcttctggtcatatgtttggttcctctggcaaccagtcctcaatctaaagctatctctgggtttttacccaccagacatctcattagcataaactgggatgtgcatgaaagaggtttcttataaattataaaagacacgcttatcacctctgtcattcagaggtgaaattccaagagttttagaaggaaagtgtgtcagaaaccaggaatgatgactaaatatgtatttattattatatcaaaatatcacaacttatttcatgcttttgagatctctttccattttttcaaaatggaattttaataaagtagctacaaaatacacctctcatagcatttgtttatccattatctactagaattattgcggttcatttttgttgaaggacatagtgccactatgaatgtaccagtgaacaaatgtgatttctgcattaatatgtccatggatcttaaaatattacaatgtgaccttagcacatgtcatgatgtcatgatgaattatgtttattcatttgcagagaaattgttgtggcgtgttttatgttccctggatttttccaaaggttctatgtatgataagttttgaagcataatttcttatatataaaataattaagtctgatgatggagtgcaattaaattcagtcagtaaaatgctaatccattttttaagataaatgtgtgttcacattatcttgaagtgtactaacttgtgacagtcaaattgttgtcatgttggaagttcttcatttttcaaagttatcctatttaaagtcagagatgaaggctgatgttgacataatttgacagagtatatttgtggcacacgatgtacataagtgttgatcagtgcataaaattcactttgcctgaaagatcacctgagatactaaaacattaagagacatattttttggagaattataatattgcccagttttctaagcaataatgctcagaaagaatgatgagttcctgaagacagaggttaccttactcatctcccacatctcacgtctctgcttcagctacccagggatttattggtatttgcccaataaggatttattactacttatctgtcgtagaggtataattcaaatttgttgtgctgcatcaaggagctaaataataaaaatggaatttttgaccacattatgttatgcaatctagctcagcacatatttttagagtatcaactttcaaaacactcttcgagttactgaggaagtgtgacaataaataatgcaatgctctacctttgaagagttcacaataggttcttgccttaatatgatatgtattactgtgcatctgcatccattagctctggttgacccatgagcgatacacggaatgaataccacttgctatctttatatagatgaagttgcacctaagagactggaaacaatgctttccacatctcaggaccattaagcagggacacaaacatgcaaaaccaggcagttttactcttaatatacagtgtttgctactcttttagaccatattgcaggaaactaacatacctagttgctaaaagtagtttaaactttaaggaccattgttctaaaagaacatgcaaatatgactctaaaaccttcactgatcagaaaagaaaaaaaagggggcggggggggaaagaaaaaattgagaacaggaggagaacgtaaggaagcccagaataacatttgacacaaaagatcccccaatggttaaagtacatggaaaaatgggttctgtttactatacaccaaaagttttccttttttaaaaaatccacaatttgtgagttcttagaaaataatttttagaagtcactatgtatcacttttctcaaactgaactcatttacaaaaatatgctatcatgaaactagtaaaatgaagttaatatttagacaagatgtatgttgagttcaaacatgcggttaacagattttttcgaagtaatttaaggacaatttaaagaagtgtagattgcaccagtttttaatgtgtcatcattttaatggaatatttgcaaaaatgcttataaaatcagtgacatcttgattaatggggcatgttccacagctctttaattggccttaactgtataaaacagaatcttagcagcaaattttgttgaagcattctttataaatatccaagttaaccaaaatagctacaattattttatgttgggtgagaagatcaaaaaattaaacgcccttcacagacttgaatcattgctagaacttaacagaaaaaaaatttgtaagaataaatgtcaaattccaatttaaaaaatagaactctattgtgtatctactaaatttcaggcattattgcagagacttggactacctcaataacacaggagaccctattgctgcattcacaggtcacagatcttatgctgtagctgagagacacagaaaatgaaatgtaaacaatatttggaaggcaatagagatgtgcaggttagaaagtgtggagaaggaagaggaggatgaagttggcttttggtgtgactgtggatccacaggctgtagtcttcaatatcaaggtcaagtgatgtctcactgagaaggtggggattgagcaagaactgggatgagaagagggcgtaatccctgtggatactggaagatttcttgcagaagaatagctacagtttttgcctaaggggtaaggactcagtggtgagcatggagtttttgaggaaactagtaagacaggaggtcagagaagtaactagaggccagatcttgcagtgctctatgggctggcataaaggacgtgtggctcttgatagttttaagctgaggaaggatagaatctgatttctggtgaaaggatccctttggcttctgtgttaagattagacagtggaaggggacaaggtgaaagcagaaaggtcagttagaaagctactgtgaggtgccagacaaagagggaagtctagaatccttcaataatggctggagcaacttaaaggatttgacatgaataagtctgagtattagtacagaactttaaaataagggaaggagtaatttttagagtccaacacatacgttctgttaatagattaattagaaaatacctgtttattgaatcctaactatgatctggtcgctggaccaggcatttagtaagcattgcctcctttaataaacatatatacaaatagaaaattagaaaaacaaaacataaaagaaaattaaaagaaaaaaaaaacacctatccatctatctatgttgcctgccatttcagacagataatttatcttgtaaacaaacaatgatatatatgtatgttataaattcagtataatactgtaaatgaattttctcttccttgtgattttctcaataacattttctttcaatagcttactttattgtatgaatacagtatagaaatatataacattcaaaaatgtgttaatttactggttaaattatcaggaaggcttccagtcaacagtaggctgttcgaaaatgtgtttattttactggttaaattatcaggaaggcttccagtcaacagtaggctgttagtacttaagttttggaaagtcaaaagttatagtaggatttttgactgtgcaggggttggcgcctcaacccccaccttgtccaagggtcagctataaaagcaaagcagtctgaggtctcaaactttgccaacagaagaaagaatgtaaattgctaatcagggaagaacttgaagaaaagaaagacaactgagaaacgaactgggaaggagtagtggaagacagcactgtctttcaaaagcaaattagtagaagagtctctaaagagactaagaaatcaaagacagattcaggcagaaaatgccatttttaatatatttcttaaaagaaagcagtatgttttagtggaacatcaaaactccctcataccacttattttctaaaagagtgttaagcacaaataattctttccttatggaactctatcacataggacatttagtaaggttaattctttccttcggggaggaaataaagtaattaaggttagtagttggaaaaaaactattttgataatatcaccacaaaaaaattgttaagttccttctattatcatattacaaatttgggggagaaattttttttgtatttgtgcatttctttttagaagtgttgtctccagctcttaggaaactattgacttgatgtttcattttgtttcctttggtaaatagtgattgattcctgggccctaaaaagccagtattattgctaggtgctcaaaatgcataaaattcaaattgattatttgattcttttatcttactagaaattcatatttctcactacttttacaatcaataatcacatacactaaaagccaaaaatttagtagtgtgtggatatatacatatacactcacacatacatatatgtaaagagagtatatatatacacatatatgtacaatataagtatgtatacaatttagaagtgtgtatgcatttatatatccacacacttatgtgtgtatatagatagataagtccaaatataaaaataagcaaacaattgactacctgacctaataatgtcatgctaattgcattttcttttttcttttactgggagtatagagggtgtctcaaggctctggggagagtatataactttatacagttgatttaggcccagagattttacattactgtaaatgcatataacggaatggtcttctttccttcagcagtaaaagatactaaaggttatgctatttttaccctactgcatataagacactattaaattttgtatcaaacaacacatatgtatcctagaacaccattttcccccattgactatatctctccatcttattttgcatctcaaaaaggaaacaaaatagatgcctaagctattttagtttcctttttgtgagctaaataacctcaatacaagcacactatctgctctatgatcctaatggtctcattttttagagaatcatatttgatagaagctaaaataatcgcattgtttctatattatttttcagcatagttattccactgcacatgaaggtagttttgctttatttctcatccctgtgatactgtcaattccttcctcttcccctaaatctgcaccttcctagcctaattgaggaacagaagagttctcaatggtggcgtaattatcatgtattaaggagataacattttaatatgttatttcagatgcttctctagagtttcagacttctgggctgtggaggtctcccctccatcttagctcagcatcattcttttttttagatagatatcatgtctgatctaagtacacacatctctgaagaaccactttctattcttataggcacatgcacctaacctcgtgatatattcttgaactgccatgaacacatacctactctctgatttcatatcaggtttgcaacggtgatagaaaaactgtttagtttgttacttgtttgttttgaccaaagagtctgggaaaagtcaaagtgaactgaaaatttacaaccttgggaactcagcatttgtgatcgaagtttctaactttttcttgttgcaagtttaatatcttcttcgctttcctgttttacccctacacaccaattccttctaaaaaacacaaggataacaattacatcaacagatatgctttatttgtgtttttctttctagagaaaaacatatatgagaaaaaagagtatgaagagcattatatttattaatcttatctcatttaaattattcatgtttttagaggttcttataatcatgactaatatgagggcctaattcttttttagcataaaacataaaagtatctagtgtacacactcaagatgtcaatttttgcttttaaaaaatcggtacctcttttctatcatttttcttgattctttctttctctccacagtgatggatagaaggaattgattttctttaaaatacccatattctttctgccccttttctgaccaaatgcttcaaagccttctcatagtctctaagaaatggctaactcctctggctggcattcaagacacttgagaatcacccagaccctgctgcttcctcagcctcagtgtcctatctttgctttgagttgtcctcatgggccgatgtcttctccctctaagaaagccctgctctctcctattgtgactcttgacacagagcacttttagcttcccttctttcctcctgcatttcatttgatgtgattcattcttcaggctaaactcaaatctttctgcctttaagcagtttttcatcattcttctatgcacacattatctttcccatagcatcagttgcctatgaatttgtaagatgaaatagctcattagcagtaaaataaataaataaactcttcttcttcacttgcaaatggaataacattcatgggataaaagggaagcttaaaatagacaaactagtagatgatcactcaactaagttttgttcagaaaatggtttgattttattctctacatttgacaagattccccactccagtttgatatctggcctcattgctccaatacagtgattctgtttcagagaaacatgtcctctgtgtcactaaatccatggatgctcttcaatttttatctcccttaaactcccagagcctcagtacctgatgtattcatttatcttctttaaggaaacttcatgtgatgtgaatgaaacacacctctcttccttagccccttcctctgagactgatttgtttccattggctttgcttttacgaagccgttaagtgttttttttttattattattgttaatagctaaacaattcatgtctttattttttcttcctctatgctctcttcctgagcactttcacacatgtctttaattattacctggaatcgatgactcccaaagagtaacatgtaacctagatgactccttagatttccagagctgtcaatcttgccgcttcaatgataccactacttaacatctcaaaagcagcttatcttccctttgaccacatctaaagtgtaattatcctcatccaccaacccaaatataggctgttccatggttccctgttttatgccttatgcaaaagctcaagcaagttatctaaaaataacactttgaaactcactccctattcttctattcagttcacctcttttatggatattgtctaagtaggtgtgaactactataacaaaatacctcagagtaggtggattaaatcaccaacattaattctcacagttctagagaatctcacagcaagaagaaaatgctggtggatttggttcctggtgagggctgtctccctggcttgttgacagctgtcttctctcggtgtcctcacatagcagggaaagggaggtttggtgtctcttcctctttctatttgggaactattatcatcatgggaacatcaccgtcataacctcatctcaacctaattactccaaaagatcccatttccaaatatcatccaattggcagttaaaacttccacatatgaatctgggggtgagggtgtgtggatagcacatgacctttcagtgcataacagatattatctcctaatagtataatctttccccttctctctaactctaccatcaacactctcttctaaaccattattctatcttatttatctggactcataatcccctcctcttcccttgctaaacagagggaaggaagagctttgtaataagaatgagaatcagatcagcatgctcagccaccaaatacctttctatggcttctcactgttcagggagaggagtataatccaaaatagacagtcaggctgacacacacttaggtctccatactccatgcccaacttaccctctccacctaactccttgctctttcagtggcagccatggtagccctttttcagtttcctattgcttacaggcattgaaagattatctaatctctctctacctgaaaattttcccctacctccagtctgcttactcagtaggtacctacttagctttaacacatcagctcagatgtcacttcagagtcaatgccttccccaggccagagtaagtcctactttttatgtccttacgtatatatcttttccagaatttagagtatttataataattattatttatgcagttattggattcatgtctttaccccacctcctaggctataggctccaaaagagaagggtcttttttcatagggtacccatttcatctccaatgtccaggacacgtggtaagacttagataactattttttgaatagatgattatcatgtatggccttcagacacctttttattttgatttgatgtttgtgctacaatgaattcttagagtacttattttgtttcatagtttctttcccatagtgcctataaatcttattaattattaatagaagtaaagaaagattgattgattgcctagaaatatctctgaccatatgcatttgtgaatccattataagtgaacttacatataagggtacaactgaatagagctaaattctgaaaataggaaaagcagctaaatctccacaacatcggttcataatacagagcttaatggagcgtagatccctgctgctgtgtccttaaggaaaatgtgcttgtttgcactctggggtgatataaacctgtacagagtggcttttatttaggtagctgagacacgttagaagaatgattgtggtgttgctgactaatttgggctctagttcactagaatatatatcataatatattgtatattctcaataaatgtcaataacacaaatttgcaaatagctctttccacatttcctcatcacttcccgttttggccacagttattgagccacattggggctgatttatttcctgaaaagaaaagaaaatatccatttctgaaggttaactgataacattaacagaagagaaaaatctacttgggagacccataaaggatgtttattacggcaagaatgaactcacagactaaactgaagttaatctatgttcatgggtaaaaaagatgaaaatgacatacaattcaacgcatatgtagtttttgagtttaaaagtgtagtaattactcaccaaaaaagaataaaggaaagcaccagtaatcatcacaccatactgattttatttggcttactgaatctgttaccaaatacatttaaccttctttgtcattagtataatttcctgcaaacctgaaggaaatgatagtccgaaataagaataatgatttcagacagacatcaatatgtatagatttttttttttgccatttgacctactgggcaactttggcttcagacttctaatgctgtaataattattaatataataaaagcattcaccaaaagtttcctacatagcagaagtggctggctgggcgtggtggctcatgccactttgggagggtgagaagggtggatcacctgaggtcaggagtttgagaccagcctggttaacatggtgaaaccccatctctactaaaaatacaaaattagccaggtgtggtggcatgtgactgtaattccagctactcgggaggctgagtcaggagaatcacttgaacccgggaggcagaggttgcagtgagccgagatcacaccactacactccaggcagggcaaggagcaagaccccatctcaaaaaaaaaaaaaaaaaagtgaaggaaaccactttacttgcgttcttttctttaccttcccaacctctctatagagctgttttcatttaggtgccaaggacacttttaaaaatatattgtggagttgctgactaattgggatttcagttcaccaggaaacgtgtcatagcagtttgcatttcctccataaatgtagaaaatgcagaaaacggctatttctcctgtctgcactgttactattctcattttttagctaatgaaggtaatgtatctgaggataggagatgtgctcccagtcagtgagcaatgtagagcttatatggctggtcctgtggctggcccaaaatatgaaatcaagtctgaccaactgactccaaaagtttggctcttatccactgcactgatccacatcttagtgtaaatgtcctaataaacagacattaatatttttattccgttttggatttagggaaacctgcagtttaccaagcagatttcaatattagattctatgttagcattcaggcctgataaaatataattaatttaatcattatgaatgttcatcctcataccactgcttacttggaagcaatggaaatctcagctcagatgaaaataggccatatgacagataacttgttttcaacatattttgtatgcacggataatatactgtataaggaatagttgtgaaaacctggaaaaagatgaataaattctaaaacatttttctaacagttcaatatctcccacttcccaggaagaaaagtttataaaactatacaaattatttttagaaggatagaattttattgtggaaaatattaatgtttcttataattatttgaaattcaaggttgtctatatttttcttagtataccttttcctccctcctatctaactcatcatagtacatatctaactttaatttaagattatgggagatgctcacataataaaaacatttttagttaaatgagattaaagttttcatttctgtatataaataagaagcatgtcattgtcaatactataacacgccaaaattctcttgctttgaaacataaaagtacctgaacttcactttccatggaaggagttatcatattagttccactggctttttccccatcaaaacaaggtaaatgaatgattaagtatttctgataatttttataattatagtaaataagccttctgaatatgatttttacttccttagcaagaagaatacaaacacaaagcaaatagaagactagccttttaatgttgctaggaaacgtcattgagaaataataaagggaaattatacattagttagaaatgtctgattaactcttccatatccccatttaaggattttaaagtatatataccaggttgctaaatgtaagatgttattttattttaagtcaaaagctggaaatattgctgctaaatattgaatgagtagttgattgaaaattatgtttgtaaagatcaagaaagtaatctttgaatttagaaaattcactaagtaaattaactacagacaacatataatgatgtgataatattttatagaaattaatgtcatgaatatgcctttcctaaatttttcagatcagttggaaattgtaggtgaaaaaaagtcagtaaaaatatatttatcatcatgattttcattagccttatgaggctatttaaatttttatacctcagattgagcatccttaattcaaaaatccaaaacatgaactgtttcaaaatcaactgtttgaatactgacataacaccagaagcagaaaattccacacctggactcatgtgatcagttgcagtcaaaattttgtttcatgctcaaaattattaccaatgttgtattaaattaactccaggctatgtgtataaggtgtatagaaaacataaatgaatttgctgtttatacttgggccccatccccaacatatctcattatgcatttgcaaatatttaaaaacaaaaccccaaatccaaaacacttttgtcccaagcattgtaaatacgagatactcaacctatactatgatttttgacccaagtgcaaagtgtattgtttgtcaatctacagacacgggtttgatagacagcatttctgaaacacacataaccatgaatttttttatatggcaatgtcttgcattactgacattttaagaagcctaatcatataatggttgccacaaagataaccataaaacaggaatttaacttttaagttaactgacaattttcagcaatcatcatgttctttttacattttagataccttagagtagacaaaacactattattttattatttatcatttgaaagttatctttcttttcattaaactctatttacctataaaatgatacatcgcttcattttggttagcagcttatgatagctgatatatacaacagcttagagagaaagagacagacacaaacttgggcaggtgatagttgtgtcttgattggttgtggattttatttatttattattatcatggcccaatcatggatctatttatattagtctttaataattgaccttagaatgttgcaatgttaaccatattttctgtttacatagcactcttgctattttgaataggtgaatgagcagggatacttttctgaatacatttgtcagaattacacaagtttgaacagcacttcaaaccatcttgtacaaaagactctgtaacttggattctgtgggtccttcattttgatgcgataagaagaagccaagaagaaagggttacaatagtatgttatcaaggtgtagaacatcttcactagtaatattgttacatttaggttaatcagaaatatctttaatataattgttattttatacattttaattagataggtgacataaaaatagatatagatccagtatagacatattcaatttaataaattgaaaatcgtcattaggtatctttacatgaatctttaaactttaacctgtattacacatttagatgtaatattaatgggaaggatctggggtagaaggtgtttattcgaaggctcctttttaaaattatgagacctacataattaatgtctatggattgcatttcctagtcctatgaaatccctgctatcatggaattcatgtcaagtttctttttttaacctctttcactagatatgggaactgtgggcatccagtttccatttttcatataattagctaatcactaatgaatggattagtttttcactatctctgcagattattcaattgaagtttgatttcggaaaacacacattgttgaaaagtatgttaatgactagaggagaaaatataacttgttaactagcttcaggatatctagaaagaaaagatggtattactgaggatggctaactcgcatctagagttgttctcaattcagaatttttttaatattatctattgcagtaaattctatatcaactcagtcatgacttgtcagtcttccctttgattctctgtcagccttcattttagatcatttgcaaatccttctgattttttttctgatttttaaaattgattttaataaagttgtttcacagcctgagactcacgtgctctatgctaagtcacccccaactgacacttcctatagcctaacaattattttaaaggttaaaaacaagtatatataggtaaaaaaataatattatcatcatattttttagcttacctgtaattagtgttgaccaattctttttgatgaatgaaggtaagaaagtttttaaaaagtggctattaaactactaatcatacgtatacatataaattatatatattttaatgaattggatatgatctaaatgttttataaatcattgatcatacaatttatcttccaatattttaaataaaatattaataaaaataaagtatttgcaagccatttccaaattgcaatcaggttgtgctctacaagttcatttgtaagccactgttagaatttggaacatatttctccataaaacctgcatgatgaatgtggttaggatacaaaaccaacctgcaagattctacctaaatcaaaatgtaattaaaatgtagcaacagtattattgcagaacttggccattatttatccagctgcttctttgggaaacagtttccaatttctaacttggaaatcggaatgcttgaacttcatttttcttttcacatctctagttatttgcagaattctcccagccttactctagccccacctttcagaagctcctacttcaataatataaattgaggttctttatcagtatggagaaacatctctcagcaagaaaccatttgcagttacaagatcctcataaatcccatggttatctctcagacatgcatttaagactgtactctgttttgtggtcattttttgaatctctgcatttttcaagaaagcaaatctgcaactgtcatgatatttttgaagaaattaaggaccttcctcctcctgttcccacaatatgaagatatgtttttataaatttgggaaagtaatacatgtgctaagctagatcaaaatcaaattataatacttctgtatcaacataaaattgaatacaacaaggtacttcaaatcataaatccaacacttgtttttcagatgagaaaagctatcaccaaatatagtagtcatttagccaagtttatgtatctagctaatttacagagccgcagttagacacagagtgatgacgatctttcactttacccaagaacttacgtataaagagatgtgtgagtttctttttctctgataataacatttccctaaggtaggcatagatacttaaatcttataccctcaagtgtctctccaattcccagtcttcacaacttcccacaaactgtcccttcccttcccttctcttcctttcccttcccttctcttccctcccctccccctcccctctccaccccttcccttcccctccctccctccctcccttctctctcttttcttttcttttcgttttttcttttctttttttctttccttcttttcttttctttttgacagagtctaactgtcgcccaggctggagttcaatggtgcgatcttggctcactgcaatctccgcctccggagttcaagtgattctccttcttcagcctcctgagtagctgggattacaggcgcccgccaccaagcctggctaatttttgtatttttagtagagactcgattttgccatattagccaacctgcccttgaattcctgacctcagatgatctgcctgcctcggcctcccaaagtgctgggatttcaagcgtgagccactgcgcctggcctgatgtctgatttcgtatacgctgttagtttatgtggctttattggatagatcttcttattaaatggaagcattaaattatctagtacaaaaagaatccaagtatcatgtattgcaattgtgttatgcaacatatgaggaaatcgctgctgacaaacattgtaatttttctggagcacagccctagttgtcagcatgcaatttggaaggaaccctctgtgtcccatgaaataatggacacattttttatttttttcccagagacaagtggaatctccttcaggtgctcgattgagtgttatccacatgctgcaaagtgctgctcagaggatttgtatttatagtcctggaggaaaaaaaaaaaaaaaaaaaaaagccactttgcttgttactgaagggactggcatgagggctgaggctcaacaaatatatatatatatatatatatatacacacacacacagagtcattattttgagtggttactactaaaataatgttacatattgatctctttatactaagtatcagcttgttccttttcaaaaagcacttagaagctcagaggtaacagagtactctcttccaagcattattctggagggagggaggaaagaacactatttcaagtggtaaggttaataacctacaaaaaattctaattttctggtagtagaaattctaaagctaaaaatgtgatctaacacttcccctttaatttaattaactaattaaaaattaattaacacttcccctttaattaaaaattaatttaatttttaaatttaaaatgtggaatactttgttatgatgtggagatgtttatcattatatgactggatttatagttttggcttgtctaagttttgtacaagtttggaagatatatttaaattattccaaaataaactgtggttgggcaaagctgttgtatagagatatagaataattatttaaattaaataatgtatttttatattttgaatattttaacaaagttttaaaataataatactttataatgaaaatgatagtaaaaagtcataagactctatatgtcacttatggattacttttcttatgcccatttacttgatacaatacggggtgcttcataagagttaaacaatggaattaccttgcaagatatagatagataaggcccactttagagagtgggaaaccaaagttctgaaatataaaatgacacatgcagtggcaagtgggcatccagccaagattatgttgccaaattctgcattctttctacctgtgttagtttcccctaaacttggcagtttgaaacaataatggttatctcacaccttttcagagggtcagaaatctgggaacagcttggctgggttcttgctcatgagaaatctcgcacaagattgccgttggctggagttgcttgtccttatctagaggtttagctggggctagagtatccacttccaagtacactcacacggtttgtgtacaggcttctgttaactcactgcttgcagactgagctccacagcccctcagcttgagctcctctgtaaggccacttccacaagggcagctggctttcctgggaataagccatttcaagagggagggagggagaaaggaagagagacccaaggtgaaagctgcggtcttttgtaaggatcccagaagtgatttgccatccgttcagccatattctcttattaaaatggagtcactaaatgtaactcacactcaagggatgaaggatgaatctcgaccatctcagtgaggctaggttaaaaatgtgtcgttctatttttaagactaccatgctaccgttacagactgcttccctatatgttttgtcacatgtaaagtactacatttattcattgagtattacgaatatgttaaaattgacgtcagtattgctctcacatttttataagaacaggtaatgaattaacatgtgatttaatgtacatgtttttttgatacaagaaaaaatggtagagttatttaaggtaatgatacgcatggtaaacatttatttagagtatcatgatgttttcagagacaaaggaacttagtattatttctattaaaataattctattattatttatttagttattgaatgagatgctgagatgtatattaagtcattttatatattatatatcataagtgaaaaaagtattcaataattgggtggtaatggtgagttactatttatttcacaaattgccataatatggaaaatataaatattgagtttcattttgagtctaaaattttattttaaaaatatctgcatctaatattataaattctatcaggaaatatattccaactttatggttcatagatattttaatgcctatgtgaacatttatttttagaacattattaaatatatttctaagatacatcacatcatacctgaagacttatttgttcccaactcagtgaaaagtccagaccttttgaaacttgggactatccatagtagagttttaagacattctcaaaagctaattttgcttccaatgtaattaatgtaaggaattcaaatgtaagtggataaattaagggattattagtttggctcatgaagaaagatgtcttggagacaatgaacaagaaaactagtcatgcaacaaaaatgaaaatactgaattatatattttcttctgttactgatgttaaaatttataaaattattaaaagtttattcttcactaaaattatcaatggcatttaaaacataattacataagagtaaaataaaatatctacttttaaaagtataatacattgatttatatttaaagtagtcagagttatatcaaaacatcattcccaaaactgtctccactatattaataataaagaaaatagtaataataaccagacagtgatatactcaccaaatccaaagttacaatttaattttccaaattttataaaggagtaagttaaatctcagagaagttaaatagatttcgcagggcacaaggccacactaggcaagtcaggatttcaacccgctttgcttgattcctaagttgttaattttttccacttagacacatgatattcttggaaggctcgtctttactgatatttttaaaaattcatgtttttattcaaagaggataaaaaggcagatttccactgaaaacataatagcttataaaatcttagtgctaaagtttatttttaaaactcaggagaacaaataattgaaaatagtaagacaaaagtaaccataagcaaaacactaatgttttataattgttaaaaattggtatatatccattcattcttttaaaaattatgtgtatgtaagtggaattataccatacataatttttgaaagcttggcaatatcttgtttattatttttcaactttaaaaatttattatagacacataagtgtacatatgtatgaagtgcaagatgatgttttaatacatgtacacattgtgtaattgtcaaattatcgtttgatacatgtatacattgtgcaatgatcgaatcagggtttgatacatgtatacattgtgtaatcattaaatatccatcagcttaaacatttatcatttatttgttatgagaacattcaaaaaccactcttctagctatttaaaatatacgctattgttaacagtagtcatactactatgcaatagaatgtcaaaatttatttctgactgtaattttgtatgtacccactgacaaatcacttccctccctctctccttcctcccctccccttcttctggtaatcactcttctactctctatatctgtgagaacaacattttcagtttcacatttgagtgagattacctgatatttgtcttctatgcctgcttatttcgtttaacatcattttatttaaattgtgataagaatgtatgactacataattctacccttaccacaaatttttaactgcacaatacagtatttttacctataggaacagtgttgtacagcagatctctagaatgtactcatcttgcgtaattgaaattttgtacttattgaagagtaactccctgtttccccctcttccaggccctggaagccacctttttactctctgtttctgagcttgacaatcacagatacctcgtataagtggaatcatgcagtatttgtccttttgtgactggcttattttacttaccataatgttctccagattcacccacgttgtggcatatggcttttcttctttatggctattattctgttatatatatatactacattttctttattcattcatccatcagtggacattcaggttgttttcacatattggctattataaatagtgctgcaatgagcataggagtgctattactctttgagatcttgatttcagttttgtggtccagaaatgaagttgctgaattctatggtaattgtgttattaatttttgaggagcctcctcattcttttccataagcaagctacatcatttgaaattcccaccagcagtttacacagagtccaacttattgacatatttgccaacacctattttttgtaataattatcataatagatgtgagacaacatcattttttttttttttgaaatggagtctctctctgtcacccaggctggagtgcaatggcacaatctcggctcactgtgacctctgcctcgcaggttcaagccattctcctgcctcagcctcccgagtagctgggactacaggcacccgccactatgcctggctaatttttctatttttagtagaggcggggtttctccatgttggtcagcctggtcttgaactcctgacctcaggtgatccacctgccttggcctcccaaagtgctgggattacaggcgtgagccaccgtgcctggcctgagacgatatcttattttggttttgatttgcattttgctgattattagcaatgctgagcaaattttcttatacctttcagccacatatgtgtgtcttttttgaagaaattaccattctagtattttgctcactttttaattgggttatttggttatttgctcttgagttgtaggagttcctaatatattttgtaatgagcctcttaacagatatatgattttcaaatatttctcccatttcataagtggtcttttaattttgttgattgtttcctttgctgtgccaaagcttttaagtttaatgtatccccacttgtacacaattttactttttttgcttatatttttggtgtcatatccaagaaatcactgccaagcccaatgtcatgaaacatttcccctatgattttttgtaaaactttaatttgtaatctgctgtttcacttagtaatgatttcttattttccacatataatttcttcttattttccatatataattaagaattcatatactgaatgatttttactcactccatattattcctttacatggacataccctttttttaaaaaaaactaaccctttattagtaatcccctctgctaaattttcaataagcagagctggatgaatctctctaaatgtattcatgaagaacattcttgattaattttataaaaggcaccctgaaatttggaaaatattgcctatatatcactattaaccaattagaagacatggtatattaaaaagttttttttaactataagaacaatgattggactacatgtaaaataggaaaatcatgtgaccaccaattttgtatgacctacattaaataaatactgaaaagctgttcttaaaggaataaatattacataatgaaaagatatggcatactcttggatattaaaatactattgataaataaataacatagagaaaataatacagagataaataaaataatatagagaaaaataattcccaagtctataaatgcattgcaatctctttagtatagtttctggaactaaagaacattcagaataggtacagaaagaaacacatttttaaaaattgaagcatcacatgcatatagaaaagcatacatatcataagtacgactcaatgacttttcatggagtgaactcacccatgttcccttcatccagataaagaaacagaattgcatcaaaatacaaaattatgctatgctaattgctgttcaccccctacaaggttcctgacttctactttcatagattaatttaccagattttgaatttcaaataaatagtcttgttcactatggactctctttttttctttcatttagcaccattcataatggtgcatatagttgtaattatttcatgattattgctgtataatattgatatgtatgaatacaggagtatttaactattcaaatgatgaacatttggctttttttcagtttaggattattgtaaaaattgttgctctaggtatacgtgtatgtgcctttggaaaaatatatgtacttatttctgttggcttcatcagtagaattattgaatcatagtgtatatgtatattcagttttagtagatattgctgagtagtttttcatattgcatacaccaacttaaatgtgtgggcaatgtaagaaaattgtagtttgtccacaacctgactaatgtatagtattatgtgtcttttaaatttcagccattctgctgagtatatagtggtatcaccttgtggtcttcattcacatttccttgataattaataaatttcatcattgttttatatgtttagcaacaatatgggatatcactctagtgaagacattcggtttaaacattttgcccatttctttttttcactgtggctttttaattgttttgtagaaactctttatatgaggaatttgtcatataaattgtatggcaaatatattatttcacccttagattgctttttcattctattaatgggtgtttcttttaaggaattatatttcttagtttaatatattttaccttaacatatttccttatgattaatatgcttttctgcattgtttttaagatatctttgcaaacactaaagtcatgaagatattctactgtttgtttctttctaacaatgaaacaactctatcatcttttaaattaaattttaattttgagataagtatagattcacatgcaaatctaaggtaacacagagaaatcccatgtactctttaacccatttctctaatttcctaacttctatcttgtaaagttataatgcaatatgaaaaccacaaaattggtagtaatatagtccaccaatctaactcagatgtccttaattttacatgtactcgtttgcatatgtatttatttgtgtttctatgcaatattatcacacatatagtaattagtaacagatttccgtcaattcattggcttaaaacgctagaaattggttttcactgttctggataccagaagtccaaagtcagtatcactaaaccaaattcaaggtgtttgccaggctgtgctcgctttggaggctctagggaagaatctgttctttggccttccagctcccagtggctggtgtcattgcatgccaatctcttcctctgtgatcacacagcctcatcttttatgtgtgtacctagccccttgcctctctcttagaaggaggtttatgatggtatttaggtctcacccaagtaatctaggataagctctttattttatttatttatttttatctttttgagagggagttttactcttgttgcccaggctcgagtgcaatgatgtgttctcgactcactgcaacctccgcttcttgggttcaaatgattctcctgcaaagtagctgggattacaggctgccaccaccatgccctgataatttttttgtacttttagtagagaaggggtttcaccatgttggccaggctggtctcaaactcctgacgtcagatgatctgcccgcattggcctcccaaagtgctgggattacaggtgtgagccactgcgtccgaccaagctctttattttaaaatttttaatttaaccatatctgcaaggaccatttttttttccccaaataatgcgacacaggttgcagagattgaagcatggatgttttctggggaccatttttcagtcttccacgtttagatttgtgtagctaccatcacagtcagaatacagaacagccccttttaccatgtctacctcagtctcaactgcttttcactggtcccctcacccctggaaattacttacctgttttccaactctgtatctttgtcatttcaatcatgttatataagtaaagtcatttaatatgtaacctttggggtttggcttatttcatttagcataattctctggagattcatccgagtgttatgtttataaatagtctattttcttattgctgagccatttcgttgtggtatggctgtatggtttatttagtgattcacctgtggaaggacacttcagttattttcagatccaggttataacaaataactctgctatcaacatttgtgtagaggtctctgtgtgaacataagttttcatttctctgggatcaatacccaggagtgaaattgctgggtcgtttggaactgctgggaggtttagaacttgatcatttttaactctcagaccctttgctcttttaagactcacagtcttacagctaagacaaattcaagtaagcccaatgctttcatcagaaaaaccactcatttataaaaagtatgaccttaaacaagatcaagctcagcatttgtggcttcttcttatacttcctggcaacacagacttttattgaaagccttaccagtttgcaagacattccatcaaaaatctacctatttcagctcaagtttcttctcagggagaatctcagttctgttccctgattgacactataataaaaacttcagctggatttttcccataaattcagccaacatgcctctatcccagcagtgaacataatccagatttaggccaaaatatctactacatagagcagtgttcaagtgagcatttagatccaaggttccattaaaaaggaaatattgaataggcaacctaaaacctaaacatttgcaatgagaacaaagacacaggagcaaatcttcagcaaagacagaattatctgtgtacatcagagagaaaaattcaccttcaggaattttcaggacttaaagactaacctcatcattcttcttgagaccctaagaaattcttcaggcaagtgtgacatagtgataaattactctttgatgttcactaacattgaacaagtctgagaaaagatagaaatgttcagaggtcaaatgttactgactttctagccccaaatgcttgtacaaacagctatgaagataaatgggaactcatttgtaaaatgctgtatgacaaccaaaacaaatgcaattttattcagctcacaatgcacatatggtttcttaattttctataataatagaaaatatcttcacaaaaatataaagaataagttgctgttacaggaacttcagtatatgtttattttaataatttaaataatccaatttatgaatttagaaatatttttttttaggtagccagacatttacttaatcctagtgacttatgatcttgtcattttcttaatatgccatttgtttactatgtctatttctcatattaagtatgtattagaatactcagtagacatgtgaaatgtatctatttaactggttaaagtatcctgagttttgtagaaaaacctgtattcatatgaacatatcacttctattaacaatggcatccaaatagtcaagtggttattaaatttttgatatgtttacattgaaatactgtagtctttcacctaaaagaggaagtttaaaaactaaaatagatccaattttaaaatatcagtggattttttctagagattcttgattctttaatgtgtttgagggttattagaaattatggagcccttgcatctctctttaaaaaagaaataaatataaaatctcttacttttcaatcagtacagtctattttaagataaataatttttaaaatgcaagaaaagcaaaaagatagcgggtatgcaaggtgataatgataggtttgacaatgcaaattacttctgtaaaatcatagaacatgctgcttgtttactttcccacctctgatctttaatataggagtttttcaatatgagataatgagttaaaaataacaggaggctaaatatatgttttcactggaaatcaatttccaccacattttagcaacaatagcttcctaaaagagaatttaggtgagcaaaaataacaaacaacaagtgctgaaaagtcacattaacttccataaatcttccttaaatagtctctaccactcagtacaaataagcaagactgaagttcccctacagttgtgccctccctaatattccccctgaatctgttgtaatgtgaggctaaataatcttgtaggagagagagagagaaagagagagaaaatgaatgtatgtatatgtgtgtaaataacctctgcttacaaactaggaatgctttttaaagtcattatcaagctgtgtcagtctatgtggtcctgaaaatacaatttggtcctttctttttgaagtccctctgtgtgattcagcaattccttgtgtctagaaataatgtggatatatgcaaacgctatttggggaaaacttttctcactatggtactaattctagtgtacttattaacacaatttgtatcaatattaacatacacaaatatattttatattgtatcagtttcttgttgctgcatagcttagtacaatcaggctgctatagcaaaaggccatgaattagctagcttacaaacaatagtaatttacagttttggaagctgggatatccataactcacctcctggtaccttctcctgtgtcctcagaggcagaggggcagagggagctgtttgggaggcctcttgtataaaagcactaatgccattcatgagggcttcactctcatgacctaatcacctcccaaatttcccatctctcactgctatcacattgggaattaggttttaacatatgacttttggggagacaaaagcatttaggccatggcactgcataacaaattactccaaaacttgacagcttaaataacaaccagtgtttaatatgttgcatcacttttgtggatcaagaaattagaagccacgtaagtgggtggttttggttcagggtctcttatgagatcactttcaagaagtgttggcagggatgtcatcttctgaaatcttgactgggcctagaaaatgagctcacccatatgttctcggaatcggtacctttctatctgggcctctgcttgaatgtccgtgtgatctgataactggctttccacagagtgaacaatccaagagaacacaaggtgaagagtttttggaagtcacactccatgatttctacaatattcttattggtcacaggttcaccctactccatgtcagagaggactatacaggtacataaataccaggaggaaatgcacatgaggattacagatcgttggagactgtctcttagctaaataagtcattccagtgttaagaattttagacaatataattgatgattatgagggtaataacattacaaagttgatgccctacacaaattcttgtttccaaccctttctcaatatgaaaaagtaaaattgaatttccttatttattattttaacatatcaaaaagtaatgagtatcatatatcaccgcattatttttcctcccaaaggtaaactaacattagctagagcactttaaagatatacttgtcctttattaaccaagcaagtagaattttagctctaaggatactttagctacttcagacagtgtcttctaacttttatttgcaatagagttaaaccttaattatttctattgtttcctattgcattaaattttcaaattaaatctagtttttattttgcatttttatcatccctgacacctacccaattgcacatttactactcatcctcatttcccacaaagtgctaggactaagagaacagaaaagtgagcttgaaacacagccaaataaaaagtcagcaagacaatgcccttaaagacatctcatctgtggcaactcttcatttgatctttgtttctcgaagtgtccttctctcctgctttgctcctaggaaatgcttttaaacataaaatatgtaattacattccattctcttagtaaatgtgtgagtcagttagaaagcaaacatatataatagggagatgggatctgcccaggctggaggtttgtatcatttccaaagctgatgtttctattctgaaaacagagtatctcagcctggggagaaattcagaggttacatggatctcacaccaatctgaggctagaatcttctcctgaatataatccagttaatgttgtttgaggcacttataacagggaattcattatctcctgagggagataatgtgggaatcttgatcaatttggggctgttataagttgtattgtgagttattacttaaactgagtaaaaaaattataaattatcttttacgtgattatctttcattttgtgcataacataatctctgaagcaacactaattcaagttgaagggttctagtttccacaaaatattttttgtaaggattcaggattatgctcttagtcatgaacctttgatttgggaaaggtttctactcacacgttagccctatccccattcctctgccatccagacaagaattctgaaataaataaaattatactgatgttagaaagtgaaactataaaatcagcacattttattttggaggtgcactgtcacttgaacgagatagaaagattcttagatccacagataaaggcatattgaagactatatcatttagaacagggataggtaaaatggaatgatacagagagcagaccaagccaaaggatgccagtgccaagggtagaaattgacaaggaagtaagaattacataatgaattttggatattagagtcttactaaggatgttatccactattgtggaaatagatagttcacccattaatagtaaagttgtctattatgtaactaaatcttctttttctgattccacattcactcagaaactggttttaaattggttttctacgcaaatctatctataagaagtgaccattgtggttattctggaaaaagtattgcaacctatatgacatttaaaatacattgatgttcagcctggccaacatggtgaaaccccgtctctaataaaaatacaaaaattagccaggcatagtggtgggcgcctataatcccaactactcaggaggctgagggaggagaatcacttgaacccaggatgcggaggttgcagtgagccaagattatgccactgcactcctgcctgggcgacagagcaagactttgtctcaaaaaaaaaaaaaaatggtgttctgggctaatgctgttctgagtttgattaatgtgaaatgtctgcattttctgtgcagtgtcaaaattgtgtcgtttctcagcaagccaagtatctttgaatggagcttagccattggacatttatatattcaacaagaccattgtagcaggcagaatggtagtcccccaaagatttccacatcctaatcctcagaacctctaaatgcaccacatggaaaaaaagtactttacagatgtgattaagggtcttgagatgggagattctcctggtttatctgggtgggcccgaagtaatcacaagtgttggtaaaacagagagagatgtgacagtccaggaaggtggagtgtgatgtgctctgatatggcagaaggggctgcaagctgagaaatgcaggcagcatccagaagcttgtaacagcacagaaaacagatgacccccagaacctccaggagcatgaatctgccaagactatttagcttgttagactcattttggacttctgaactccagaactgtaaaccaattaatttgttttgtggtaagctaccaagtttgtggtaatttgattatactagagattggaaacaaatacagtaattcatcttcagaagattcttagatggtaaccatttggccttttcctgttaatagcctcatcttgcattgcaagatttttctcatgtgtacatatttatatgatatcgcatgtaattctcttctggagcaaacagcattttggacacaatctgatatctctgatttattgttattagataatgcattttatgagcacattttaaaatcatgactttttttggctgtgaccatatgtgtgtttaggccttttaaaaattaatataaattgctagatctcatttttctaatcagagatcctttgattttaaaagtcaagtactataaaaaccttcccttaaggaaaaccctaggcctggtggcatcagatgtaaatcctttacaatattttcatttaaaataacagcattttaagataaattcttctgcagaataggacagtaatggtttattgagatcaactaatgatattataacaaaagaaaaacaaaagccagagtctcccctaaatataaattcaaaactcataaaaatattaacacaaaaatacaagagctataaaaaatagctaggctgaacttatttctgaaacacatggtcatttaagtttgaaactcaataaatttcaaaaattttataggatgttggagaaaaattacacatttctctcaagaggtacagaaaaaaaattggctaacatttgatgtcaatttattataaaattattagcaaactagatatacaaatggccatccatatccatgagtagtacattgttggattcaactatctatacatagaaaatattcaaaaagacctgatgattggctttgtacagaaaatgtacagacttttttgctatcattattccctaaaaaaatacaatacaacaaccatttacatagtatttacatttattaggttataagcaatctaatgatgatttgaagtatatgggaggatgtgcatatattatgtgcaaatactatgtcattttatatcacagagttgagcatgcacagattatggtacccctggtgggtcctggaatgaatccctcacagataccaagggaagctataaaacagcatttcctttaccaggtaaaaacgtattgaaaacaaacatatttattggcaaaaataattaaaacattcttctggaaatcaacaacaagtaaaaaaatgtctgttaccaggacttctatttaaaattgtacaggaggcctctgctaatgcaaagaacatgaaatatgagtgtaacatctaatgaagaagaaatttttaaatgtgatatttaaaggaggatgactatgcacataaacaattgcacagattctacagatcaataactgaaattagtaaataattttagcagattttctgttagaaagccacaatgcaaacactaattttatttctatagaccagccccaaattagaaatttaaaatttaaactactacatatatataaatttatatacatttataaatttaacacaccatatatatgtgtggtgtgtgagtatcagaaaacatgaaatggttagaaataaatctaatgaaagatatctaagacttacacacatacaaaattcctaaagccattactgaaaaaaacaaagaagacataaataaaaggaaatatataccttgttaaggatttaagtgttgtgaagatgtgaattctttcaaaataggtctgtagcatccatttaaaaaataaaaataaactgtcggtgtgtgtgcacatgtatgtttttgtgtgcaagctaattgtaagatgtacgtgaaaatgcaaatggccaaagatagcaaaaataatcttgaagaagaaaagggtagagggctagcactattttacatcaaagctaattataatgcaacatggtaaagcagtgtgatagaaatctcagaagagacaaatagaataagggaatagaatggagagattagaacctacctatacaaatactgccatataatttgtgatataggtggtggccacaccatgcaattgtgtatgcatggcctttttgacatatgtttctgaatcaactgaatattcaattcaaaaaaattgaaccatgacctttgtctcacaccatatacaaaagtaagaccctgggtgtggtggttcacatctgtaaatctcaacactttgggtggctgaggcaggaggcttgcttgagtccaggagttcaagactagtctggggagcaaggtgagacccagtctttacaaaaaaattaaaaaaaaaaaaaacacatggtggtgtgcacctgtggtcacagccacattgggaggctgaggcaagaagatcacttgaccccagggggttaaggctacagtgaaatatgatcatgccactgcactccacactgaagacagagttagacactgtctctagaggaaaaaaaaagcaagtcccagatggattgtagagctaaaggtgaatattaaaacaatacaacttttggggaaaaagacacatgagaataacatcatgattttgtttcttaaatagaacgtaaatcactattaaagaaaagttaataaatctattttaaaaatctattcatcaaaacagatcatgaggagagggataaagcacaggagatatatcaaacgcacacatatatataaaatatatattaggcaatgcggttatctcagaatataactcatagaaaccaatgagataaggagaaatagctacattggaaagctgtttgggaataaactggtagtgagtatgcgctgttacgtttttggtataagctaattataagttgtatgtgaaaaagtaaatggccaagggtagcaaaaaaaaaaaacaaaaaacaaaaaaacaaatttttagccattcttctcttagctctgtgtatgtatcacataaataatgcatatacatgtgggcacctgaagccaagtatatgtgtatttatactgaccttatttattatggtacccaactaaatcaacccaatatacatcaataacagtatgcataaataaatattggtaatttgtcatatgcaataatatatagcaatgtaaagatcaagctactgctatgttttatgaaatggatacatccgacacacacaacgatgaatgaatgaatccacacaaaaagaatagtatatcatatgacataattatttcaagttaattgacagcagaggtaggttacctttgttgaaaaccagtgaacaaaggggacacgtgtagacatctggatactggtgatgtaattcttgagctggatgtgattacacaggtgctttcactttacaaacatcactgaagtgtatattgaaacaagtgtggccaccctcctatatatgtcatatatttctatgaaagcttattacaataaaagatacattaccggagtaacacacatactcaaaagagaaagattgattgcgaggaaacacagcaaatctcaggaacatcctaagtcagaaaataaaaatttaactggcttgtagaaactcggactggatgtcagaatttagggttgcttcttcatatttggcaactgaaataattgcctcttgtctctgtttctgtcctctctgtgattttgattctttttgccagctagctttcttcgcttactcatgcaatctcctctactgcatagcttttagcttgcatgtggctttgactcaccatgtcacgaaagctaaatcaggtactgggtgcattttcattttaagtactgcagtcatctaatgtacttcaccagcagaatctaaattctagatccaagaaagattattgtcagctggctttattcagggtccaattctgagcccagtatcaagtaataaagattgagtggtgtgataattagagatgcttcaaccaaagtatgtgagttaatcagttttattcttgttttacttttttgctttaagaagaaacctgtgattgtgaaaaactcattgaaattccttgctaccgctatggtcatggaaataaaatggcatgatacagaagttctcaaactttttggtctcacacactctcaaatttattgaggaccataaagagattttgtttctgtagataagatctatcaacgctcaccatataagaaattaaaactaagaaattgtaaacacattccttttaattttctaaaataacaataacaactcattgcatattagcatgtcatctgttgttatgaaaaatagctgtatttaaaaataatagaagagctgcattgttttacatttttgcaaataaagattagctgagtgtcatggtgcatgcctgtagtcctagcttgctcaggaggctgaaacaggaggattacttgagcccggaagctctaggctgcagtgagctatgatcgcaccactgtactccagcctgagcaaacagatcaagaccctgtagaactcttgttttctaaagccagatctcttgctcttaagtacagtttgttatctttgtttggcaatttaagatgtaaacaacaaatgttaatgcattttttaaccgatgtattttacactaatataaaacctaatgaattattcttagatgtatgaaatcacattacagatttactgtccctttttagacatcatgccaaatgctgtatgcaaatctgatttgcttgataacagctagtactcttgacagcatttaaaataaactggatgtcattataacttaacggtcacaccaaccttccaaagtacatgctgttttaatatacattgtacaagttaagatgaaggttttagagattaagtcacttggcctcagccagagagatagtcaaagatagagctagattttgaactttgatatgttggcaccagagttcattcccttaaccacaaagttatctaattttgaaataatttttcgcccataatatggaaggcagtggaaaaaggaagcaggaggtgggataaatgtatgttgattagtgatacattattatttttttgaactgccgtaacatctcaaactaccaatatcactttgcaaaaatgtataatgtcttgatagtgtgaaaaattaattataatccattaattataatgtccctagtttgcttttgttctgttatttataaatgctattatttgataaccttgctgtactacatatcatactagtttagtggaaagagaaagagtgactgtttaaaaaatttttgtaaagatttaaatttcttacttaagcttctagaaataatcctgtcctttcaagcaacaataaaatgataaaataacataaaagatgattcacaccaatactttttttaaaaacacaggattgttacaagtatttaaaacgtttatattattttaaaacacagagttgtcataagtatgtaaaacatttatattatttatttcccatatttcttttaatctatgtatcttttataatttaataatattgtacaatatacttatatactattttggatgacttatgtattttttataattttaatgttttgtataggaactcttttcagtaagaaatgaaatgatagatttcaacttaaaatagaaattagcctcaaaggtaaaataatgctctgttaggcagtatttaataacttttctatatttctaatttatttcaggactgtttagttctccttttattgttctcattctgttccattaataggtcttaagtttacctcagagaatcaactgccaaaatcatcaaagttttagtgaaaacaattttgttaacagtcttttatagcaagaaatgagctgaagtaggcgaccttgccgcaaaatttgttttcagactttttagtagaacatggggctctaactgtagctgtaattttaacttcccattgactgtcagttgaaaatatatagaaaaagatgtgctattcacagaaatctccataaaaggcttaaagattatacatttcaacatatccaactgacaacccatgctttactgcacataaaaataatcacacattaaaaagatataaacactttatggcctgtaaaacacaaatcaaattgtattctttaagtcatgtttcagaaagtaaaatataatttaaacgaagatgacatgaataatagtttaatattatatattagcattatactaagcaaaagtattattttaatattgaaaagagtaagcacattgcttcagtaaactctcgtctatccttgtatatttacaagttgagatttagttctgcatttgaaagtaaaaattcaagtagaataaacattttgccttaaaaacagaacgtcaaacccctttttatttcagatccaattcacttggcattttcaaattctagctaatattcagaatataatctttgcatttaagacatgatactgaacaaataaaatgtaatatttaaactatataaacaaatataaaagagaaactcactttgaaaatgtaatactggacaaaacaattatggttctttttctaaatcattagagatgaaagggcaaaactcatgcttagaagtcaaatatatcacaaagccctaccaaaaaaaaaaaaatgttgatgtagtaaacaatcaatggatagtcattgtgtgaaaacctgtatgaccaagagtaggtttcagtgtataaactgcttgtgatttcgtcagtgacttgagtgctactctaacggtatcacagagtgtaacacaatttgaactcaatcttcgtttcaaagaactgtttatatcatttctcaagaccagtgatgctaagcattagcttcctaacgttagattccaaagtgtcataagaatcatctgaaaagcttatttaaaatgtagttttcagccaatgcccacagattttgattctgtaagtcaaggtcagtgctctcgagccagcatttggggctgtctgaagcacgtgggaggcagagtatcttgcacagattatttcttctgtttcagggttaaactaccttgaaaagcccaaccacacctttcctttaaagggctaaatatatttaatagcatatattattcttgttattaatttgaaagtcatctggtcatataaatataatagtaattttataaagataacaaaaatgcatccaaagatatcttgatacctgataacttacagttaaatttcatagttcttgcttctttcatttatcagtgaggatgtaaatatagtaatatctattccataatcatacatacgtatttttttctggcattctcttagggcattaattctaagatgacagtgattacatattaatgaaaaattttctgagacttctttctaaggtttggtatcttcattcacatcacaattagcacatattgatgccatgccttcactgcagtaatacttcagagagtttggatacaaaacttttctgaaactaaagtaaaacagtgaaatgaacctttgtccttagtatttttaatatataatagtccaaactattattttaatttagataatactcagaatatttccaatttttaaacaatgtgtatgaaattctttatctcttaagattcatttgacttaatgatcctaagaaaattaaactttttgacataactttaaaaataaaacagccacaaggtaatgtggcttatatgttatgcttgcattttataataaaaatgaatttattactgaatgtacatctacctaaatgttatatacaatgaattatgaaaaataataaactattcctatactcagaatattttctaggtgaagtaatgagacacagaatcaaagaatcacaaggaaagaactgtaaattgtgaacattgcttttgagttggcaattttcttcccaaaaatgaataaaataatattgtaagacatgtattatgagttgcacagatgatttttgaacacagaatactaatggaaggagatcaaacctggcaataattcacaaagataatatgttgttgaaattttaatagtcacatttgtatgtgacatcatctaagtcgagattttcaaaatacattacaattagtggaggtataccatgaagttccatgtaaaaaaataccaaaaatttgttcccctgttgaactacaggatagttcaacatggttataatagaatacagaatgaacatgtataagatgtaattaagcccatcaggtagggaaccagcagaataataaaggtaattcaaaaggcatttgaggccaggtgcagtggctcatgcctgtaaccccagcactttgggaggtcgaggcgggtggatcacctgaggtcaagagtacgagaccagtctggccaacatggtgaaaccctgtttctactcagagtataaaattagctgggcgtggtggtgcatgcctgtaatcaggtacgtggaaggctgaggcaggagaatcgcttgaacccaggaggtggagattgcagtgagccaggatcatgccattgcactccagcctggttaacaagagtgaaactccatcttaaaaaaaaaaaaaaaaaaagcacttgaagagctgggtatttgtcagcgtttgaataatgaacattagactagagtaaatctgtttgaccagatacaaaactgatgttctgcatgaaaataaaaccatgacctttgatgttatagtttctactaggctgaaccatttgcatttgtcttgacaaaaaaaatctatttattatgtaactcaacagagtattgacctttaatcaatagtgggtagcacataagacaaagaaatatttgtctagatatttacataagttttggacccactattaaaacaaggcattgaaaggacttactctcttcccttttccttgtttccaaatgttagtaatttttcttattaatattgtatctgccctctgccttcatacatatcccttcataatatgattgtctagcttatggcaccgtttaataaactctctcacctctccttttgccagaataacacttccctggagagcaggaaataattaactgtgtgaattcaaagggactccctgcagggctataggcttcatgctaagtaagagtaaatagaaattgtttgcagtgtcaacaattacagccaacagagtcaataagaatttagagataagattaacaatagataagtgactaaatgggaaacattccttttgagagttaatggcatctttatttggaaagtttctgagatttttagtgtttctctatgagcatacaagtgtttcaaacagatttttcaaactaattttagattttggatgttgcattaaaaaatgccttcatgctttgaacagacataattaaatgctatttaatgtgcccttcagaatgagatacttgaataatttactgtagttcattccacagtgcttaagtccagagcaatgattacaccaaattgatctcttgacatttttcacagcacttcattttcaaagtagttggtcttgtacacatgtgtatcaaccaaaaatattgcaattcagaggagctcttcaacagactgtcaaataaatctatccttcttcaatgcttaattcacttgaaagctaaatcctatagatttgatggttatctaaatgagtataattactcttcattttagggtttctaaaaatgcttcttcttgtttaaaattactcgatttgcattcacctctgtatatgtaaatggtatttgttgtttggaagctgaatttaaataaaatgtaatttaatatacttaagtttctaatatagctaggcctctgcttgtggacttcttttggtaacttttgaatgacttcatgtcttatatccatctaagggagtttcagtgtgtggttttgggtcagttagatagtagaaaagaaaagagatagaagtacatatagagtttacctgaacatgatgatttctttgagcattttcccaaaatagaagcctggttcatactacactctgggaacatattatttctacaatgtcaaatgtatgtttgcatggtatatttaatgcccctaaatagaaatacattaggatttggctttgtgtacatagttttctataatttgcctggtaggacacaacaggatttcaagcaaacaattcattaagtcacctttaaaagatataaataagtattttcttaacatgtatatagacatgacatcaaatgaaaccctgagaagaggccacagtagaatatttcaagcatgttaggcccaaactaggagactccaactatgtctttgaaagaaacaactaattaaacaaatcaaatgtatttaattaaatatctatgatctctctgtgatgcacacatatcccatttcctatataagcctttcatattttggtgtttctaaatacttcaactgaaacttaccaaatgcttgctgcaatcacagtgttgttccaattattttaatgaatactttatatctactgctgtaggtatacttataccaatccgtgtttttaagttctatttaattcacacctaaggaaataataaagcagatatttcaataaacttacccaatatcatacaagtaatagatatcagaacttagatttaaacagtgaactagaacatttaggtctttttttccccttttcatcatttccttataaatatgggaattgttgtaaagtcagtatttaatgtattaatatgtgctcccccatactagagctaagaaaaacaagcagttatgtggcaaacttctttttaaaggcttacaagtcttgttatttaccttaagaattgacacaacctttcaatcacttagggcattcttaccaccccataaaaatctctctttgcaacattacacttgcttttttaaaaaaattgattctgcttagattaaagcactaagtgtaatgagcaagttaagataactttagctgaagaaagcttagaaagcttagattagagtattattcattggacttgaaagaggctttaaattatataatttatattttgtttataaaaatgagagtatataatggtagatatttgaatgcatgaataaatgaaaaattcttagtaataagctagagacattttttagcttctatttgatctccttgaatagtatttactgtttaaaagtttgcaacattcgaaaactagttctaaaaattaagtctttaaaaattgaaatttaaatttttactttgtgacacacaaaaaaagatttttttataaaatgactttccggtatgagagtacatttatcatagactcatgtaatgtaagttactattttattacatttttctgctacttacaaattatgtagttgtagttaagttgcttaatgtttatgaaccttgattttttttcatggataagataaacctctgtgatacctccctatttgaataattgtaagccttaaatgagagaatgagagaatggatagaaactatctagcactgtgcctgccacactgtaggaactttgtttcttttaggtaggtaaattatctcctttccatcagccacagaaataactcaggaagcagacaacattcacaggcttttcttctctagatggaaccattgtaccagggcagcatgaaaagatctattgcctaagttcctaacaattgtttgtgtgccgtatgtttgtattctgacattgtagcaaagaataatataaatacgttctagtactaactccagtttgtatattttagaatgatggttgaaggtctgccatgtcatgtgttttaagcatgtaagttttataaagttagcaatctaatcacaataggataacatctggctgtctctctcaaaaatattggcaatcatagacaattaaaacaattaaatttataaagaataagttgaaattcccctcaaattgccatacctaaagggaaaagtattttggaaaacttttttctcctttttatccacctaggttttcaaaaatgggaacatattgaacccttggttctacaactaccttcttacaacgaagttagtatgcagtgctctccaagtcaataaggaaagtggtaatgaatcatcataataacattattaacaatacctagttttactgagcacctaatatatgtcagatattatctgaaatgcttcacatgtattatgatatatgagatgcgaaatgattttgtgaatagctatcattttgattcctaaacaacttttcccagatcttaagtgaagtaggtagcacagcctgtcctcaaacatctgtctcttaaggctgaagaacatgcttctattttcctacatcggtgcctttgaatgacactgaaattctctttgctgtaatctcagttacataattctatctacttgttttaggccctacttccaagctgtaatgttccaagaggaaaggaccagttctattttttcaatctatgttactataaacataaatgtctcacacatagccagctttgaataagtcaataaaaaaattacatgacacccttttaatagctacactgaattctttcatgtgcacatgctgtgaagtatgtaactagccccttttcatctatacttttatgtgcctataatatctacctttatgactatcctcgtatttacattcttgtgcaactgttcacatttttcttgttaggaaaaaaatccccaaattagaattgctcaatcaaagcatacccacatttaaaattcaaagcatactgtaaagtacagttacttaggaagatttttccagtattgccttcacaatgttgaataaaagtaacgattttccccactttttacgacatttaatataggttttttttttacagtttgaaagtttttagccaaaatgaaatcttaccaaaactgtagcacgcttgcttcatggtacagtaatactgctaaaaggcaaatctccaagtctccgtggcttaacacaggtgatttgaagtctgttgtgcatggtgagggtctttgttttcatagtcattgggggattcattcttctactgtggctcagccttcttcgaaggcctcaattttttctgtgtgttcatccaccagatgggtagagcaaatggaggattgatcacaagggaagattttatgagccatgccaagaagtgacttaatcatttccacacggatttcattggccagaactgagttgtatagccacctttaacttcaaggaaggttaggaagttagcatagctctgtgcccaggaaaaccggagcattggttgagcaaacaatgaaccagtccctacctgagttttcccttctggtcactaaataactgaatcttcatgctttacataaaacctactcatgccaccccaaaaaagacaagcattatcccatacataaaagttaaagattcctggataatagtcttctccaaatggtcaggatctaaaaggcaatcccacctcacccctgcagatatcccaaatcaagggcagaactgagacagggtaaccacaacaaaaattccctcctgggaaaaggagaaataagaagcaaacagatgtttccagttcatatcaatatttaaatactcctggggatgagacagtgatttttccagataacgggaactctctggcccgttattgtttataaaccatctagttgtaccttatagttgatatttcttgcacttttttcttccataactacatctggagtaggcagtgaaaaataagctgttctttgggactgactcctagaatcttccacctgtatattcaagcctcaggatgcaaaggtttatctgagactcaagttatcaaaatgttattgtccaggatcattatttctttgtcaataagatttcttcacaaatgggtaggattttgattgattttttaaaaaatcagtcccatataatagtaaatgctcctgtgagagggttttatggaccacacctgaatgtagtttttactacttttagccatgtccctttggcaaggactcagcaattatagccaaacctggatggccaggagcagacaattttggtaaacatcagcctattgttgccttaattattgggaaataaaaaaacctctatattagggaataactttgattcattttaattgtcctgttgaaatttggatgtagtctgtgtataaaaaaaagttacaattaaaaaaattaccaaggaataaaatttaaaaatataaaatcttgtatcttccagaattctttatttttcaatgacaattaataaactataatttggctacaatattttaaaaatacaaagaattgaaatgtaattatgaataaaacactgataaaaattaaggaaaaagtaaacaaattctttctagattcaacaatataaaagattcaattctattttgattacttgtgtttaaaaataggcaaaattatgattttatgtgtatgtatatatgtatatatataaaaattatttctgctttatgtatcaaaaatgatttcttatgatttgaaggtacaaaacataaaaatgataatgcatcattttaacttgggtttccaatggctttaaatctttataatctatatgtatatctatctatccatctatctatctatagatcgatcgatctatctatctatctatctatctatctatctatctatctatctatacccatggaagaaatagaagaatattttcaagtacaaagcctgggattccccagttacataggtaaaaggcaaaagtgaaagctaagtttagtcacttctctctcagttgctgacttttctattagttggggcccatcaaatcctattagtcaaatattattaggtcaaaatatcaaacgcttaattactttaacacttttgtagtaagcatctcccatatgtgagacaaagtgtgatttaacagggattcaagaattaaaaaagtcaggtatctactattaagaggattatggttggatgcagtggctaccaaatggtgtttccaagatgggaagaattatcacctgtgaactcattagaccagcatcttctcagactccactagccatctgtttttaacaggccttctgggtgattctgatgcaatctaaagattgactatggctggtctagtgctgtcctttaagggcacttatggtgtgtgacagaatatgctccccgctacctctgctccatcctgagcatttttctaaattgcaaccagaaacttaaaatgtgtaaaaactgagctacagcacttaatgttccatttactattgttatgtcctttacacattacaaaaataagtattcctataaatgagttgcagcagacaaggtcttgtgagcattcagtaagcaaacacataaaaataaaatgatatagtaaaattcaattcaatttctctctctttaaatccattctttatttttctaaaatgtattaaagtcattttctactaataaggaacaaatctaaattcaaggtcaagaccgtaagaggaagaaagcaagtttattataaactatgatgttaaatgtagactataggatcgagaaggagatttcactgttatctttgaacaaagattaaaaacaaagtatgattagttatgttaggatggttactatagaaacatataaaatgctttgttatagtttcataaagttgttgtggaagatattattaaagaccttagaaatcctaaacttaatagcttaaaggagtcaggcagataacttaaataagcgattagaatcagatgtaataaaatgaggactggcttatgtagactgcagtgatgtgcagaacaggccattctgaattgataatgcatttcccaggtcagagaggtcaatgccaaacagaatatagatcacatttcaccagatcttcacatttctcaagagaagatagaaacttgtacatttaggtaaaatctacacatgctttaatattttaaaataatttacattttataatattgtgttggagaaatgacatacttctgagtgtatacatgcccttgagcacatgccagtatacaaattatgtgttgcaacatgttctttgtggaaactgaagagaaaattatttctgctttgtgtatcaaaaatgattttttttggccaggcacggtggctcatgcctgtaatcccagcactttgggaggccgaggtgggcggattccctgagctcaggagttcgcaacctgcctgggcaacatggtgaaaccccatctctactaaaatacaaaaaattagccgggcatggcagcatattcctgtagtcccagctactcgggagggtgaggcaggagaattgcttgaacctggggggcagaggttgcagtgagccaagatcgtgccactgcactccagcctgggcgacaaagcaagactctgtctcaaaagaaaaaaaaaagttttttttgatattttgaaagtacaaaacataaagttgataatgcatcatttttaacttaggtttccaaaggcttcaaatctttagcttccgttttttatcaactactagggaatgtatatgtcattaaggatttcattctatgtgccttttcattttcaacttcttgcctttcctaagcctcttctcttccaccatgcattatttttatattatattttatggtatggttaacacaaccagaatttccctcaccgactatgtttttcttcagatgatagtgccttcattccctttgctgtagccaccacagatgagctgttactattacaggcccattttagactttcaatgagatatgagatcaggacaaagatggtactttaagctgaaccatgctttctcttgttcttgagccatgcttgttcaggcttttttttttttttctcagaagataattacctgaatttcaaagtcctctgcatccatatacatgagcttttccccaagtttcccacaaggtaccatggtacctaggttgacaaaactagccataacatgtaactagaataaacacttccttctagcaacataaaaattagtacttactttgagtcccagaccagattccccttcactatttatatacttctctctagaacctctgtcctttgacaagattatccttcatttgcacttatctaattatcttagatagactcttaaatctttggaactcagaagatcaataccattgggaaagattaagtacaaacattgggattctcatctccagagaggccctctaggcttgtatacttgagggattgggcatatattaattttctattttgtgtaacaaattaccgtgcttttatgcgcttgaaacctatttattacatctcagtttttattcattaagagtcagccttaactgacttagctgacttaactgaagctctgctcaggatctcacaaggcttcaatcaagttgccagctgggctgtgttctcatctggaagcttgactggggaagaatctgctttcaagctcatttaggttattgatagaattcattttttctggctgcagaactcatggcagcttgcatcttcaaggccagtaggaagcttgtctgacctcatggagggcccaatccttctttgaatggctttcatatgattaagccaggccaatgaatgagaatctcccttttgattgcctcagtcaactgattcaaaacctcaattaaatttgtaaaattttaaacatttactatataaataaaccttttccatcacttattgaccagaaaccagctacaggttctgcccttagaggaaggagaatatacaagtatgtagttcacataccctaaggttatcttagggtatttcttccaagggagcttctgatctctacctgaatacatttcaatacctgtgatgactaatctcacttgccaatagaatcttagcagcaggctgtttaccaaatgtaacatagtcttttatcttcatttgaataagactatgaacacattatggtataggattataattaaatgatgacataattgtgtaaactctaaggaaatatgtataaaacaaagagtttccactaaatgaaaggatttggttcaccagtttccaatgggagacaagatttctctaacaccagattaaaaaagaaactcacatgtcattttgttgataggcataaagtatagtgttattaacattaatcctaactaaaatgtattgatacttactggacatcttagtaaggtccacacaagcttcatggctataattgctgtgttcttgccaaaggaacatggctgaaagtagcaaaaactacattcaggcctgttctataaaaacttcccacaggatcttgcatcctctcttttcccatctgttggctgaatgcagaagacattcatgcctcagagcaggggagacatacaagatggaaggaatctggtctctaatttacagtatgaagccgacttatccttatctcattttatttttataaaaacccaaaatagcttttcatattaggaaatattaagaggttagaaaacatgcacatatttaggaatatgctacatcctaaaaaagtttggaatcaacgtttcttttctctggagtctgcattcaaacgctatgtgctatttcatttcgctttgctttgctgtcattgtgacaaagaaatcaaaggggtcttgaatagaagtttatagaaataaaaaaagatgtgataagtttatgaatagataaaaatagactttagaatagtatatgaattgagctacataattgtaaaacaaagtagaaacatgctcagctttttatttgctattttaatatttggtgagtgctggttctatgacaggcagtgccttaaattctgaaaatacaaaaaggatgctgtcattctattagtgaatttttttaaaaaagcttaggaatttggatttttgaggtacttaattctgagatacaacaacagctcttccactcacgaattttagaacttttgatgagttatatgacctctgcacatctgtggataaaatattagtactcatctcatagaaatattataaagcttagatgagataatacaggttaagtgtttagtgtcctgcatctgatatggtgatcaaatgatgtcagctaaagatgatgataataataataaatggaaaatctaaaatgtatgctatgttgtagaagcatacaaagaaaagatgactgaattcacaatgaaggccacaaactggtggcccacatgggtaaatatctggcccagaggtgtgtattattgagctaacataatttctacatttatgcagagtaagaatacactgaatccttggaccacgtagcatctaatctccaccatctgcattcacactgcttgtttttctatatttgcctagacctttaagcattttgagttataactcttaaaatagaagccattaatggtttttaatgctgcctagacctctagcacaagaaaacataaacttgctcaggggaggtgtggctccagttgaagaaatcttattctctgcaagcatttggggaagtctcagcatcttataacataaggatactctatagataagcaagagaatatcataccgatatcaaaattagtcatagctaaacatcaaaggtgacattaagtgcactcataaaaatatataatggtgaaaaaattaatgtaaccttctgattttgcaatatctagagaaaactatcttttctcccaaaactgtattaggatagcataaagtagaacaagtttagagcaacaaaatacatgtgtaactactgacatgtatttagacagtgagaatccactctcttttttgacaagaattacatgacctgtaagggactaaaatgatgttgacattcctcacagtgttatgcaactgactcaaagtaaggacatggaatatattggttgtcaaaaagagctatgaatcaactcatctctcttacctatttaagatctcacacatatttgtctaaggcgtatttttgtactgctagtaataatatgttcatttggtttataaaatggcaaagctacagtcctttaaaatactggagcttaatggtagaacattttatatgatgtttacaacttgaatttcccacatgaaaaattagaaataaataacattaaaaattgtataactttgaaattgcaatgttgatatgttagttgttctagtaagacttacaagaactgtgaactggtatgaaaagtaggcagagatttgccttactagaattttgggagttagtataacagaattatctagaaatgtgaattgaaacggaactactcattagctgtcccaaatactttagccccaataatgtaaatatagcattgtctaataacagattgagcaaagctactaatgccttatataaaataactttgtagttgaaaaaatggatgatctcatttaatcctcacagcttcttccaagaacaagaagtcataaagtgacattggaagtttttttgaggcatttttgtgtagaattattattcaaatcagtacaaataagtatgttacaaaagaagatttttattttcttgatagagaaaataaaaaccaactcattgtatataatgcttatacttaaaagatgcctattatgttcattttaggggatcattttatcgggtgaaattataagatgctcaaaattagccattcgttctcagggtgggtacaatgaaattaacaccaagttgtcttgaaaactgtgtaccaaatctgtttgggtaaattattacatgatagggaaaagtacctgagatacattatattatttgaaactcagattatttttttgaaaacaggcatgatgattaatgtgtttactccttaaacataggatgataatgctgagttttaatgcatgtgcttaattaataaattaattgacgtcctgcatatcttcagaaactaagaaggcattctagtgtgcatatggcacagtacaataaattaaaccaaaattattttattttgttttattttctccatacattgccttcataatggctctgtcacttctacttattttgtcccttaatgatgttatggtcatatttcataagtggctgtccgctttcagttatacaatctttcattttaaagtccagtagaaaatatcaagctcaaaaatcaaataagtctatttttccttagcccatccttgctcctctggtttcttcttctcttttccctttcacattccccacacttgcagtgcagacatgagctgggaccctcattccctggctgaatggggagttgtatggtcttttatgctattttttgaactctgtaaactccaggattgagcactggggaggaatgcccatgaacatacgtttcattttatagaaatgagttccttcttatattgagggatgtccctaaggtttttatggttcagtctctttccatgtgaggaatctgaggagttggtggtctcaactcatttgatatacatattttccacaaagtggtacgtttgagtctgagtcaaactataatttgtttttaaatcaatgcactatacataggtgacaaagccctagaataaaatacagtaaattcaattttaagcgtatgtttcgtggtgtattctagtatgcatctctctgaggacctggagaatgacagatttttatagtatatctcttgttagtgattttctgagtgtaaggttattaattataatggcttctctagtttgttccacttggatcagtacccactccatctgaaataaagctgaagagctggatccccacagagatagggggtggtggtgaaattgggagagggatagaggaaactttgcaggtaatcattcattattatatttattcctctaacacatactaatattattccatttcacttgaaatgtagtaatttatatataggtctattagtccattctcaccctggtgtaaagaactgctgagactgggtaatgtataaaagaaagaggtttaattgactcacagttccacattcttacaatcatggcagagggggaagcaaacacgtccttcttcatgtgatggcaggaaggagaagtgctgagcaaagtgggcaaggccccttataaaaccatcagatctcctgagaactcactcactagaacagaagcatgggggtaagcacctccatgattcaattacctcccacagggtccctcccacaacatgtagggattatgggaactacaactcaagatgtgatttgggtgggcaaacagccaaaccatatcaataggtcacataattataataatatggaatgccaaaatgtgtatttagaaacactgattttttgcaatcagtaaatttgtgttggctgtattattatatgcatatcttattatacatattatgcatatatattatataaatatataaatatatatatttagagtctgatattctaaaataagaccctttccaataaaattacatcaatcaagcaatatgtcattcataaaatcagcaagtaagtcaccattgaatagcctatattccaagtttttgctttacataaaagctttgaagtatgtagcaaatgccactttttctgatgcttataagatgtaaaaatatagatgggtaaatagatattgatgtaaatataaaatatttctattttgctttattgtgtgttctttagcttctatttattttatatctgtatatctaattccatttgattcaatataaactttatgtcagttatattcctgccagggtcagattatgaaggtaagatttagttcctcctaaagggtcccacataatgcttttttaattgtcaaataagtgatgagtaaaataaaatctgatattttctgttatcaattttagtagtctgtagaattattaaatgtcatattatattacagaaatattttctttgcaggaggtgagtgggtgttggctaagagtgcattatttattcatttatttttgagatggagtcttgctctgttgcccaggctggagtgcagtggcgcaatctcagctcactgcaacctccacctcctgggttcaagcaattctctgcctcatcctcccgagtagctgggattacaggtgcccaccaccacacctggttaatttttgtatttttagtagagaccaggtttcagcatcttggccagtctggtcttgaactcctgaccttgtgatccgcctgcttcggcctcccaaagtgctgggattacaggtgtgagccaccacgcccagccaagagtgcatttttttaatgccctaactgtatgctcgaattgcctattgagtggaatgactatattgcccaaacccagttactttcaagagcggaaagaggagatattaatcattgtgccaggttgatagagacaaaatgagactgttctggatgaactgagatgtgagtgacctactgagaaatcttgccccagaatagggatttctttttctgcacctttccctggcactttaattaaactgccctacttacttcgtaccagataggttcgccacgccttcttgctttcttcatcttgtctttgcacctgcagtgttctcttccttctttatctgacaaaacccagctgcatgtaaagttgtaaaaacttcttcagaattccttccttgatgcttcactttcttgtgcctctgagcaaaagactgcctttcttctgcattgaggctgaatggaaaagtcactaaaagcctgctgagttttcctagatgctgggttctgtaaggacacattttcttcttgacaggataataatttgattatactgattatgtgttcttcatgcacaatccccattccagactgattgctctcagagttttattatagaaacgcctcaaggcatgcttcattttgtagcgagaaaatgcttcatgtgttttaagagacttggtttctgttttcagaagcaatattggtgacctctaatccacaagtttatgccttaaacaatgagcagggcttttgttgttgttgtttttctttccctacgtatccagatttgacaaaaatatcgctggctgaggataggaggagaatataagtggaggcatcgtgttagatactggtgggaatttgaaaaatgctcctgatccctgaatcaggtctagacaatacagctaaggaatcaaatacatttaatagtcaaaagcagagagaacataatgtactccctagttagaacctggggaaacaagttctgtccatgaaacaccaccataccctagcagcaagagaaaataaatggcagtattacataaacaacaaagaggattggagggaaccgccctcttccccagtctcttgcagctcaagagagctggtagagattaactgaatttcccaaacccctgaaaggggcaaagaagtagcccagagatgctaatgagcattaagcacctgggtggtcctgggtgctaggactgagttgccatgtgggattctcagtgggaacaagcagggatggttgtctctgtaggggagagatgacttcctgggtactgacactcttggtactcctccaccgcccccacctgtcacagctagaagagtaaaatactgaaatgactatttaaatttgcccggatagaatttaccagcatttgaataattcaatattgaaatagagattgaggttttttttaagtaacaaaactatattttttgtgcatcttgttgtaaaatgtacatcaagcagcttttcaagttgaaagagaaaggaaggatcaagaactcacaaaattgaggtacttataatttgccaggtctcatgcttggtatttgacatctattatctcatttattcttccaaataactcatttatttacagtattattcagagttcccacagcaagtgtggctttatttaagggcttgcatgcagacggtttattttgtaaagcgaaatcatcctcaggaacttgggagggccctaggaagaatgacctagggcagaaagaaagacaagtaaaaaggtgtctgtgcatctggtcattgtgggcagcagaggtttcacccattgaggagctaggtgattgtggaggaaattcttcagacttgtctgtccagggacccaaagaaggaagtatttcccatcagttaatgtttcctcattggtcgttggttgtgcagtcccttgcacatccaaatttgtgcatgtatcagaatcactgagctggttcccatagggtcacatgtaagagtggcaaaaaattcgttagctagaaaatcagatatatgctgggcattgaaagaaagatgctgcttggattacatttgaccacaactggttgccttacaggagccagaataaaattaggccaagaggatgtgaggtgtggcataaaagtcccaagatccaggccaagatttgcacatgtgtgaccaggatgatcgcatgggattctgtgatcagaagggttctgcaactgaggtttaatgctctgtgaaaagtcttatgagtgttatctttgagtttgtgttgttgtttttttaaattattattatactttaagttttagggtacatgtgcacaatgtgcaggttagttacatatgtatacatgtgccatgatggtgtgctgcacccattaactcctcatgtagcattaggtgtatctcctaatgctatccctcccccctccccccaccacacaacagtccccagagtgtgatgttccccttcctgtgtccatgtgttctcattgttcaattcccacctatgagtgagaacatgtggcgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctgttgtgaatagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcgagtttgtgttttataagtgaagtcagatggggtaatggagcccgcactgggatttggatcatctcctcacagtgagtctcacctctcacagcctccctatgttgttcttgcctgggttggtggctgcccagtctcttttctctggtgacctgattattaggctttatgcctcccttctgcatcctggggccactgccacctgctgccaggggcaataaccaggttgcattggtggatagagaagggaggatcatgttctattattgcagtttctcttagtgggggctgagcatgggcacaagaaagttcagggtcaagcccaattaacggtgtcatggggaggaggatgaggcaatgactgtcctctcccctgtgtcagcaccatggggaatttgacaggaggcttaatgagatcctcagaatactgacaatctagatattaagtacagctcagtgtggaagagattgccagtatttgggattcactcacctgtagtgtgttgggtcaataggaaagggacactgacttccccactgcgttaaccttgttttctagtttgtgtatctgatattttgacatcacggacattgttggctagaaagggatagcccctcccagggttaatggattctagagaaagcaaaatactctctgcctcttatacttaaactaaccaattccccaacccacatagtttatcccgctctcacactgggtaacaccagtttctctttccctaccttaattatctcagggccaggcataagacaaccagggacaacccctattccctggagcccactaaatttattcaaattagtcaatcctaaatctgtttctcctgcttaccctgttctcccattttttcccccgttaaaaaaaccacagtacaatctttcctacagtttttcttgctttctctctgcctgtgaccaaccaaccctggtgttctctcatgtgaccttgccagggctggcctggcatacccccttctcctggcaactatgcataataaactgtcttttcagggtcaggtgtctcctcgtctattgatctcaccatacctgatttaaaaaataaaatcccactggctggagccagtttgtgtttttattttggactacgacctgtggttagtagcaaattcttcattcaggaaacatgaatatagataggcttaagtttcttgcttaaagtcacctctattaagtgacaggactcacactctgtctaaccctgaggttttgttgtgcttataccattttgcctgcagtactgaggtatgtttacccaagaagaagttaaataatgtaagctgttcacaattaggtgagaatcctcctatttcataaatgaccttcagtaaaatgtaacattacgattttacctctggtgggatagtatattaccttgttctggtggctttgaatcgtatgtttgtactaacagaagaccgctgctcaacttgacatacatcacagcttttgagggattgaatgaacaggaacagttgatacagtttcctaattttatagacacaaaggtgtgtttttgagataataaaatatagtgcaaaagaattgtgagatacctgacagaacactttcctcagtgctacaaacatataaaaacatttcaaacaaaggaattgatcattaattagattattttgaatgttctgtaatgtatttgtttcatatcaaatgtatagtaataatttactctcaacttattagattaataccaacatttgaaatagtgactgctctcctccatgggcatgttcttcattgctctgttgggctaccctgatatacatatttctactgatcacatgggcttctcttcattttccacctatgtcgaattcattgataatgtattatccagcttcaaagattcaaatatcatcttccttctggtaatgcaccaatgtatcattccagccagaactgtttctgaacccttagttctaaatgggatttctactcactcatcatttcaatacccagtcaaatagcacaatttttgcatgtagaatattgaactcttcatgtttcctcccacccactataaagaaaaccttcactttcagaaattttccacaacttaataattggaagcacaattttttcagttgttcacctcacaattattggagccatctttgaatcatcttcttttttcactccccatattggatttactaataagctctcttagtttgacctttagaatatatatagaatctgacccttctcattatctcaagtccaaggtaccactctctctactctgtcaattgtttcccacatttctgcctttgtccctctttattctcaacaaaaatccaaagacttcctaaggaaaagcaaatgatgtcatctccctgcttcagatccatcccacacaaaaccaaagcaaagttcacattgggatccttctctgtttgccccttcttacctctggactttgtcttcttacacagccccctctggtatacccagcctagcctcctcccggctcctgggtacaccacttggggcttttgcctgttcctgtcctcagcctggttctctgtccccagatataaaaaaaaacccatctgtacctcttacagcacctaaattgatgccaaaggaaaaattaaagtccaatagttaatttatataaatattctctctgtccaatgggaggcaattactactactgaatatgcaagtttgtacagaaatgcatgaggcactgagaccttcacttgctaataatctaggtcctcaatgggaacacttaataacgttctgtaagatagtatactttgtttctgttaaaaatgatgaaataatgattttctttattattttagttatctcaactcatgcattcatgagatatagaataaaatcttagtcctacattcagatggaatgaacttttggttttcatcaaaatttactagacaaacttagaggtatttagagagacaattatgagtgaaaaagaaacaagtaatttaggaaacaatttcttcttttaaattgtatgctaagtataataaaagatgttcagaagaatattttcggttatgtgtatttaggttcactttttttcagtatctctttccgcaagaatcatgtttaatggtaattatcattattaagaagttaatttatttataaattatagtgggatgtttaagtaacttaagctaatgtaacactaatactgaaaaatattggtctaagtctttgaaaaaactttcaacttaaaaattcatgtacagaaccttgaagcataaatatactatgtaccttaaagtatattatatatttgagggacaagtcagaccaatataaaaatggtatttttttaaaaagtaaatgatatgaactaaaataaaactatctgcaagtatatggaaattcccaaaaagtgccataataggaaaaaaaaaaaagaagaagaagaaaagaaggcaatgagaaaaaataagggaagattatttagaagtgatgagtttgagataaacttggaaggatttggagatgtagaatgaaaataagaaaaggataaaacataagcaaatatgtgatcatcaaagtgatcacagctcatattagcaacactggatgcaatggacagagcaaagggtctggttgaggaatattaaaaaataaggctattcactgtttagtcatattctgagggttctcaattccaggaaaaaatgaatttaaattgccaatggttggaatcacttaaaattattcaatggatgaccataaacagattgctataaagttccagttaggagtaaaatgtgagaaatgcctaatcggatacatttattcttaagaatactcttaaacacacacacacacacacacacacacacacacacccaaagcaaacaagtaaattaataagacagaaagaaaccttaggaggtgatggatatgtttatggtgtgacaaagagtcaaacactgtaaagtatttgaagaggtttattctggaccaaatgtgaatgaccaatggcccaagacacagtctcagggcatcctgagaacatgtgcccaaggtggttgggctacagcatggttttatacattttagggaaacatggacatttatcaatatgtttaagatgtatattggtttggtccagaaaggcaggacaactggaaatggggggcttcctggtcctaagcagatttaaagattttgattggcaattgtttgaaagagttattatgtgaagacctggaatcaatagaaagaaatgtctgggttaggataatgagttgtggatacaggtttcataggcttcagagctcttatcagacctaaaaagttgctggacctagttaattctctcctagatcaggaaaaagacctggaaagggaaggagattctctacagaatgtgaattttccccacaagagacagcttttcagggttatttcagaatatgtcatagaaatatatttgggggtgaaatactttgattcctttcagggcctggtatttgtcatctgatgctatactagggtcagctggaatttggtgttttattgctaccaaaagtctgttttgtcagtcttaagatctctattttaatattaatgctacccaactgtgcctgaattccaaagggaggagagtataatgaggcacgtcccacccctacttcccatcatggcctgaactagtttttcaggttaactttggaatgcccttggctgaggtgagcatccatcggtcagttgtggggcttaaaattttatttgtggtttacaatggcgttgattttggtgatggtttttttgggtatatacttttctgtaaactcatcaaattgtacacattaaatacaagccactttttatacataattaatatctcaataaaatagtttttttttcatttttcatgctcagtttaaatttagctgtacacattacattttatcaggcaaccctagttgtatgctcattgtgctttaataggtctaatatattgtatactttttgaagtagcattaatagaaaaaagtaatatctaacaaatgagtttttctgcattttgtgatattgcaataatcttttgctttaatatttgcactgtttgtctttaataatttcattttagatcaaataaatgagttctagtgcaagaacattttccagtttggtaagaaccatggattgatatagtataacttaaaacaggaccaattaattttgaaatgttcatcaaactttatcttcactttctcacagcatagactttactaattgtataaatctgcttagttctgataaccagagattcctaatacaatacccatgaggaaaaaaactaaaacataatttctgagttcgtttatatgctcctgatctgcaattatattggcgctatcaagccacaacttgatttattatttaatttatcaaaaagtccctaaaatagtttatgacaaacctagacatccctttgcaggtctttttcctgatctgggagagaataactgggtccagcaactttttaggtctgataagagctctgaaggctgtgaaacctgtatccccaactcattatcttaacccagacatttctttctattgattccaggtctttaaataataactctttcaaacaattgtgaattaaaatctttaaatctgcttaggacctggaagcccccatttccagttgtcctgcctttctggaccaaaccaatatacatcttaaatgtactgataaatgtccatgcttccctaaaatgtactttgctttgagttaacattatcatatatcggcaatgaataagccaggagaattctgcagtgataatgtgaacttgctgcagattttgaattctcacaaacaaggaaatcaagtgactattatactaacctaaatatcataccacttaatattagatagatttttaggtatttgtcaatttatgctctttaaataaattggtcaagattttaaaaataatttctgacttgaaagtggttttctttaacagagaaaataacatttttcatgtagaatttttatttccctaatctaactgaggtataaaatgtagcactgagtctgaatttcttaagtttgcttaagagacacttagaggaatttggaaattgccttattaacatatattctgttgttgataccttagttaagctggtcagatattcagtttatatacttatttatcataaagaaagtcatgattcacaatgcagtgttatttaaaaacctgatcctgaatgctacttccctactagtctgatttatatttttttgttaacattctaccaagcaagacatatatatgactgtttctgagtatgtctgtgttatgtctgtgtctcaactactgtactatgtgtgttaaaggcattattttttaaatgattataacatccagtctgtgtcagctatttatcatcatttatactgaagaagttaagatgcaaataagtcaatttactagcctatggtcacgtctcttgtaagtggtaaattggcctcacacacacaaaatcacactgtttaaattgtatgctttccagttgtgactagtgacagaaatcattgcttcaacttttttttttttttttagtattcgtttattattttagagacagggtctctgtctgatgcccaagctggagtgcaatggcacaatcatggctcactgcagcctcaaagtcctgggctcaagtgatcctcctgcctcagccttggtcccaagtggctggattgcaggcatgcaccaccacacctcactaattttcttttcaagtttttgtggagatgggatctcactatgttgccctggcttgtctcaaactcctggcctcaagtgatccttctgcctcagccttccaaagtgttgggattacaatcgtgagtgatcttgcccaacctgcctcaagtttctaatttggaactattttattacttttagaaagaaaaaaaaatcgagtcagtgagtgtgttcatttgctagggctgccataacaaataccaaagagtgggtggccgaaacaacagaaatttattttctcgcagtgcttgaagctggaagtccaagatcaaggtcccgaagaagttttctcccgaaatttctctacttggcttgcagatttttatttttttttttgctgcctctttacatagaaaaacaaataccttctttttataacactcatcagattgaagtagggctcatgctagcagcctcattttaacttgataacctctttgaagactttatttttaaacccgttcacattcggaggtactggagatttagacttcaacatataacagtgatactttacaaatctttttatccattactgcaacattgaagccagagtaagtcaaggatatctaatattggaaagatgtgtaatccatcatcattagaaattagaatgcaaatttgtacatctgcccagtcttttatattctcttgatggaatattgctcataatttttcatcaaaacaggtagggtacactgtcatcttgggtgtataaaattttagggcagtacattataaacattagtaccataatcaactgtagaacttggaaaaacacagacacctagccctatcttcaaagttttagtaggtcttgaatcgagcctgggaatttgcatttccaatcagctctcagctgaagctgatgctgcttgccaaaatgtaagtagcacagttccaaagcatgcacgctgactcaagttactttttattgctctttcttttgagaaatgtgatgatttcacttaacgtgtttattgaaacaaagtagaagctctagataattattaggagaagtcttttgctgtgagcattcccttggctttaactaaccacatggaatttctctcaatagagaaaataataactgtcttttctgccattttcttccaaatccttccctttttctaaaaaccaccttgaaaatatcttaaatgagttattttgaaaaagatagtctttttccctttgtttcaagtctgactttccaaatatagtaacttcttaatctacataatagttgataagctcttatttgttttagtggcattaaatcaacatgcaattttatctgttgtagctaaaaagggtaataattattaaaccattactactggaaaacatattgcattttgaggatcaagcacagctgggagcttctcaccacctcaagcaccagctgctccattttctgtcatttgttcagaattatttacacacatggatgagtgagcagagggatggggaggtgccaaacagtctttttattccaaatttgttgattttttatagataataaaaatgtattgcttaaaacaagaaaaaaaataaaataaaatgtacacagagaaaaggctccttcctatccaatgcactctccctgattttcatccacccccaaatcaaagatactataaatttatcatatattcttttgaaaatggttatgcataaagaaggagatataaatggctattttatctcatttaaaaatagtagcccactagatgggccttgcagtctttcccagctctgaaagtctgtgaatcattggtacccgaaaggtgattcattttaaatcatcttcttataaacacataggaaacagaagagcaggggaacaagatgaaagagagataagaaataaagttcggggaacaatgcagagattcaatgaatggtacgttcagtcctaggacacacctagtcaatatcggttattacttagccataaaaaagaatgaaatcttgtcatttgcaacagcatgagtgggactggaggacctggaggacattatgttagttgtaatagccaggcatagacagacaaatattcatgttctcatttatttagggaactagaaaaaaaaaaacaaaactgaactcatggagatagggagtagcatgatggttatcagaggctggaaaggatagtggggggagggggataaagggggaatggttaatggatacaaaaatacagttagatagaatgaatacgatctagtattaagtagcacattagggtgctaaaaaaattaaaaagttaaaataaataaataaaaatagtagcctactatacactcctaggaaacttgttatctttaaacaatgtcttggagctcattccatattcataaggagctgcctagtattctattacatggacccactgtaatcctttttactagtcgtctgtaaatgttaacaggtgaacttttatggtaccataacatttccattttacatagtgctaagtattacattaatagctacatatgtcattttccatgagtatgattaaatattataaaaattgttcttcatgagacatgaaaagaacatgctgaccaccttttattcttgttttctactgaaattatatattttagcaatctgtagatcagattcctagaagtagaatttattagtcatcaaatataaagtttgaaattttgatagaaatagacagatttccctcaaaatgattggcctgttgtatataactataagccccgtgtaagggttcacacctctggtcacagtcttgccaaatcagatatcagacctttagattttttataatctgttgagtgagaaatggaatgccaaaattatcctaacatccatgtctcatgagtaaggttgatggtattcatgaatatgtttaaaagcccttccaaaattatcctaatgtccatgtctcatgagtaaagttgatggtatttgtgatatgtttaaaagccctgcatgtcttctctgtgagttgttgggtggacactgccagattttgtagggtggcattcttcagcactttgcctactttgcttatcacatttgtgccacgtagacattttccgtttttatgaagtggtttttaacaatcttttcttttatgatttcataggctaaaaaaggagttctcccacgatccaccctcatatatttatagttgtccagatcagttggtttacacaatgtaagcattttctgtcttgtcagagagagattgctttcagtgaagctgctgtgtttgtgttattgtgggtgcaatcttgcctcctctggtgaacgatactagctaggtccagaaaggtttgcagcaaaacttatatctcctccactcacctaatttccaactgcacacaggtttcagacctgagcatgcactctcacctttagaaagtgtatttttgctgtgatttactcctaataacttcagttgcttctgaagtccctttcagtggtttcttgccctcattttgttccatgtggcacaataaaaactactgtggttaatttctgtagcttttggaagcccttacatgtaacttagattgtaagaatacgtctcattatggactgagtgtttgtgttttccacaaatgtatatgcccaaggctgaacccccagggtggctgtacttggaatgggggcctctaagcaagtaattatggttaaatgaagtcataagatcagtctgctctaatagcattggtgtccttaatagagatacagcagagagcttcctctgtctctgcccgagaacatacattgaggaaaggccatgtggggcatagggaacaagtggccatctgcaagcaaggaagagagaccttatcagaaatcaagtcagccagaaccttgatatgggacttttagtctccagaacagtgagaaaatacatttctgttatttaagccacctacactatggtgttttgttatgacatccccaaaagactaatgcacatgcctctcacagttttactggaggaggcattgcaagtattttttttattctttatttttcacaatcttgtactcattgctttttagtaaaattcagtgggatatggaagtaatgctgatgtacacatccaatttcataccagatgtttctgggataattccatttataagtgcagttttcaatactcctgaaggccaccggttgctctggattatataggaagaatacatgtgttctgtttggccaaatggattcctagaaaccagtattcgaattctcacttttaaaaatcagttattggaggatgtgtaggtagagtatgggttttcgtaaaagtgaacaggacaactcaataagttttcagtgagaaaataaaaagggaatatttgcagcctccctaatttatcaccaaaacagtgacatcatggtatgccatggcttatactatccagataatgaaaagtagagaatatttagtaagagtttcaataaagctattgaactttagaaacctaagaaggactttagaaacctcatgactttctctttggatgtacatgcacacatataaatcctcatggcccagacctacaagcgaatgcttcacaaatgtctgggtgccctccccaaaagtaaacaatgagaacggttactgtttactgatgatgctaataataatattattactaagtacacttcagagactgatgcaggctaggctcttggagatatctcatgtaacaatttagttattcatactgagcagttgtcattatgctcttttccagcatgagaactcaagagtctggcagaagtttgacttgcttaggtaacaccagtcaactaataatgagtggtgaaccaaaactgaaacagaaatcagcttgaccccaaagtcctggttactacctggttaatctaccacctggtcaatccagatagtctctccaggaaggacaaattgtgtaatgaataatttttcttctattttggtaatttatgaagttgacatgatacaagtgagatattgcaaataatccattttattcctatttgaccttttctgagatgcatttaattatccacgtacacaaaacaatgctattagaaacacattctatacatacatttcctttgtttcttgtgtaacatagaaaactctattttatcagctaatgaactaaaaggctggctttctctggagtttaaacacacagattttaagttaatcttttgaaccaaaagagattattgtctacttgacactatatacgcttttcaaggggaatatatatatacacacacacacacacatacacacacacatatatattccccagtaagatattgaatattaaattattttacattcatacaatatgtggtatgtggtagtaaaaaataagttaagtatacaagagacataaaatgcatttataattgtggcaaaaaactgttagatagtattaatatgactcagtgtaaagaatgatcagtttagttttcttctttcatttactctgcttgttgatacaactgttaattattttatttatttacctccaggactatatatgcatattcatttggaaggtagaagggaagaagggaattttgggttttttgggtttgttttttttttggcttttctttttatattcaattttattgttatttattttttattttattacataaactggtaaattttttataataagagcaaataatagaaacataataataaatattttaagaacaaaaatatagacctagagaatatacttttaagtctctggaaaagccgatataaaaaccttctaaatattcccgacaaagttatatcagctggaaagcctttatttttataggaccacagtgcagcagttatattaacaacatggcaaattccccgtgtaaatggatcttcaaattatctaataatactctcgaggacattatactgttttgttgtttttgtgagtcttattattacttttcactaatattcaacaaagttataccttaatacccaataaaaattcattggaatatccaccaggacctttttgcaaccaggtgatatattcagtcttttgaatgactatgttatgcaaatatgttgccttatttgttccctaattgttaaaagctataaagtagcataaacaggatgatgtaagaactggatatatgtacagcacgttgcaaataaaatctcaatgagttctcagatagtaaaagtaaaaacctgttacttttctaagccacctcagaaaattagtttatgtatatcattctattaatatctcaaaatttagtaacaccttaaacaattagggttaattttccttttatagctctgggagactgaaagcaaaatagatgactaaggtcctctacaatctccctactttctttctgtttgccacagatcaatttatcaaaatacaatttatcggtcatataagaaacttcactatatggaagttgttcctagagtttatcctagtttgcaaggacaggagaatcagactcatttaaactgtaagcttcttatctcattgaggctattagaagacatttgaatatgcatgactttgatttttctaagctggtggaaagataatgataatgtggtagaaataaaaatcacatctaccctaaacattatttgtagttgattgtaatcatgcatacatttactttataattttaagattgtatactagttttaataaaaggtattaaatttcgtgcctcatttttatctttacattttacgaatgggacaaaaagtgccatgtaataaaaataaatatgagtcgaatgctgaaatggtgtatctatataacaaaaatattacatacattttaaggacttattattaatcaggaagatttatcagtcttttatcttctttcacttcatataattctatctatgacttaaatactgttgtcatattcattcagcactcagggaactgaaattttttgatattaacttatgtctcaaaggccatgacacaaggttacaaaagcatcatgattcaaatccatgtcaatttaaatcctgtgttagaaaaagatgctggactaagacagaactgtactcaaatttcatctgagacaaatgacttcaatgctatatcttagtatcttcaactcaaaaatggtcataaaacaactgtaataagataatggttttaagcatctagtggagtatatggaatatagagtgcctctgtgtgtgtgtgtgtatgcgtgtatatatatgttcatatatatatatatgtttatatatatgcgtgtatatatatgtttatatatatgcgtgtatatatatatgtttatatatatatgcgtgtatatatatatgtttatatatatatgcgtgtatatatatatgtttatatatatatgcgtgtatatatatgtttatatatatatgcgtgtatatatatgtttatatatatatgtttgaaatgctaatttgtatacttcattggtacataaatattaacaaattcaacacaaagcgtacatttatggcatctgggtattgtatgaataaatatattgatttaattggtggttcaattctttcctccttaaaacacattgttctctaggcttctatgctaccccatctttccgaaccccattcactgcacatttcttctttttatttatagcctcctgatcctctactattaactctagatgtttaatgcccagaactgtgccctatgccctatactcttctctacgttaatctctgccaacatgatcttgttactccatgaatttaactttgcaaggtatcctgctgactctcatgccaataccttcagtcctgaccattccactgagctgagactagtttaattggctgcaagctccacatttcctttcaaatccattatgaatagcaaacatttactaaatttgaagacagagctatttatttgtaaatagtagatttatttgttacttcctaccttttctgagactttgtgagttgtattcttcttttaatccatctatcataaaatttaacacatagccttagcttttatataggctatattatatacatatatatgtgtgtgtgtgtatatatacacatatatataatatagcccatataaaatgtatatatacacattatatacatatatgtatataatatagcctatataaaatgctatatatagcattttatatgctatcatctatatatatagcattttatatgatatatatgtatagcattttatatgctatcatctttgtcttcactaccatcatttctcacctgcacttctgcagtagtcctcaaaccagtcctacattacctcttttaatcttcttggtgccctatattgcattctcctcatggaagctagaatgacttttaaaatcattttatgttatacacttctcaacccactgcagtgtcttcctatttcaattagcatgaaatccattatcctgagttatattaacaatatggtagaatagaaagccccaggctcttcttacatcccatggagacattatttcaacaatacatggaccaattctctttcagataaatttagaaactgattaagaggctcctcctccatatcaggtgagtgtgaaactaactgaatctaagctgataggaaagtgtggcaccctctcatcataatacctcgccctggtaaagcatcatgtggtctgtaggaaactgtaacctcctggtttcacacctattaaggaaggagagatattggaccatgtgtccaacattctagcttgtcatggaagctacctgagagactgatttttgtctcacttgtttcagagcactgatggaattggatgtactcttcatgcctaatggctcatgagaaaattaaataaccaggcagtttcctgcctgctccagaagacttgtgccacagaagacagaggctgatacaactcagtggcctctgcctcaagggataaagagaagagtaaagagtatgtcaaatattctacccttatcaaggggctgcctaagggtctgccttttgtatagcccagtgaaagcactgatgggcccaccataatctggatgcatgggagccaatgagaacaaaagagagtcaagcattgtgctggttcttcagcggatgtgcggtacaccatatagacaccagaaagagcaagaaattatgagatctcaaaaaagggaaatcagaagattcctctaattaggaatatacacacataagtcaaaagacatgtctacagagaaagtttgagtgatctgcggaatcttagtttagttggagaaagtctttctctgtaggaaaccattttgtaaagactggaagaggtggctgactttcaaatacgcagataccaacacaaaggtaaaaggaaaatgaacaaacaggaaaacagggctcaatcaaaagaggcatataaatctctagatactaaccctaaaaatggaagtatatgaaatatataacaaagaattcaaaataaccatcttaaaaatgtcaagaagctcagtaaaacaatgcataaacaaaataagaatatcaacaaagagattaaatatataaaaagaagcaagagtttgggatctgaataatacaactaaactgaaaattttagtgcaaaagttctatagcagatttgaacaagaatgaagaatcagataacttaaagacaggccatttgaaattattcagtctatggagagaatataaaacactgaaggaaaaaaatatggaacaacatcaagtagatcagtatgcacattgtgagattccaataaaaataagaaattgagaaaagatcaatgagtttacttaaagaaatgatggcagaaaacttccaaaacattggaaagggaatagctataatagatgcaagtagcccaatgaatttgaaatagtttaaacacaaaacttgctaagatacattacaatcaaactactaaaagtcaaagataagagaatttggaaagaaacaaaagaaaagtgactcatcacatgaaagagaacttccacaagactatgaacagatttctaagcagaaatcataaaggccagaagtgacaggataatatattaaaagtgctaaaggtaaaagaaaaagaaaaaaaatcttgccgacaaaaaatattatatccagcaagtctgaccttcaaaagtaaagagatgaagattttcatagactaaatactgagggagttcattaccacaagacctgtcttacaaaagattccaaaaggagtcttttatttgaagtgaaaacatgctaaacagcaatttgaaaatatatgaaagtacagctacccctcagtatatatggaagttcagtttcaggacccctgtttataccaaaatctgcatgtaatcaagtccagcagttggtcatgtggaacccacatatatgaaagatggccctccctatatatgggtttcacatcccctgaatattttagctccacaatgggctgaaaaacgtccactaataaatagaactttatagttaaaaatctatgctgttcaagggtcaactgtattaagcttgatagtaaaggtaaatatataggcaaaaacagaatgctggaatgatgtaacagtgttgtgtaaatcactttaaattctggtatgaaggtaaaagacaaaagtataaaaataacaaatatattaattggtacacaacataaaaatgtatttgtgacatcagtaacataaagcatgttagtgtgggtgaagtaaaagtgtagagtttttatatttaattgaatataatttgttatcagcttaaaatagattgttataactataagaaggtttctgtaagtcccattgtatgcacaaaaaatgatactgtggaagacacatgaataaaaaggagaaagaagtcaaagaatgtaattaaaagaaatttaaaaaaacacaaagcaaggtagcaagagaggaaaacagggataaaaatagctacaagatagacagaaaacaataacaaaatggcaatagaaatttcttccctctcaattattactttaaatataaatggattaaatttccaaatcaaaaaatagtggctgaatgaataaaaataagctcacattatatgctttctacaatagactcactttagatttctggacacaaatcagttgagagagaaaggataatacatatatatatattccatgcaaatgttaagcgaaagagagcaaaggaaagctatacttatatcatacacaatattctttcagttaaaaactgtaggaagagacaaataagggcattatataattataaatgtattaactcagcagaaaaaaaacaattataaatatatatgcacccaacatcagagcacctagatatataaaacaaatattgacagaactgaatagagaataatacaataatagtagaaattgtcaatactaaactttcaataatgtgtagaacatgcagacagaaaatcaataaagaaacagagaacttgaacaacactatgaaccaaatggctttaacagacatatatggaacattacacccaactgcatcaaaacacacattcttctctagtagaaatgaaccattttccaggatagatcacgtgttgggccacaaaacaagtctacaaattcaagaagtgtaaaatgatagctggtgtcttttccaaatacaatggaagttaggtagaaataaatagcgaaataaaaacagaacatttgtaaatatgtagaaattaaactgcacattcttgaacaaccaatgggtcaaagaaaaaagtcaagagaaattaggaaatatcctggggtcaaccaacaaggaaacagaatcatttatgtttatttgttatttttttttaattctttgaattattccatgaactggatacaaagaaactatcttaacaactataatttggatatatattttttaaaagaagctgaaaatgtttaagagacaatattcattaacatcttggtaatatttaacactgtgcatgtcttcttagtaagggctagtggtttttattcatgtaatgtacagtatatgtataattttaaaatgtttcaaacaccagaagtcaattctgggcataaaaagcaacaaataaatttgtttgaactgtgttggatagccattgaattgatgagggtgtttacaaatcaggtttagggagaagtaggaaacaatggaatttagacagctagaaattatatcaagtacttgccactagaacaacatagctagaacccttttaatttatgccactggattctgtctgtcatatctgcagagctcaccatcactatacttgggtcttgaaataattgccactgctgtggaaaatttctcaactgttcctacatctttccatcatttgagcatatcatttatgtgcctctgtcactgatgaaatttctgatgaaaggatatagaaagaaagtatttggttcctgtattagtccattttcacactgctataaagaaacactctcaagactgggtaatttatagaagagagagatttaattgactcacagttccgcaaagctaaggaggcctcaggaaacttacaatattggtggaaggagaaacaaacatgccctttttcacaagtctacaggagagagaattgcagaacaaaggggaaagagccccttataaaatcatcagatctcatgacaactcattatcatgagaagagcatgggggactagtccccaggatctagtcaccttctatgaggtccctcccccaaaatggggatagcaattcggattagaattcaagatgagatttgggtgaggacacagagccagaccatattattccactcctgaccccttgcaaatcttgtctttttcacatttcaaagcacgattgtaccttccctacagtccctgaaaaatcttaattcttcccagaattaactcaaatgtccaagtccaaagtctcatctgagacaaggcaagtcactcccacctaggagcctataaaatcaaaagcaagttagttctttcatagatacaatggggatagagtcattggataaatgctccctgaaatgggaatagttttgaataagaatcaatctttgaattcttctccaatgggagaaattggccaaaacaaaggggctacaggccccatgcaggtccaaaatctagcgggacagtcattaaatcttaaagctccaaaataatttccttttactccatgtctcacatgcagggcacacagatgcaaaggttgggctcccatggcctagggtagctccactcctgtggctttttaggatacaagcccctgctctggctgctttcacagctggcattgagtgtctttagcttttttgatgcacagtgcaagctgttggtggatctacaattctggtttctggaagacggtggctgtcatctcacagcttcactaggcagtgccccagtgggaactctatgtcgggggtccgacctcacatttcccttctgcactgctctaacagagtttctccatgagggctccacccctgcaataaacttctgctagccatccaggtgttcctatacatcctctgaaatctaggtggagtttcccaaacctcaattcttcacttctgtgcacccgcaagcccaacaccatgtagaagccacctggtgcttccaagcacttggtggaaggctcggtgcttgcaccctctgaagcaacaagctgagctgtaccgtggtctcttttacccatggctgagacgcagggtaccaagtctcaagactgcacaaagcagcaaggcactgggcctggcccaggaaaccatttttttcccgcctaggactctgggccttagatgggaggggatgccatgaaggtctctgacatgccctggagacattttctccattgtcttggtgaattacatttggcttcttgttacttatgcaaatttctcaagctggcttcaatttctttccataaaattagtttttcttttctatcacacgatcaggctgaaaattttccaaacttttatgctgtgcttcccttttaaacataagttccaatgccagaccttctctctcaagttcaaagttccacagatctctagtacacggacaaaatggcaccagtctctttgctgaaacatagcaagagtgaccttttctccagttcctaaaaaattcctcatgtctatctgagactgcctcagcctggacttcgttgtccacatcattatccattatcagtgtttgggtcaaaaccgttcaacaagtgtctaggaagttccaaattttcccacatcttcctattttcttctgagccctccaaactgttcctacttcttcctgttatctagttccaaagtcacttccacatttttgggtatctttataacagcaccccactctactggtaaaatgtattgtattattttattttcatgctgctataaagaaatacccaagcctgggaaatttataaagcaaagaggtttaattgacttacagttccacatggctggggaggcctcaggaaacttacagtcatggcaaaatgggaagcaaacatgttctttttcacaaggcatcaggagagagaagtgcagagtgaagggagaagagccccttataaaaccgtcagatcttgtgataacttactcactatcaagagaacagcatgggggagcagcccccatgatccaatcacctcccatgaggtccctttcccaaaatggggattacaattcagattacaaatcaagatgagagataggtggggacacagagccagaccatattggtgcctaagtgactagtggtgaaagtcagggctcggtttatcagaattcacatattggaatgttccatgaaagcagaagggtctttgaacactgctcagtcataaaatggaaaatgtctaccacatatttctattgtattggtctcaatcactggtttgttttcttattatttgcatttcaattttttctaacttatgcagagatggatttcttgcagtaatgcagaaaaattttatatttgaagttatgtcctcttattatatagtaaataaaattatctccataagcgctgtagtgatgtttacatttgttcttttattccatagcacagtatatatctattttcataattgtcataattgagattcgcaaacatataaagcatatgtagatcaaaatgcatttatatatttttggaatgactcacaatcagtattgtaaagaaaacactcattttacatatctgtaatgcattgcaaaagccactttcttcaccttgtactcataaattaagctttgttaaacaacttagcatgaagggcaaagatgttaattttatttgaaaatcacaccaaatggtgtgaaagtattaaaataacaacaccttctatgtcttcaacaacttggcttctaagaagaaaagctagataaagtttcctttttttttttttgaaattcatgatttgaaaattaagaatctcttgggaaataaaaagtttaatataaatttattaaaataatttattacaaatgctggaaagaatattaaatacagttattccagtcacaaattttaataaatgagggcagtgagactgaaaaacatgagatggttcacataaattaatatagtaagtaaactatcaaaaaataaaacctgtgatttctgactctctttccaatgctcttgccattttgaagctagaatagtattgctctctcttatattttaggagagttttgaagttgttttgatttaaatcagagggaaggatacctttgctttcagaaaatatttgaaaacataaattttatatttgtcaaatgataaaagtgaaattccaattactctaatcctacacaattgttgcacaatggtgaagtaagcactattactaaccctcatttaaggagcgaaatactcagagaaaaatgccgtgctcttgaatctaatgtgacttttttccttcgtgaccaaatctgtgtagcatctttcctcaactgtgtaagagaatcatgctgtaaccaattatttgtattcagtattataaattaattatactgtcatgtcaatttgttatttattcagatctacatttcagtttgtgctgatttgcagggatgaattgcattcaatgagaaagtgatttatttagtactttttattaaatgaaatagccatattcgtgaatcaatgtaatcttcctaaacatatattcaagcacacatatataatactacagcaaaacttgatgcaaaatttatattctttaaataagcttataatttcagtcattctttttattttattgtattttttgagacagagtttcattcttgttgcccaggctggagtacaatggcatgatctctgctcactgcaacacccatctcctgggttcaagcgattctcctgcctcagtctctcgagtagctgggattacaggcgtgcaccaccatgcccacctagttttgtatttttagtagtgatgggatttcaccatgttggacaggctggcctcaaactcctgacctcaagtgatctgcctgcctcagccttccaaaatgcttggattacagtcgtgagctactgcacccagcccaaatttcagtcattcttttctctcccatatcctgtcattagtttttcagaaatgtttttcgtgttttactttgttgcccaatcatagtataacctacactcatgtcttcaacgtgttgtttttttttttttctttttttttttttgagacggagtcccactctgtctcccaggctggagtgcagtggtgcgatctcagatctaggcttactgcaagctccacctcccgggttcacgccattttcctgccttagcctcctgagtagctgggactacaggtgaccgccaccaagcccggctcatttttttttttatttttttatttttactagagacgggtttcactgtactagccagaatggtcttgatctccttgccttgtgatctgcccacctcgacctcccaaagtgccgggattacaggcgtgagccaccccacccggccttcaacttcttttaattttaaaaatcaaaacatttttcctctgtttatttaccgctatttttttctttctttaatcctgtctttagataattgctagaattatgtgtactagaaatcaagcctagtaatgtaattcccaaacttgaaaatctgccttgtctgtgtgtgaagttcatacccggggtagatatgcaggacctatcaaaatttacacaatctataattcagccaattgacattgtcactcacacccaactttaccaatctgttccccaaacctggagtaattttaagttgcattctttttgttttcagccacctttttctttgatcttttattttcttccactttacttactgagcactttaagtacctatttgattgctgttatggtctgtgacaatttttcagcccttgggatattttgtcaaaatttgatgagtcttatacagtaggtaattcatgtgtagtatatataacaaatttgtattatgtctaacaaaaacaagaattatacatatatttgtcattgagaattaatggtacagacaggaaggttcatgtaaaaatgcatgtagacatataggtgtataggtttgtggatgtgtcctagagattttgcatatgttctttgcctatcaatatcacattgcaaaatagtatcatttgtattcagagcaaatagttaaaaaaaccgtgttttgtaacacatataattttctctttccattaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaaggtaagattttgtttattttgctgttttttctatcctgagaaattgtggggtaagatgagctcatgttggagaaatatttgaagagatagacaaatgaagcaaattatgttgtagagtgaattacgctatagaaactactacttatactagagagctcaaaataattattgtaaaaagaaaacattattcatcatattatacctctctaaacattggcccatatgtacaagactgcatattcataacaagcatattactttttctgttctctcttgtaagttggaaacacttaatggaacacacaattaagtaattttttctttattaccttgaaggtatattggaattcacatgtcacttattcgcacactgacatttactgctattttcacatattgctcctgcacatgtggctaaaaagaaggcactctatcatgaaaacatcacacatattttctaatatcataattaaatattagaaaatatctaatattctctattaatttttagagatgtacttttagcctttaaaatcatatgaatatttttcaaaacccaaagttaattttcataaaaacattgaaatcttttaatatagattaagtatgcactggatatacaggctttgaaaaaaaatcacaatagaatgaagttaacaaaatgatcagttatttcaggtcaagttccctttctctcaaaaatgcagacacgaaaacttaatggctgatcaaactgttcaggaaattttgtggtcagtaacatgggagagtttaagcatgtgtcatctaggctctaggattgagaacgaagtgggaattggagaggccttcttctgattaattactggtttttggaagtagccacacttcagtttgttcaaaacctatgggagaaacagcaagcacagcagtagaatatccgtgactgcaggctcagtggcttctatcccccgattgatgatttattctcactttagcactgttagtactaaaaaaaatagtattccatctaagccgtggcgcttccctaatgtgtaggcagtacaggatcacaagccatctgttccaccccttgtccaacagggactgggttacagctgcattttctatacaaggcaggagctgtggagtcagaatatagaacataaaaaaagatctaaaacaattgtatcatattctcatatgcatattaaaatgagacagaagaactatcttcattgtatgcttttttccctaccaagtatttcataaaataaatttttaaaaatgtaataacatcaaagcataatatattagattagtagaaatttacctgggttatgaacttcaaaatccttttttttttaaaaaaattatacctttaagttctgggatacatgtgcagaatatgcaggtttgttgcataggtatacacgtgccatggtggtttgctgcacccatcaacccgtcatctacattagatatttctcctaatgctattcctcccctagcccccaaccccagacaggccctggtgtgtgttttttcccactctgtgtccatgtgttctcattgttcaacccccacttatgagtgagaacatgtggtgtttggttttctgtttctgtgttagtttgctgcgaatgatggtttccagcttcatccatgtccttgcaaaggacatgaactcatccttttttatggctgcatagtattccctggtataaatgtgtcacattttatttatccagtttatcattgatgggcatttgggatggttccaagtctttgctattgtgaacagtgctacaataaacataggtgtgcaagtgtctttatagtagaatgatttataatcctttgggtatatacccagtaatgggattgctgggtcaaatggtatttctgatcctttaggaatcaccttacaccttatacaaaaattaactcaagatggattaaagacttaaatctaagacctataaccataaaaaccctggaagaaaagctatgcaataatattcaggatgtaggcgtgggcaaagacttcatgactaaaacacaaaaagcaatggcaataaaagccaaaattgacaaatgaaatctaattaaagtaaagagcctctgcacagcaaaagaagctatcatcagagtgaacaggcaacctaaagaatgggagaaaatgtttgccatctatccatctggcaaagggttaatatccagaatctacaaagaacttaaacaaatttgccagaaaaaaacaaacacccccttcaaaaagtaggcaaaggatatgaacagacacttctcaaaagaagaaatttatgcagccaacaaacatatgaagaaaagtacatcatcactggacattagagaaatgcaaataaaaaacacagtgaaataccatctaatgccaggtagaatggcggtcattaaaaagtcaggaaacaacagatgctggagaggatgtggagaaataggaacacttttccactgttggtgggagtgtaaattagttcaatcaaaatcctttttctgtatcctttccatccttgaaattagcacaagaaaagaatcattaaaattgccctttttggaataaaccaagaggaaaactattttattattaaaaatattttatgatgcatatttcttaaaattttaatctaactaagaaacagaaacaaaattttctggaaaagggagggaaattcagacaacttgtttttcaggctcgcctagttttggtaaaagatgaagcctcaataggaagatcagttctaaacaatctttctggaattgaatgaacatatggtgccaatgaacatatggttgagagctcctcacatatcaggaggcgatggaggtttgtgatgctgttcaggtttgtggcggttctgtgaaactgttgtctattctgttgtctgtagtatggatggacaaatgcacaggtataaaaggtcaaacatgaaagtgtgtcctcttattcctcatctgacccagggacacctcgctcatagtctttctactttattctaatttgcctttatgggcaattctaacttaattgtacagattttttttctcccacacaccccctgtaacataaatgcttaactaaaaattaaaaactaaaaactgcaaagctcagcaattactatatgcttaaaataattcccttctgtgccattattttaacttgcttagaaaattaatttaacctcacatttataaatacattcatagtgaaccaattattttcatagtactcttttttttctttatttcttctaaaaaaatacagagaaacaaacaaacaaaaaaaagggatacatgtgcaaaacgtgcagggttgtgccatggtggtttgctgcacctattgacctgtcttctaagttccctccccaccccccaacaggccctggtgtgtgttttttccctctctgtgtccatgtgttctcaatgttcaactcccacttatgagtgagaacgtggtatttggttttctgttcctgtgttagtttgctgaggatgatggctttcagcttcatccatgtccctgcaaaggacatgatctcattcctttttatggctgcatactactccatggtgtatatgtaccacattttcttaatttagtctattattgataggcatttgggttggttccatgtctttgctattgtaaatagtgctgcaattaacatacatgtgcatgtgtctttatactagaatgatttatagtcctttgggtatatatccagtaatgagattgctgggtcaactggtatttctaattctagatccttgaggaattcccacactgttttccacaatggttgaaccaatttacattcccatcgacagtgtaaatgtgttcctatttctctggggccttgccagcatctactgcaatcaaattagaactcagaatttaaaaactcactcaaaatcatgcaatttcaatttcatgcaacctgctcctgaatgactcctgggtaaataatgaaattaaggcagaaatcaagaagttatttgaaaccaatgagaaccatgagacaacacaccagaatctctgggacacagctaaagcagtgttaagagggaaatttatagcactaaattcacatatcagaaagctagaaaggtctcaaatcgacaccttaacatcacaatttaaagaactaaagaggcaagaacaaactaatccagaagctagcagaagacaagaaataactaagatcagagaagaactgaaggagataggggcatgaaaaccctccaaaaaatcagtgaatccaggagctgttttttttgaaaaaaattaacaaaataaatggactgttagctagactaataaagaagagagagaagaatcaaatagatataataaaaaatgataaaggagatatcaccactgtccccacagaaatacaaactaccatcagagaatactataaacacctccatgcaagtaaactagaaaatctaaaagaaatggataaattcctggatgtatacaccctactacgactaagccaggaataagttaagtccctgaatagaccaaaaacaagttctgaaattgagtcagtaactaatagcctaccaataaaaaaaaaaaaaaatcccaggaccagatagattcacagctgaattctaccagaaatataaaaaggggctggtaccattccttctgaaactattccaaacaattgaaaagaagggactcctccctaactcattttatgaagccggcatcatcctgataccaaaaccaggaagagacacaacaacaaaaaaatcttcaggccgatatccctgatgaacatcaatgagaaaatcctcagtaaaatactgagaaacaatccagcagcacatcaaaaaacttactcacccaaatcaagttagcttcatccctgggattcaaggctggttcaacatatgcaaatcaataaatgtaatccatcacataaacagaaccaaagagaaacaccacatgattatctcaatagatggagaaaaggcctttgataaaatttaacatccgttcatgttaaaaactctcaataaactaggtattgatggaacatatatcaaaataataagagctattcatgacaaacccacatccaatatcatattgaatgagcaaaagctggaagtatttcctttgaaaactaatacaagacaacgatgccctctctcaccactcctattcaaaatagtattggaagttctggccagggcaatcaggcaagagaaagaaataaaaggtattcagataggaagagtggaactgaagttgtctctgtttgcagatgacatgattttacatttagaaaaccccatcatctaagcccaaaatttccttaagctggtaagcaacttcagcaaactctcaggatacaaaatcgatatgcaaacatcacaagcattcctttacaccaacaataggcaaggagagagccatgaatgaactcccattcatgattgctccaaagggaataaaatacctaggtatacagctaacaagggatgtgaaggacctctttaaggagaactaaaaaccactgctcaagaaaataagagaggacacaaacaaatgaaaaaacattccatcctcatggataggaagaatcaatatcatgaaaatcgccatattgcccaaagtaatttgtagattcaatgctattcccatcaaactaccattgacattcttcacaaaattagaaaaaaactattttaaattgcatatgaaatcaaagaagaccccatatagccaagagaatcctaagcaaaaagaacaaagctagaggcatcacattacctgacttcaaagtatactacaaacctatagtaaccaaaacagcagggtgctggtaccaaaacatatagagcaacggagcagaacagagacctcagaaataacaccacacatctgcaaccatctgatcttcgacaaatctgacaaaaacaagcaatagggaaaatatctcctatacagtaaatgatgctgggaaaactggccagacatatgcaggaaactgaaaccggaccccttccttacaccttatacgaacattaactcaagatggactaaagagttaaatataaaaccttaaaccataaaaatcttagaagaaaacctaagcaataccatataggacataggcgtgtgctaagacttcatgacaaaaacgccaaaagaaatttcatagcagtcttgtataaaaagtagaattattgtgatcactgtaaacgtgagaagggataactccaaaaagctgagaagtatcttttctattcctccctgtcacagaaatgccagcaaacattttgtcaacagacctaaaataatgctcataaaatgcagttctggtattaaaagaatgtttttttaatagatgaattaggtaagattattccaaattatctttgaactcgattgaaatttttgtatctatagttatattttacgttataaaataatattaagtagacttgaaaaaatttctacctttattttagattcaaagggcacatgtgcatttttgttacatgtatatattgtgcgatgctgaggtttggggtgtgatcaaacccattacccaggtagtaagcacagtaatcaataggtagtttttcaacccttcctcccctttctacttcacccccgcttgtagtcccctgtctaatgttcatatctttatatccatgaataccttgtgttcagctcccacttacaagtgagaatacatatttgaatttctgtttctgtgttagctcacttgggataatggcttccagttgtatccacattgctgcaaaggacatgattttgttcttttttatggctgtgtagtatttcattatgcatatgtgtcacattttctttatttaatccaccattgagggacacctaagttattgaatccatgtctttgctactgtgaatagtgctgcaatgaacatatgggtgtatttgtctttttgttagaacaatttattttgggggagggggtatatatccattagtgggttggatggtttgaacagtagttctatttctagttctttgagaaatctctaacctgctttccacagtggatgaactaattaacattcccaccaagagtgtatgtgttcccttttctccacagtcctgctagcatctattattttttaactttttaatgatagccattctgactggtgtgagatggtgtcttattgtggttttgatttgcatttctctgataattagtggtgataaatatttttaacatgcttgttggctacttgtatgtcttcttttgagaagtgtctgtttatgtcccatttttaatagggttgttttttgctttttctcttatgttccttacagattctagatattatacctttgtaggatgcagtttgcaaaaattttctcccattctatagtttgtctctttactctgttgatagtttcttttgttgtgcagaagctctttagtatgactagatgttacttgtcactttttgttttgttttgtgattgcttttcagtacttagccataaattatttgccaaggcttatgtcaagaaagacatgtagttttattttttattttaggtttgttatataggtaaattgtgtgtcacatgggtttattgtacagattatttcattacccaggtaataagcatagtacctgataggtactttttcaatcctcatcctcctttcacccttcactctcacaaagactccagtatctgttgtccccttctttgtgtttatatgtactcaaagttcagctaccacttataaatgagaacatgaagtatgtggttttctcttcctgcgttagtttgtgtcaggttatggcctccacctctatccatgttcctgaaaaggatgtgatctcatacattttcaaggctgtgtagtattccatggtttgtatgtgccgcatggtcattatccaggatactcttaatgggcatttagattgatttcataactttgctattgttaatggtgcagtgacaaacatatgcgtatatgtgtggttatagtaggatgatttatattcctttgggcatatacccaatacctggattgctgggtgaaatggtacctctcctttaagtttttagaaaaattgccacactgatttccaccatgactaaacttatttatattcccatcagcagtgtataagttctcccttttcttcatgaccttgtcatcattttttatttcttgactttagtaatagctattctgactgtagtaagatggtatcaaattgtggttttaatttgcatttatctaacgattagtgatgttgtgtgttttttcatatgcttgttggctgggtatatgtcttcttttgaaaatgtctgtgtcttttgcccactttttaatggagttctttgatgctttttctttctaatttgtttaattttcatatagattctggatattagaccgttgtgtgatgcatagtttctaaatattttctcccattgcataagttgtctgttaactctgttgatagtttcttctgctgtgctgaagcactttagtttaactaggtcccatttgtcattttttgtttagttgcaattgcttttggcagcttcatcataaaatctttgctgggacctatgtccagaatgatatttcttaggtcatcttccagggtttttatagctttagattttatatttaaatccttaattcattttaagttcattgttgtaaatgatgtaaggaaggagtctagcttcaaccttcttcatatggctataccgttatcctagcattatttattgaatagcgagccttttccccattgcttgttttttgtcgactttgtcaaaggtcagatgttggtaggtatgtggctttatttctggcctctctattctgttcccttgatcttttggtccatttttttgtacttgtaccatgttgttttggttactatagccttgtaatatagtttgaagttgagtgacatgatgcctgcatcaagctattcaagctcttttttggtttcatatgaattttcagatagtttttgcaaattctgtgaagaatgaaattgacagtttgatagcaatagcattgaatctgtaaactgctttgggcagtatggccgttttaacaatattaggtattcctatccatgagcatggaacatttttccatttgtttatgtcatctctgatttctttgaatattgttttgaaattctcatcgtcaatacctttcacctccctgattaggtatattcctataaaatttattatttttgtgactattgtgaatgaaattgcattattgttttggctcttagcttggatgttgttcttgtatataagtgctactgatttttgtacaatgattttttatcctgagattttgcttaagttgtttatcagacttaggagcttttagacaaagactatagggttttctaggtataggattatatcatttgcaaacagaaaaagtttgacttcctctctttctatttggatggtttttatttctttctcttgcctgaatgctgtagccaggacttccagtactatattgaacagcagtggtgtgagtggtcatgtttgttttggtctgtttctgaaggggaatacttccagcttttgctcattcagtatgttgatcactatggatttttcatagatggctcctgttatttacttattaattaattaatttatttttgagagggagtcttactgtgtcacctaggctagagtgcaatggcatgatcttggctcactgcaaattccgtctcctgggttcaagcgattcttctgtctcagcctgctgagtagctgggattacaggcacatgccaccacgcccagctaatttttgtatttttagtagagacagggtttcaccatgttggccagggctggtctcgaactcctgaccttaagtgatcctcccgccttggcctcccaaagtactggggttacaggcatgagccacagcgcccagccggctcctgttattttgaagtaagttccttcagtgcctcgtttgttgaggtttctttaacatgaagcgatgttgtattttaccagaaaccttttctgcatctatcgagatgattatttggttttgtatttacttctgttgctgtgatgaatcacgcttattgatttgcaatgttgaaccaattatgcatcccaggcataaagcctacttgatcatggtggagtagctttttgatgtgctgctggatttggtttgctagtattttttgaatgtaaaaagtttctgagtataaatttatcaagaatattggcctgcagtgttgttgttgttgttgctgttgtttttgttgtgtatctgacagatttttgtatcaggatgatgctggccttgtagactgagttagggagaagtccatccttctcaattttttgaaatagtttctataggaatggtaccaactcttccttatacatcttttcagttctgagtctgtgtggtcatggagtttttctggttggtaagactcttattactgattcaatttcagattccattattattgtattcagggattcaatttcttcctggttcaaatttaagaggttgtatatttccaggaatttattcatttcttttaggttgtctagtttgtgtgcatagaggtgtttgtagtagttactgagggttttttgtatttctgtggggtcattggtaatgtaccctttgtaatttctaattgtgtttatatggatcttttctcttttttactttattagtctagctacaagtctatcaatctaatttattctttcaaagaaccaacttctggatatgctgatgttttgtatggcgtgtcacatatcaatttccttcagtttagcttctgtttttggttatttcttatcttctgcaaactttgtggttggtttgctcttatttcggtgtcagagtcttgatttgatatctttctaacgttttgaagtgggcacttagtactgtaaacttctctcttaatactgctttagatgtatcccagatattctagtatggtgtatcttttttctcatgaatatcaaacaatttcttgattctgacttaatttcattgtttacttaaaagtaattcaggagtagcctgtttactttccacatctttgtatgattttgagcaattttcttagtattcatttctatttttattgtgcaatggtccaagagtatgtttggtatgatttcagcattcttgaatttgcttagggttgttttattttttattgtgtgggtgattttacagtttatgtcatttgtagatgagaagaatttacaatctgtttttcagaggggtggagagttctgtagatatttgttaaactcatttggtcaaatgtcaagtttgggtcccaaatattttaagttttttttttttttttgccttgataacttgtccgatattgtcagtgtggtgttgaagtctcctactattactgtggtgttatccaattctctttgtaaatttctaagaacttgctttatgaacttgggacatcctgtttggtgtatttatatttaagatagttaagtctgcttgttgaactgaaccctttcccatcatgtaacactttttctttttgccttttttgttcattggtttaaagtctgttttgtctgaaattacaataacaaccctcactttttttctgtttgccattttcttggtagatttttctccatccccttactttgagcctgtgggtatcattgcatgtaagaagggtcacttcttgactgcgtggagttgagtcttgtttcttcatctcacttaccactctgtgcctttaactgggacattcagcccatttacattcgaggttaatattgatatgtgcaggtttcatcctgtcattttgttgttagctggttattatgcagatttgattgtgtagttgctttatagtgtcaatgatctatgcacttagtgtgtttttgttctggctggtaatggtatttctcttccatctatggcactcccataaggacctcctgttaggcaggtctggtggtaacaaattctcttagcatttgcttgtctgaaaagaaccttatttctcttttgcttatgaatcttagattggctggatatgaaattcttggttgtaacttcttttcttttctttaagaatgctaaatatagtcccctagtcacttctggcctgtaggatttctgctgaaatgttcactgttagcctgatgagtttccctttgtaggtgacttgcctcttctttctagttgcctttaacattttttctttcatttcaaacttggagaatctgatgactgtgtcttagggaatggtcatctttatagtacctcacagggattctctgcctttcttggatttgagtgttggcctccttagcaagtttggggaagtttttgtggataatgtcttcaaatctgttttccaagttgcttgatttctcttcctctctttcagcgagccactgagtcatagatttggtctctttacataatctcatatttcttggaggttttgttcatttttcttatattgctttttctttatttttcatgcctgttacttcagagaaccagtctttgagtctgagattatttcctcagcttggtcaattttgctgttaatacttgggattgtattatgagattcttggagtttttcagctctgttagttccatttggttctttcttaaaatggccatttcatcttttatctccagtatcattttattatattccttagatttcttggattgggtttcaactttctcctgaacattgatgatcttcattcctatccatgttctaaattgcatttctgacatttcagctatttcatcctggttaagaactcttgccggaagcaaccatggtcatttgaagcaagaagacactctggctttttgagttgctagagttcttgtactagtttttttctcatctgtgttggctattattctttcaatctttgaagttgctgtcctttgcataagttttgtttgcttttatcttctttgatgcccttgagagtttgattattgtataaggtggattctattgacaagctttgaatctagtttgcccctggatcttgaatgtactcctttcaattactgtctctgtgtccatgtttcttttgttaggtgttctggtctatgcagctccctcagacaggggcaacagttggcagacaggctgtatccttgcggtgtcagccctaatctgctgtccagtgcttcccaggggaacatggggttgcacctgcctgcagagttcaggcagaagtgggactactgggctggaagctctagtgggtgtagcccatctagctttgagaggcaggagtgggtagaattacccctcctgctgtctgcgtgtttttgaggttaactggaggctgtttcccttggcaaatataagcagaaataagaccagtgtgctggaagctctagctggcattgcttgcctgactccaagaggcaagggtgggttgagtcacccaccctgccatctggatgcttcctgggacaacaggagtctgtgcccacttgctgagttcacacagaagtgggaatgctggactggaaactctagcaggcactgtctacctggctaccagtggcaggagcgggtgaggtcacttgccctgctatctggatgcttcctgggacaaccagaagctgtgcattccagctgagttcacaaaaaagtaaaaccactaggtcaaaaggtctagcaggtgctgcccacctggttaccagtgccagggatgggtgtgattatctgccttgctgtccaggtgctttctgggacaatagaaggttgtacccactgtacccactggttgaatccatacagatgcaaggacactgggccagaagctctagcaagtgttgcccacacagctaccagttgcagggttggattgggtcaccctctctgtcatctgggtgttttccaagacaacagaaggttgtgtcctttggctgagttcacacagaagtgggactgctgggcctgaagctggtgtgaagccccatccagctaggaggagtgaagcaatcttactactcacaggcaccaaaactggggcctctacgggggatatggtgctggtgctcatctgctttgggacccaaggcttgtaaaagttttgttgaactccaaagttgccacttcaaaatgtccgggtggctctctgcctgtctagaagcatggtagtggggaaggcatggggaacttgggaggattctctcatttccagtcttgcacaagttcctgtggagaacatgaatcccctaggagctctcgatcactcaccctttcccatactggggaggttctcctgtctccatggtgagcccagacaggctggtgtctagctctactcctctctgctctctgtgtcactttgctgccttgatgggtcccgacgtggtttctcagttgatcagcttgcagggtcagtattcactagcctgttttgctccccctctgtgagaggagcacacatgagcttctaatctgccatcttctatccaattattggaccacgtatattattccactgtgccttagcatctacatcaaacgtgaattcaacacattgcagaaacttttgatgttagctatttctttacttctgttagttttgggattcttttattttttatttttttttgtatttctatttcccctagttgtgatgttaaggttattaattaattttgttatttactcaaaagtcatttaggagcaagttgtttaactttcatgtaattgtgtggttttgggagatcatctagttttgatttctattttcattcctctgtgatctgagagtatgtttaacacactgctgatacttttgaattgattgagacttgctttatgaccaagcatgtggttgatcttagagtgtgttctgtgtgtagaccagaagaatgtgtattctgtggttgttgggtgaaatattttgtaggtgtctattacctctaattggctcagtgtcaaatttatgttcagaatttctttgttagttttctgccttaatgatctgtctaaagctgtcagtggggtgataagtcctccactattttattgtggctaagtcttctcttaggtctagaagtacttgttttataaatctctatgctccaatattgagtgcatgtatatttaggtgagttatgtcttcttgttgaattgtgttgtgggaagttagggaccccgaacggagggaccagctgaagtcatggcagaagaatgtggattatgaagatttcatggacatttgttagtttcccaaattaatacttttataatttcttattcctgtctttactgcaatctctgaacataaattgtgaagatttcatggacacttatcacttccccaatcaatacccttgtgattccctatgcctgtctttactttaatctcttaatcccatcatttttgtaagctgaggaggatgtatgtcacctcaggaccctgtgatgattgtgttaactgcacaaattgttgtgtagagcatgtgtgtttgaacaatatgaaatctgggcaccttgaaaaaagaacaggttaacagcaatgttcagggaacaagacagataaccttaaactctgaccgccggtgagccaggcggaacagagccatatttctcttctttgaaaagcaaatgggagaaatatcactgaattctttttctcagcaaggaacatccctgagaaagagaatgcgtccctgagggtgggcctctaaaatggcccccttgggtgtggctgtcttttatggtcgagctgtagggatgaaataagccccagtctcccatagcactcccaggcttattaggacaagaaaattcccgcctaataaatttttggtcagaccagttgcctcctctcaaatcctgtctcctgataaaatgttatcaatgacaatgcgtgcccgaaacttcattaccaattttaatttcgccccagtcctgtggtcctgtgatctcgccctgcctccatttgccttgtgatattctattaccttgtgaagcacatgctctctgtgacccacaccctattcgtacactccctcccctttgaaaatcactaataaaaacttgctggttttgcggcttgtggggcatcacggaacctactgacatgtgatgtctgccccggatgcccagctttaaaatttctctcttttttactctgtccctttatttctcaaactggctgacacttagggaaaatagaaaagaacctacgtgaaatatcgggggtgagttttgcctgatatctggctgaatttccccagatagaattgaaccttttatgattatgtaatgcccctttttgtcctttcttattgttgttggtttaatctgctttgtctgatttaagaataacaacgcctcctcttgtttccatttacatgacagatttttctctatccctttactttgatcctatgggtgtcattacatgtgagctggaccttttgaagccaaaagatggatggtcttggttattcatccaaattgccactctgtgtcttttaagtgagagtgtttagagcacctacattcaagtttaattttgatattacattcaaggtgaagttttgatccggttgtgatgttgttagctgtttatattgtagtctcaattgtatagttacttttaagggtctgtcactaagtacttaagtgtgtctttgtggaagcaggtatcattattttgtcttgatatttagaactctcttcaggatttcttgtaaggctggtctagtggtaggaaattcccatagcagttgcttgtcgagaaaagatttttttcttctttacttatgaagcttaatttgctgggatatgaaattcttgtttggaattaattttctttaaggatgctgaaaatagggccctgatctcttcaggcttgtaaggtttctgctgagaagtccactgttagcctgatggggttccctttgtaagtgatttgacacttttctctagcttcctttaagattttttctttcactttgaccttggaaaccctgatgactatgtgtcttgtgggtagtcatcttgtatagtgtcttacagagattttctagattttattttacgtttgcttgtctacctctctagcaagattgggaaaatttctgttgactatatcctcaaatatgttttccaagttgcttactgtctctccatctctcaggaattgtgggtttgttctctttacataatcacatgtttctcaaagttattgttcattttaaaaattctttttccttttttttttttttgttttttgttttttggttaactgggttgatttgaaggaccagtctctgagctcaaaaattcttttctaagcttggtctagtctattgttgtggcttcaaacttgttttgaaattccctgtagtacctttttcaatgccagaagttcaagtatgtttctttctaaaaatggctacgtcattgttgcactctaggatcattgtactggcttctttggattgggtttcaactttctcttggatcttgttgagcttccttgccatccaaactctgaatcctatgtctgtcacttctgtcatctcaatctgcttagaatccattgccggggagctagtgtagtcttcgtaggtaagagagtactccaaagattaaattaatggagtttttgtgccaatgtcttctcatctgagatgagtaacgtttcattatttttttgaagtttctgttattgcgatgaagctttttggttttatttttattttttttcctgttgtgtgtttgattgagatgaatgttatgtattatggattggttgtgtttctttgtgcttttagagtccaaggctctgtatgggttccttagttgtagctggcttcctgccttgggtttcacaggtgatccaggtagagaaatttatttttatttggtggtacaattcagggtgagatccagtagatgagaccctcaccaactccattcctgggccttgggggaaccccttccaaatactggtgctaggtccccatttctttaggctcaaacaggtccctggcaggctgcactctctcacaggggctacttgagtcaaaggttagtccaccaggggacatgccattcactggggaccttttggtcctctgagtttggcagagtcaaagtgggttgtggggtatgtctacaagtggtctgttaatgcggtgggcctagggtggaggatccctagacaaggaagtggtgccattggtgtgtagctgttgtggcacctatggcccaggatattttgccaaacagatggctgtgggaactgcccagctgtcactcccctgttggtttctccctctgttgtctactccaggagcaggtctgaacagctagttttgtgccaaaccttctgtgcccggattgctaggtcactctgggtgttctgggctctagggctgccttagggagaaattgcagctggccaacttgctacactctttcttgtctggttttgtggagagagggatgaccaactcccatgccagcacacaaacccatacatcagacattggtttcaatgttctgagagtaggggctcatccccaacttgagcacaagtcccagatcttacctcaatactcctgggtgttttgctcaaaccctggagggttgggactaagcccaaagctttgaaagctttgtcctctgggacccctgactctactggggaggggcaaactgctctcaggccactggaaaaacactcagctggggcaatggaggctgtgctgtgtgcctcctcttatgggagtggccaggcagggacctcgggaggggccagctaaaaaggggttttgtaaatcagatgcaccatggtcctgtgggaaaggcagccctgttctcccaacctggccattcacaggagccagagccactcagagcaagatggagagccttgggggatggacacttatggttgtgttttgcagcagctgcctcccacacaaaaccttttgggctctgtgcaagcctctgcctcctctctgggaagttccccttgccaattcaaatatctgtggggttcatgggatctcttgtagctgggatcccacctacaatgcgagtgtgctgcctcacagttccttcactcaccccttccttaggacctggtcagaactgggagccattcttgacacttggagactccatataggcttcctagctttgtccctattcaccctcggtgtcttcatcacttctccattgactttgagtgttttctctcaaaagatctgttcagaatgtgatggtttactcgatattttagcttctcttgttggaagagacatctcctggctgtgtctagttggccatcttattctactttactaaatttttaataagagttcaagcccaagtattttgatatgtactagcttcccttatgtttcttataataatttttaaacattttctcaatgattagatttattatgatataattaattctgttgacattaatcaatatatattattctttactaatatatatacatgtggctaaagccatgattttagagaactttgtaataataaatgataaattgtatacagaggtataaacacatatatgtatatatacatgtattacttatataaatatatatgataatccataagtcacatttttttccaacatgtaattgccattagagttcaagtatccaaactagcggagggatatatctcatagatctgattacttgttaaagatcttttaaaataattgaaggattacgataagaaaataatagtagcaaatttagtaaaaagtaactgattttctcctgaaacaaattatagtcatgtgccacataatgacatttcagtcaactatggaaagaatatatgatggactatagtgcatattatattgtactgtttttatgtttagatatgcatatacttattattgtgttacaattatctatggtattcagtacagtaacatgctatacaggtttctagcctaggagcaataggctgcaccatatagcctgtgtgcctgtgtggctattgcatctcggtttgtgtaagtataccctgtgatgttcacaaaaacacagaattgcttaacgatgcacttctcagaatgtatttccatccttaaatgaagcacgactgtatataataattagtcactataattttaaaacaatttgttcgttctttttaaaaaatcgtgtaaaaactaacagactagttagtctatttttcatttttcaaaagttgaatagtgctgaatgaatcatgttgtaaataagagtataattttacttaagatattacacacatcctacaattcatgtcatacatcataatgctcattataatagacttcttgtcttcatgagataataataattactgagtgaggagctaagcttgagttataactcatccatttacttcctgtattacaattgttaagtctctttaattccttgcatctttgtaaaattgaaaaatactgttgacattttgattacgaattgaagtatattataaagtttggtttatggtttagatcagggttcagttaagctacagtctgtgtgtcaaagctagcccactgtctgtttttgtattgcctacatacaattctgtttcctttttaaattttgggaaaaaaatggaaagaaaataatattttgtgatacctggaatttatataaaatttatattttagagtccataaataacatgttatggggacatagacacacaaatttatttatgtattatctatggctaatttcatgccataatggcagaactgagtagttgcaacagagggagtaggactcacaaattcaaaaatattcagtattgaccattcacaggaaatgtttttgagctcctgggtaagaagtctacctcaaaaaaatatatcatacatgtcttgggatcaggttctggaattattgtatctttatacacacagtacctgtcatagtgcctgcctagtagaatgatcaaatgttgtaattcactggaaagtttgccatgaactataaactttgatagccatattaatgattgcagtgattatttaaaatgattaaacaaattctgtcttattaatcagtacttttattgatgagtttttggaagtctctacctcactactttcactgatgtactcacccctctcccattattaacttaatgagtatttattgtctcttgttacttttttgctattacatgtaataatgttatgaatgtccttgtacacatatcatgtagcacacatattggtatatctgtaggagagatttctgtaagtgagattccgattcaaagataagtaagtttaattttgatagctatcactagagcctcctccatagatgttgcagtatctccctttgccaatgatgtgtaagagtgtttgtttctttacagagataacaacacatagggttgtttttaaaacttggaattatgcaaacatgatgggtgaaaaaaagatatccccgtgtactttaaatttatatttcttgtattatgagtaaaattgatgatgttttccaattttgaggagatgtaattatttcttttttattaactgcctatttatggcctttattttacattatttttctagtctgtttaacttatcagccctattaattctttacataataggtgcagtagttctttgtcagtgataaaagttattaataatttttcacagttgacatttgtcttttaactttgttcatgatgttttgtttaataaaattattattttaatatagtaattctttgcactcttttgactgaaattatattttgtttgacctaggactttctaagccatgagggtactggttttcagagttaatagcagttgagaaaaatgaattccttagccctttttatcttcggtttaacacctgtattaaattttttttattaaataaaaaagaatgatgcagcagtgaaattgcttatgttagggactagaaattataatttaaaatacatctgacttcctatttttagtcattaactattgactagattggatttatgtttcatatttaccaatgaaatattctagaggtgaaggttgttattgtgaagtgtgtggattattaatgtaatatgttaggaatatttaaacatctgcaattgatataatttaactaaggagacatttaaaatcatgtctgttttgctaaagcaaagctgctggcaatatgcttcataaatttcaagtgctaagtccttgtgattagctagatgttgtgctccataaatgcatattattttcattttaaaaacaccattgatgatgtttttaactgactaaacagtctttcttaagaaaattaagaaactctatgtttatctccaagtatttgtaagtggatcttgtccacattgcactatttgaccattaaagaggataggaataaaaattaaaaagaatagataagagaccaaatagtgtgccatattgtttaggctaaaatattctaatctattaccaatgttgccttagaatcttggctatattgacattaaaaatagttcattaataaaagttaataaaaacattgttttctgaataaacaaaagaatgacgttctctatcttcactgtatttatggtgtatctgtttataactgttagaattttctctagatataaatcgtatgttgaagattttgcttacatctgttaagaacttggttactaaaattctcccactcactcatctgtttacctgtgtcctatcatgtgtgaataaataggtgtagatttctttattaaacaaaaacaactacaagaaacagagggtaaggaaaaagttccagtgaaataaaaaaactgagaaactattttgctgaattcctcaagtgatagaaaggagcgatgctcaaaacagttaagaggcctcttcgtgttcataggattagttacggaggtgtcaaaaaaattgagatatccagttccttaatgaaaatcactttgcaatatagagggcataaaatacgtctctcatcatcactatcactgaccttattctatatttttcattacttagaagacaaccttcaatttttttttaatatgaagatatttaatatgtattttcaaattaaagaaatgaattttaggttaaagagagaataaatcatgtaaaaggaaatagaaagtttcaagctttttagaaaaaagatagcttttatgtcatcataaactctgaattaaaaattaaatgtacaacaagaaaaggtctcaattgtcatccaatattgtcaagatgataactatataaacatgttttcatagcttccttgaaatgggaaagcttttatatcaaaacgtgacatctgaatcttatacaaatgacaacatgatgacatggtgtcatgtaaaattaattatagcacacaattctacgtgaatatataacttttccagtagtcatcatgaaaacaactatttagatacagtcctccaacaaactggatgcagagaaaatgaattttatttgagtatattatattcagcttgtagtaacttaggagttttttaaataaatcagatttaattaaggttaattatgtttttagagaataagtgatattttatttgaataattcagcaaatgtttaatgaaagcatttcctaagtctacactgacaaatttttaaagttcagcaatacacattatgggcacagtgtatatatttattcacattgtgaactttatattatcatacaaacatactaatctatgtgtgtgtgtccatgtgtgtgtgtgtgtgtgtgtgtgtgtgtaacaattttgctaaaccagaggtgactttgatgctagagggcatttggcaatatttggaaacatttttttttccagggcttgtctattagttacaattggcctaggaaaatgttttaatacatttttatcagaataaaaaatgaaaatgagtattattcaacctgcattctattattgtttctatcagttttctttgtaaatcaaatttattttttaattgataaaaggacctacaagtgcaaaagggtatagggttcgtgaaagttttaacgccctcctgggatttggttttaaatgactataggtgtagtgctcctggtatgtagtttgtagagccctgctaaatattctataacacatagaacaaccagccaccaacaaataatcatccagtccaaaattgcaatagtgccagggttgagaaattatgtgtatattgcatttgtatgtatatgcaatttgtgtgcatatgcaagagtgtttttttttaggacataattcatgcctggaaggccaaaccaaaaccaatagtattatctattgtttctgtgagtgtgggagtaatattcgttaagcaacaagggaaacatttgatttgctcatattattgggtatttttacaataaaagttcatttgttatattactttaataataaaataatttttgaaacataaataaagtctcaatagtctattgagactttatttattttaaattattttaatgtcatgctagcaaaagagcctctttcttctcccatattaaatttattttttttaaaatctgcacacacacaaaaagacaatattctcctatcctcctcatccctaaggttgttacgtcttctggataatacttctggttatactaccagaagctggttttgacttattttggcttattttatttgttctcaatagacttaacacacatgtaagtgaaagcttccaaaaaaaagcttccaaaaaaatcatagatttttccacatttgataatatgaaaattctgttttggcacattagtgtcaataattatcataacaatgtagttttgaaatagaattaaatattcaaaatatgtatattcagtgtattttaatggtttatgacactctcaattcaaatgtgtttaaatatcctggctttccctttgtggaattgatgataaaattgtttactatgactacaagtgtcaatattcttgtaattttgtaatttccctttctgaagttaagttccaaaatagttattagttcagaattacaggttgcagataaatgatttagtttatcattaaataatatatagttctaatgtcttttttctgaagagtctctctaatgagatattaaaattctgataaaaagattctcttggtaaaaatgctcttaaatattttctccaagcaattatatcattataatgatatatatcatatttatcttcttttcttatccacatagaaatgagttttaactttctgtttttttatagaatctgacaattctttttttaaacaatggttttattccattgtgcctattgtaattttttttattatactttaagttctgggttacatgtgcagaacatgcaggtttgttacgtaaatatacacatgccattgtggtttgctgcacccatcaacccatcatctacattagatatttctcctaatgctatcactcccccagtcccccacccgtcaacaggccccagtgtgtgatgttcccgtccttgtgtccatgtgttctcattgttcaattcccacttatgagtgggaacatgcggtgtttggttttctgttcctgtgttagtttcctgagaatgatggtttccagcttcatccatgtctctgtaaaggaaatgaagtcatcctttttcatggctgcatattattccatgacgtatatgtgccacattttctttatccagtttatcattgatgggcatttgggttagttccaagtcttttgttattgtgaatagtgctgcaataaacatacatgtacttgtgtctttatagtagaatgatttataatcctttgggaatgctatttctggttctagatccttgaggaatcgccacactgttttccacaatgtttgagctaatttacactcccaccaacagtgtaaaagcgtttctactgtaatttttaatgcatttggacccattacagatttattttgttttttctgcttaacaaatttttgttgattaggttgtttcttgttttgtttgttgttcttttgttctcctgtaatgacgtctactggagtttctatctgtttggtggttttatgttttatgctttttgcaattgtgattgctcttaattttttgcatgtatttattacttccatgtcaaaacataatatctccttctacttctccaacaacgacatagaatgttcaaatttcagttacatattttgttttctacgttctacatgcactttcataatacaccaagttatttttaaacctccaaataataataattattgttattagtattaatgtataaagtatatacttacatttctaacatatttaacactttgtttgcttctctctgcttctatatccagtttcttcttcctggcttcaatttgctttttactgaactatgactgtactctatttatttttaacagatatacttcataaagtttaaagttgatacctttacagttctaaacaatacaaaaaccttaggatatttaaacactaattactttctctttgttcacattatttttgtctagcattttgtttctttgttttataaagtactttccagatgggtccttattgctaaaatcatttaaacattcactcttgcttagacttacacacatttatcaatatctttgttgttgattgcttctatccccttcttcctcccagtttgatttccttattgtttatgtagaacctttactgatttatttttgtatttgatcttgaatggtcatttttttcttctttgttgaattaccatttttttctgtgtgtgtgaaggattctaggatgaatttttccactattgttttgttgaagatatattgtatactggattctattgttgctgataagcctgctataatttcatttaaattgtctttctttctcttaggcttatttcaggattaccactatgtcccttgtgttctctggattggctaatataccttggctcagataatttttttctttttatattttttggtctgtgtatttatttcctagagctgccgtaacaaagtagcacaaactgggtgacttaaacagcatattattattgtctcacggtttgggaagctggaagtctgaaatcatgaggtgagcaggattggttccttcgaagggaaagatctgttctaggtctctctcctagacagccatctcaggttcacacagtttttttcctgtatgtgtatctagtgtccaaagccctccattttataagaacatcactgatgttggattaatgactgccttaatgaccctaccttacattgattagccctgtaaagaccctatctcttaataagatcacattttgaagtattggggttcagagctttaacatatgcttctttctttatctctttcttttctttccttccttccttccttccttctttctctccctctttcttctctttctttctctccttctttctttctttctttctttctttctttctttctttctttctttctttctttctttctttctttctttctttctttctttttctctttctcccttcccttttcctttccctttccctttcctttcctttcctttttgagacagagtctttttctgtcatccaggctggagtgcagtgtcaggatctcagctcgctgcaactttcacctcctgggttcaagcaattctcctgcctcagcctcccaagtagctgggattacaggcatgtgccaccatacctggctaatttttgtgtttttagtggagacgaggtttcaccagtttggccaggctagtcttgaactcctgacctcaagtgatccaacagcctcagagtctcaaagtgctaggattacaagtgtgagccactgtgcccagccaacatatgcttttttcatatgcactattgagcccaaggcaatctaatatcagtactttttaattgattaagatttttacacctaattagaaaaatataattaagtatattatatttacttaattacttaatcaaatatatttacttaatcaaatatattgatttgctttgttcttgtttatttgaacaattatttgaacttgtttcatcctcgtttcattctaaaacttctaattgatataatttcttaagttttatctctaatgtattaatgctgtcttgaactaaattaaatcattatcctatgctcttcgaattaagtatgaatattaacttgaatttgtcttaaaatgtctctttccttttgccttattttctcctattttattttatttttattttattttttttgagacggagtctcactctgtcacccaggctgaggtgcagtggtgtgatcttgggtcactgaaacctccacctcccaagttcaagtgattctcatgcctcagtcctcccgagtagctggggttacaggtgtgcgccatcatgtctggctaatttttgtatttttagtagagatggggtttcaccatgttggccaggctggtctcaaactcctgacctcaagtgatccgctcacctcggcatcccaaagtgctgggattacaggcaggagccacctcaccaggcctcattttgacatctagtttttcttgcttcaattcttccaaaccacataaataacagtctttttcaagttttctattttccgtgtgtgtgctcgatgttcccattctcatatttcctttgtctattcactattggaagtggagatttgatcctggtacatctttaacatttttatattcactggtctccagtggtttatgatgggaaaaaatggggttcttagtggaatccctttaaactttaacttgagaaatattcatagagagccacttatctttttaactgctgtcaacaaatggtttcataaatatggatttaattcttaactactgattcttatgtatacacttaatgtaaacaacaacaacactaaaatataaaacatatatttccttttatctgggctgtaggtttgagtttcaatttctcatatgaaactttttttaccaagaactcctaataaccacaaaattctttgctactttttaaagctggtgagtatatagtctaatttttttttattatactttaagttttagggtacatgtgcacaatgtgcaggttagttacatatgtatacatgtgccctgttgctgtgctgcacccattaatttcagggagttgattttaagtgttttggctttcttcagacagctccattctaattctatatcttaaggagaatgaaagtctattttttctagtcttcaggaggtgtaaaaatcaaattattggtgcctagagcgtgtacttagttaattttccccagaggcactgggctatctgacagttgggaatggcctccatgtccctaagtcctccctcccttctttctcccctggggattatctcttactgtttctagattgcttgtattgtattttagtttgaatttttatataccatttctaattgttcatagtaagagaaatgcctagatcagctttgtctgccatttttatggccacatctttcctcgggttttgttttgtacaaaagcaagatttgtattaaataatatttttaatatcctttctggatatacatacagtattcttttatcatgctttgatactttcacacagatacagagataaaattctaaaatattcccaaatataatgtagaaatatatattccaaaaattgtttttctttataactaattgtagactgattttctatttcttttcctttttttttttttttttttttttgagacagagtttcgctcttgtcacccaggctggagtggcagtggcgctctcgtggctcaccacaagctccacctcccgggttcaagcaattcttctgcctcagactcccaagtagctgggatcacaggtgtgcgccaccatgcctggctaatttttgtattttttttttagtagagacaggatttcaccatgttggccaggccggtctagaactcctgacctcaggtgattcacccacctcggcctccctaagtgctgagattataagcgtgagccaccgcatccaggcttagactgatgtatttcaacaggtatttactttaaggaaatgaattgtttttaacattggtattacattattctcagaaggtatgttctattattttattgatttttatccaatgaatgtatgaacatttaattgcactggacctcacataacaaagacatttaatttaaaagttgagcctagtgggccttcaaatacattcagttttatttttgttttttttttgttgttgttgttttgttttattttttcttttgtaaagaaaattataggcattcgttacaaaagttacaaagttaaatataatcaatcattttcagctagaattctttgtttcttatgcaacatacttgtcattatattcatagagattaaacaatatatgctataaaatatttttctacattaaaaacaaaagaataatattacatataatagtatactaacttagtcatggccttttccttgttttctattgtttggtgctttagcttgactataatcgagtttattttgacaaaggttgaatactatataggatatattcatttactcaaaatgcatttatttaaaatgcacagtgacctgtgttccggtcactatgttacacattgtttatatagtagtgaaaaaagcagatagattgggaaaggttaacattaaattgacattcacacaaataaatattcaagtataaacaatgatgagaattgtgaaaaaaacttactacatacacagtgtaaaacctagatggaggatgagggaagaactctctggggaaggaataatcaggctgatatctaaaaatgaaaatgagccaatcagggccaaaatgctgatgtgttttgtgtggtcattgggaatggataagtgttcgtggtggagaattaacatgtgtaaaaatcctgagatggaaagaagtttgtgcagtgaaggctcaaagactcaggtacctgtggtttaggaaagaagatgtagtgaggagagagagaaaactacacttctcagtagagcctcgacattacaaagcccctttaaggaaataattggggacttaatatttggagaaactgaagacattgtttacttttaagaaggaaagtaatgtagtatcaatgtacagtcatgtgccacattaatggtgtttcagtcaatgatgatggttccataaaattataacactgtatttttactgtaccttttctttttttaatttttagttttatttaaagttttatgtgcaggatctgcaggtttgttacataggtaaacatgtgccatggtttactgcacctctcaacccatcacctaggtattaagcccagcatacattagctattttccctaatgctctctctacccccaccacaaatcccaacaggtccctatattttgttcccctccctgcatccatgtgttcttgacaaatgggatctaattaaactagagagctactgtaccttttctatgtttagatatatttagatacacacaccattgtgttaacattgtctgtagtaaccagtacagtaacaagttgtacaggtttttagcccatgagcaatagagagtattatattatatagtcttagtgtgtagtaggctgtaccatctagtttaactacactttatagggtttccccagtgaggaaataggctaatgacacacactaagcaatgaattactgtatttattgacatatatgtatcgttatacaatcagtcttgcttctctgtgagcaactggtttcagggaagaaaggttttcagaaaatcaaatgtaggttaatttctgtaaagagttaataggcaataggaaagagggtagcagagcaaagtttgcttactttaacataatgattgaagtgacaatacaagtttgggctatataatgcattatgaattcaggacaactcccctgagacatacttgtaacatgtattaagtatctagaaaccgaagaaggaatattgaactagtattcttcagtttttacgatataaatctttgacattggtaaatccagcctcctagagcccagttttattatgtacattgataaggcggaagaacaagacaaatgctaaaaccctatttcacttcaaaagttgtggcttcaacataaatttaactaacaaaatgccatttgctttgttagatttggagattacattgataaaatatgccgctgcaatgattagtgaaattaagacaagaagcagaggcagttttgtgaagaaataattgtatcacagtgctgatagtgcaacagcagtgctgaacacgcaggcagtggtgcacgaggagagatgcatttgactgagatcaatttagggaaggctttggaagaaaaataacttgcactaatatattttgctcttagtagaaaacgaggctggtaaaatgtgtttgttaagaaggaactccagtgaaattttaggaactacatatccaaaggttaaatgtgtcacattcaaggacaaacaggggtaacggttggagcagagtgcatgtgttagaagtgggcctgagaataatgccagagaacgtggatgggtgactgagtacaatcctggtagaagattcgaagaagaaaatagctatatggtttatccataagtgtttgggaatccactgggagattaccaagtggtaaatgaaattgtgacatttagaacaagcttggcatcagagaggatgctttgttgttgcacaaatctagacaggaatttgacaattgtagaagaaattgagagaaggaaatagattgattaaatattttttaagatgtagaattgacacgactttgtgtctgttgaaagggaaaaaaaaagggctgcaggactatttgaaggtggttggcaggctccggcttgtattaaaggactgatgagtaaagggcatgagagtgatgaagttatttggacaggcttcatctgggtgttttgtgggcctgcagataggcaggtatagaaaaatgcaaagtattacagagagatgtaggctaaagagtagcatcaggagacactggagtttagatggtaattgaagccatggagaaagagttaggaaaacacatatggatatcttattcagaatggaattctgaagaacaaaaacttcaaaggggaaagagaaaactgggacttcacagagagtttgaaattaaaattctgcagagggcgtagaatcaagtggaagtgaaatcatagtagacaaaggagaaagtttcaaggaggacgtggataacaaaatctgatgctccagtgagaataatataagaatgatatattttcggctagaaatggtggctcatgtctgtgatcccaatactttgggaggctgaggcaggtggatctcttgagcccaggagttttgagactagcctgagaaacagggcaaaatcccatctcctcaataaatacaaaaattagccaggtgtggtggtgtacgcctgtagtctcagctacctgggaggctgaggtgggaggatcatttgaaccttgtaggcagaggctgccgtgagttgagattgtgtgccatgggacttcagcctgggtgacagagccacaccctgtccaaaaaaaaaaaatcataataataataatgatttttttccatagctgattttatgcctaggtggctattttctcctgaagagacttagtaatcttcagaggctgagccatattcaagaatattgactagtgatagaagaagactataaattaatgggaatccatggattatttacttatttgtaatagacgtatgtatcttcttcaactgttttagtcatcgccctcattaataatccagggcatgtgaaaatttacatgtttctcaacatgctaatcatcctgatctcttatctgttttaatgatgtttatattggttagtaatttcctgctggccctggaataaaccatctgaaacaagcttaataatgggaagtaatttctgagcttatatacctgaagagtagaacagggtgtaggcacaggtagaatcagagatacaaataatttgattgggattttgaccaaccctcgaaagtggcaaattaacaaattgtgtgaggtccaagtacctagatttacaggctatatagttcagtcagtttctatattttattatagaaaggattacctaggtatgggagaatgttaagtgcccaatagttgtcaagtacacattttaggatttacttatttatttattttatttatttttttttttttgagatggaatctcgctctgtcccccaggctggagtgcagtggtgcgatctcggctcactgcaagctctgcctcctggcttcacgccattctcttgcctcagcctcctgagtagctgggactacaggcgcccgatgccatgcccggctaatttttcgtattttttcttttttttttttttttgagacaaagtcttgctctgtcgcccaggctggagtgcagtggcgtaatctccgctcactgcaagctccgcctcccggattcccgccattctcctgcctcagcctccggagtagctgggactacaggcgcccgccaccacgcccagctaattttttgtatttttagtagagacgggatttcatcgtgttggccaggatggtcttgatctcctgacctcgtgatctgcccgcctcggcctcccaaagtgctgggattacagacttgagccaccgcgcccggcctaggatttatcttttaaggtaggtactagtttatcaatcatttctaggtaccagtttatcaatcaacgtcttttggttgaaaacaatttattagctagcttaatcagaaatataaaataaaatgtaaaataagaaatgtattttattgaaaatgtaaacattcttgctttgcgtcttactggattacctcgatgaatgacagtcgacctgtgccaaatgactgaagtctggatttcagaattactcgctgggaaaaggctgaattaccataatgggtttagaccagtgctggccaacataactgtgcagttgtggttatgttgtacatctgcactattacgatagtcactagctacatgtgactactgcacatttcaaatgtggctagtgcaactgagaggctgaatgtttagatttcattactttaaatttaaatatgtgtctaagctatcagttacaatatcagacagtacttgtttagactaattaggaagaaaatgtagccacatttgcaaaatggatctaaagcgatgagtctgtaaaggtcacataaactcatatgcgtgtgagacattatgaatctaatacctaactctaatatgtaaaaatgttacgaagactgggagagttaagtcagactcacttcatcttggtttcagatagcatgcattgttattgttcactgtatttataaatgtgcgagtttgtggagtatttgtacccaaaggcatggttcagtagatcaccttcttaactgtaacagaatccggctctgagtaatttaagcgtaaaagtgactttttggatggattttgaatagttttcacaattggcagaaaggccagtgaggaagggtgaaaataaaacagaaaccgagggaggctgaatagctgaaagtgcagccacgctgacaccttaggaacaattgggccagaccattgcccatgacacttccgtcaccagacttaaactattattgctgctacttctttgttcttgataacacaaccgtaaataatatttttcccttggtctttgtgtcacttggtcaaatttcaaagctccagacaagagcattttttggcccagcctaagtcatgagccagtgatctggcagcttaagtaaggaagaggcaaaatctgccccttgaaggtttcataccaaaagtttcacaatagagtattgatttttcaaaagtaagatgggtgtacatgaaagacacacatacacgcacacacacacaaacacatatgcccagcatatacctagtataatgcctcaactctttgggaaattttaacatatttgaattttactttgttattttatcttatctgttatgccatcaagatatattaaatataattcattttattttaaagtaagcagcatctcagaagaattagaggtcactacctttcttttttaaacttactccagtgtccaccaacctgttttgaaaaagagattttacttgtcaggttatatatataaaactaaaagtaatgattcataaacttgttctggaacatcttgtctgttcggtaattgcttgttcagttcattagctactttgcatgcttgagttcttcctattgttatatcaaaattatgagaagtattaaacacatttatagtatttgaggcagcataaactatttttaattaaaataaaagaacaccaagcagaaagaaaatgatataagggagtcatatatattttgctgaggattacatttctcttttacgtatgatttatgttatgagtttatgctaattttttttactttttaatgtaggattgtcattgttatgcttgttctttgaaccctgttattagtgttccatttaattaaattgatgagggtgatttttcaattttgttacaattttagtaaacatttagatagagaatggcaaaataatatctaattacatatcaattattggcacaaacaacattaagtaagtaaatatttgtatggtgttgggggggaactgtcaataagtaatgcagctgtgggagaccaaaagctctttctggagagctgttaatttgcatgtaagttgttttttattctgcactttgcagctgtagttttcttagtgtctgtaaagaatgttgaaaacaaagaaataagaatatgctaaatttgggctgatatattaaaaacaaagctctgatctggtgtatattcccttgggaaaaatatgaataaagtatgtgtctgttgttttcaaccttgtttggatgatagaatcacatcaagagattttaaaaaatccttatgcccaaattatacattcagatcaattaagtaagccaatctgaaaataggacttggatatcaatattttctaaagctactgaaattatactgaattgatatgtaactttgagaaccattggtctttagactcattttattaaacagtatgatatataagggtaccttgaataaagtgacacagacctttgacagtgttagactttactacattgtttcaatgactgacacctgtaaaatagtgattaacgtaatgaaacatacgtgtacttagtctttttgcctggctttgagtaatgctgaggaagaaatttctaaatgaaaatattcttttaaaaaagatactgttaaaggaaaccaaggatttttttctctacacgtcttcatgccacctctattattgtattatgttaatttctattttcattgttgttgttctgagacggagtgtcattttgttgcccaggctggagtgcagtggcgcaatctcagctcactgcaacctcaagcagtgaggcaattctcctgcctcagcctcctgagtagctgggactgcatgtgcatgctgccacaccggctaattttttgtattttaataaagactgggcttcaccgtgttgcccaggctggtcgcggactcccgagctcaggcaatctgcccgactcggcctcccaaaatgctgggattattatgaatgtagtacatgcctgtcatggaaaaataaaatagtacagaagtactctccattttttttcctaccattttctactcagagctcttccttacagataaaaaccaacctataatagtttagtatttttgttttaaccagagtctattttatcttgattttctgctatggtatgtgagaatccaatggtttacacaaatcctacctctttttcccttgtcctcatagtgttttatctttaattttatagttcttcctttgattgccttttcaatatatataaaatactgatacatttattcttgtcctcattaactaataggttacaattactttccatttttttggatgaggatacagaaaacccctctttgggtttataagacattcagataaatgaggagaatttgagttcccttcatcactgactccttccgttatcccagacatcataattaatattgttcttaaaaaaattacatacattttttttccaagaataggcacaattgttggcagaggtttatgactacgtgctaaatgctctggttggagacattaagtactttttctataaatattttccattaacctttatcttttagagctatcttgcccccacctgccattatgcttggaatgtttgactcctgagcttctcaggaaaaatgcaaaacaggtcaaagagttgcacagcagaagcctttcaatagtgtttttaaggatatggtttcttttatccttctctctctttatcaatcatttattactttatttacaatttgtctttgaggatcttattgaactatctattgtgttgagagcaaaccctacaaactttactttgtgggaagtttaaatcttttaaatccttttaataatttaatgggactttagaaagaagaaaaaaatataaagcttgtgctccatcttccatcttgaacagaaaaactggggaaactcacataaagatgaatgtatctgtttgtgttataatgcttcttgaaaaatggtagttggtttgaaaagtttgcatgtgctaagcattggggctatcaagcacataaaagataatgcatgatacgaacctcattttcagtgtcaactagtcaccgattttagctaacatactaaacttcattgttcttcattgtgttagatgttagacaacaggaaaaaaataatcctctgaaatagtagtgtagcagcaaagttatctttttaaagatttattgaggtataatagatataaaaaaattactcctagataatgtatacatttaaataaatttagacacatgtttatacccatgacatcaccacaatcaacagcaatcaagttactaaacacattcatcaccctcaaaattttccttatgtatgtggtgtgtgtgtgtgtgtgtgtgtgtgtgtgtgtgtgtgttgagaatatttaacatgggaacattcctgttaacatgttttaaggtgaacaataccatattgttaactatagatactatgttgtacaatagatctccagaacatatttatcttacataatgaaaactttatacccattgaacaaaacacttcacacccattgaacaaacacttcacatttctcccttcccccagcccattgcatccacaattctcttgtatgcttgtgtgagactgaatattttagatatcccatataagtgaaatgatgtagtatttgctcttctgtgactagctcattttgctaagcgtagtgtcttctacgttcatccatattgttgctaatggtgacatcagcatcatgaagagatacctgcacacctgtgtccattttggcattatttgtaatacctaaaatatggaaacacccaaatgtccattgacagataaatggataaagaaaatgtagtattaatatataataatgtattgtttagcctttaaaaaggtatcttaatttatgttaatatcagtataattgtgtttacatatgccatataataatgaaatattccacccaatttccctaatttccaaagatatgttatcatgtcaggtatgttttataatctatttacctaaaaatccagtaatatattttaatcaatatttgaattaaataattagcggaataaaaacactaagctttaaaacactaagatttatcttgtagttttagaatgagcagaaattgattttcaacatgtaatataatttcaaattaattctgttaaaagcatggagataaatggtaactttttgagatttttttctaaaacttgtttcatgatatgaaatatgagggaaaaaaagcatttatttttgctagaaagcagagcctcatttcattcataccccacacaccccactacccaagtccaattcaaagataaaaatgcttatcaggtatgagtatttccaaaggtctggaaattcatcacagattatttacattgtttcaattgagcataattttttaatgaagatttttattgagataattgcaaattaacatttatttgtaaaatataatacggagacatcctttgcaaattttcccaatacccctcattggcaatatttttcacaactagattttaagagtttgatattagaaccaggatgttatccttgataaaaatccaacaaccttattcagattcccccacatctccttgtcccattttatgtgtatatgtgggtattaaattgtataataatgttatctactgcctaggtccatgtatccccaacattatagttatgatactgaacagtttcaaaaccactaggatctttcactggcattttataaccatacccactagcaactttgtcaaaagtcagctgaagatatttgtggagttctattttgggtcatctatcctgtcccattaatctatgtttctctctgcaacaccacactgtcttgtccactgtagctttatcaccagcattaatatcaaagagtaattcttatgattttcttcctcatcaagagtgttttaattaattgaaggcctgtgtctttccatagaatttttagaataggcttgcctatatttataaaaaaaattcaagctgggatttcaaaaatcattgcattcaacctatagatttgggaagaactgacattttagtctgttgtgtctcccagttaataaatgtaatatcttaatttattttgtttgtctttgatttctttcattagtattttgtaattttcagcattcagtgcataaaacattatgtgcatgttttattacatgtggcagtagttcttttagtgattgtaaatgcaattgttttaatttcagtttttgaatattcattgttagtattgatttgtgtttgatgatcttctatcctaccaacttgttgaactcacttagttgtatgagttttagtttatttctttgttttgttttgtttgtagattcattgggatttgctacatggaaaataacattacctaaaaataggaataattttattctgacctttatgatctttaagtattttattttctttttctgccttatagttgcactgagtagaagttactaagttggataagagttactagagcagacatgtttttccttgctccaaattgtattttgtccaatattaattcaatcattcctacttttataaaaaaaaatttacatggtatagtattttccattattttactttcaaaatctacctgtgtcattgaatttgaagtaatttttttaaaagcagcatacagttggatagtaatttgtgtgttcagtatgccttctctaattattttatttaaatcatttatatttaagataattagtgattaatgaggagtgctattttattatatatcttacatttgttttctctgtttctcatttctttgtttcttttttatgctattctttgtgttacgtgaacattattaaagattctgtcctaattaatttattctgtttttgagtatacttctttgtatatttctcactgtggttgctttaggggttaccacaaacataggtgacttttaaccatctacacatatcaacattttaccattttgaaggaagtgtgaaagcttcacttccattttggttctgtgactttcttcacttatcgccttggatatcatatggtgttttaatttttgtttcaatatttaaatatgatagataaaactcatgaaggaaagaacagcctattgcattttttcacttttctgctcttccccttgttgcttcagtttcagtattcttttgtgtgtcatttcctttctatttgaagaactccctttagccaaccaataaggtatgtctgatatcaacagatccttttagtttgcctttatctgaaaatagttttattttccttcattcttgaagagcatttctgccacatgcagaatctgtagttgacagttctactctttcaaaacttgcaaaatactgcaccaggttttttaagtctcaatggtgttacatgcgaaatctactgtcatttgaattgcctttcctttcaggtaatgcatcactttactctggctgctttcaaaaaatgttcttttatatttttagttttcaaaggattaattatgttaaatcttgttgtggatttgtttgaatttaacctgtttggaattctctcagcttcttggatctgtaggttttgattttcaccaaatctgggaaaaagttttcagtcattatatctttaaaattcttctagtgtcagtcatttttccattttatcccagaattttagtaacagaaatattggaccttttttattgtcccttgtgtccctgagacagtttttctctctgttttgcagattgggtgaactttattgttctgttctcaagttaactgattctattctgtcatctccactctactactcaacctatccagcaatgttttcattcctgttattttgttttcttgttctataattctacttagttatttttaaaataacttttattttttgctgagattatgtatatttcacttcgttcaaaataagttcttaatgtattaatgaagcatttttataaaagctacttttaaacccttgtcagatatttccagtaattggttcattgcggtgttgacatcaattgattattttttttcatttaagttacaattttctccgttcttggtatagtaggtgattttctttttagttcccagacatttttcttattatgatagaagattcagagtcttgtttaaattagtcttgttaaagtctattttaagtcactcaccaagtttaggtttagcatgtggggcttggcctaatttttgtggactgtgatttaaatggcagggtattttcagtgcctatatttatttcagtcttactaagtttatctggagccactggtgctgcatgatggcacaaaatgggtttcccttagaccattctgtggatgttgcttggtggagccatcatgtggagcaattccattactgctgaacttcagttttcctgctgtacttagacagagctttcctggtgtccttggacagtccttggacaaggatggggaatcatgacaccacgaagtcaaacatgcttctggaccaggataactgttgtcaactctttccagacaacctgcctcagtagttcttagtgataaaggaagtctcataatttatgaagaagcagaatgcttctactgactgcttattcttggtgggactcccaagcaatatcccttggcaaagctgtcatgtttgcctgatgttttcagagacacttctgtttgaaatgggtaagctcatttctctgcaagaagctgagctgccttttgctgtcaggttgtgggacaggaaacactaggcctgggtagcctttttctgttggttcaggagatacaagataccctgctgctgacctatttctccagacctaaggctgcaaacaagcatgcctttttcatacctttcagaaatcacttacatttgtcccttgtgtgacttccagggtttataattgtacttgtcaggaaggaatagggaaaaatgagtgtatatcatcttatctgaactagaagtctagaacatatttcacacattgaattatcatatttaacagtgtgaaggtcttatttatcaaattatatcactgaaggggatttatacctgtatatttcatgcatggcttttaaaaaataaatggtacttacatatgctattacacacattataggtcagttatagtttatattagggttctacagaaaaacagaacctatagaatattaggggagagagagaaagagagagagggagagaaaaaaagggatcaatttatgggaattggtttacattgttaatggaggccaagaaatcccattatcttctgtctcaacattggaaccaggacagcttgcgatgtcattcaatacaagtaaaaagaactgagaatcaggagtgccaattttggagagcaagactgatggatgtcccatctatgacataaagaactcaccctttctccatctttttcttctatttggtctctcaattgattgtatggatcccacccatgttgaattaagtgctaatcccaaatactgatataaatactaatatcttctggaaatactctcacagacacattcagaaataacattttaccacctctctggacatcccttagcccagtcaggatgatacataaaattagtcaccactacaaagttagttatatttcatgatgcaatgctatttgtaggactatttcaaataaaacagaattcactagattgtagttgaatcttgataatttaacttgaaattttagagaggatattaattatttaattcataaataatcaaatatttttcaagagggtatttcaacttaagccacttttttagttgtagcatcttggaacttaagatatggaaaattatattaccaaacttaccatttttatacaggtgattccttcgcacatgtacagaagtttatctaatccttctcttcaaattgtatatctatagagattaatcctctcccagaatatattgaagctggagtcaggttatctaccctccttccataaccccttattctcagatcctctcttacctttcaggagtacagtacgaggaccttggtttttatttgttttattgtctatctttccaaaggctaagctgtacatattatatctgttctctgtccttctaagtttcactcattaaactcttcattttcttgtttctaatagcaacaaaatccacaattaattttacggtgtaaaaggcaactggaaagattgtattctaaaatttgtgtgagtaagccgtggtatgtttcactcctggcatccctggactatatctgatttcccataataaaatacagtgtacatttaataatgaaccttatgatcaccttagctctggggcaacaaatatttgcttctgatgcagttccaggaatattgataaaatgacttaaaaccctcttaatagattacagattgttccatacaactgctttaatggttatactacttattttgaaattagaaaaatgttaattactggtgactacattagtttagctctaggcttaaggtgggtaataagtgaaatatttttaccaaaaaaataacagccctgaatcactatctgaacttagattcctttatccaagttaagtactttgtctttagaagaaaacagcaaaatattggtagtagggtaggtgaagatttatagaattgcagggttttctgtcatagtagaaggaggaggaggagtattagctctagaagaacaggcattatcattcattgattacccagggtcagactctaatatcatcaaattatttcactgtcccaaatgccaagctataaaggctatgacaacaatggtaatatatttggaagaatcatgcttgctatctaacgtaatcacaaatgcctctgtgcctagtcgtctaaataacttgtccttcttctaaagtagaagtaaagttctaccatagctagtttatctttatggaggagtataaaaaatgttggtctgcactaatgtacagtttttttgtatgttatttataagtctatattctgatacttttttcatgctttttgcagttgtttaacaaataaagttgtcatcattcattagtgggtcagattgctttggtgcaatgacaatacttctaaaagccctgtaacataaaattacctttatttctaattgagttaggattctccagggaaattgaaccaaagtatatatggatcaacagatagatagatagaaagatggataggtaggtaagaggagatttactgtgggaatttgctcacatgattacggagactgagcagtcctaccatgtgctgtctgcaggctggagaaccaagaaagctggtggtgtcatttaaacctagtctgaaggcctggcaactaagccagccaacaatgtaactcctattccaagttcaaagacttgagaaccaggaaagctactggtgtaagttacgaagcctgaaggctcaacaaccaggagctctgaggtcggagggcaggagaagatgaacgccccagctctagaagagagagaaaaaattcacccttcctttgctttcattgttctatctagaccctcaaaagatgagatagtgcctgtccactctggggagggggatcttttttactctatctactaattcaaaaaaacattctcatagacacatctagaaatcatgttttatcagctctgtgggccttccttagactagtcaagttgacatgtaaaattaaccattatatcaatcaattaaaactcagaaacctaacaggttactgcttacctatcatcatatgtggtaaaaagaaatacatacattttaaatttggtaacattcttctaaaaagtagtctgttgtggaacactgtgtaataaagcaaaaatggaataagagctatggaaaggtggaaaaatgtcttactgaatttttcagagaattgacttacttcagctagtgtaaatgaataagtaaatccatttcttttcctcctatttctgtcacatttcttgtgagaatctgattcacattcggagtttgaaatggaaaataaaaatagagcactgtttgtgtcagataattactttccaaattctgtaactgaaagccagttgggactggaactgtgtttttgttcctgtgaaacagaaattctgtcatgtgcagctacaggatttgactgatattgctagaagttacctttccactcagcgagcatgagtgactagttcatccagttacaagtgatgagaaagctgctaaaggaaagatatttccagaaagttaacatatccttacataatacaattatatatgtaatacatttcttattttgaatttgcatacaactttatcaagagaaatcttttttctttctgcccctactaaatatgtgctgaacagatgtgtgtgtgtgtgtgtgtgtgtgtgtgtgtgtgtttaaaagtcgaattgcaagaatatcattaggtttcctaggagcccacacatctgtgttccgtgagtacctgctcagtgtcatgtctctggaattttacacatattaatatttactaccacacgcactgccactctcattttcaaatgaggaagccaactctttagatgtgctctggtgccgactgaaagatttatgtttctaatctcaaactctttcatgagcttctgattcctgtagttaagatagacagtatacatacttggaggctttgctgcaatctcaaaattaacctgaacaaaactggactctaagtctcttcccagtgactcatatctggtttccccacagcctcttcttttcagtaattacccttccatccagcaggtgttcaagtaacacacctgagaatcgttcttgacacctccttcatgctcacctctccctaaacccactctgttagtgagtcttgtcagctcctcatctgaaatgtatctcaagtctgtctggttcttttcaaccttctccactctaatttatttgccatcatttttcacctgaaacactgcaataggctcttaattggtatcccctttcccctgtgcaccgtataaactcttccttatccagcatccagattgatcctttataaacagatacctggtcttgtcattctagcacttaaaatccttcagaggcttccaagtgcatctagattaaactccaaatcctcaacacagatgaagcaacatgaaccactactccttttagcttttacagctctactttctctttatctcttctcatagacactcctactgttactttatagaatttaccaaattcatattttaattatctatgtgtcagcagctggattcatcactagattctaaatcgcttaaatgcacatacaatatacctttcgttcatcattatgccactgtatagacagcaaatagccaagcactcgcacatagtatataatctaaaaatcattaaatatataaaggaaggaaggagtgaaacaatttcaaaatttatacatgcagtaataaaaaatcagaattgaaagtgcatccttgtctccattgtttgtgatgtcatcccttatagtatgttgactaggaaagtttaagaagattagatttttggaaaactagaaaggtttagagagaagcataaaaaagtctcttgatagcaggggtgttatgagcatataatgagcccatgaaggagcttgaaatagtcgaaaccaaatatagtgcaatgagtcctgtgatggggacatttatatatgtggtatatttatatatgtggggacatttatgtatgatggtatatttatatatgtattacatgtacaaatgaataataacgatggtaattatgtttacttgtgatatataaaactgtatatattatttacatacacattatattatgtataaaatgtatacaatatatacacctgtattatatactgtatattcatttattattcatatatgtaattactactattgcttattgtttttactcacattgctaatttataactctagatagagctttgaaacaagtactactattggcaaacatcaattctaagacaataacttcagcagttcaaagagtgggaaaaggccagtgagcttgtgctttttctataatttttacatatatttatttgcaatagaagttcatattgtcttctcttcttgcctatttgtcaactttatattcttaataattgacgtattttttgtcatcatcaaagggatattgcaagcactttttattttgttttgtctataagatgtagccaagttctattgacttatttttctgtttccttgacttttggtttctacttgattaatggctgcggaacatggaagaactgaaattataaatttgagttattacttcagttataaattattaacagtcacttctagtctaacatttgttgagtaattatcatatgcaaggcattattctaattccttcatatgcattaattcatatctatctcattgaaacactttgagggatgtagtactattatttttactttacagataaaataactgacgcccagtaaggttaagtaacttgcctaaggtcgtacaacttacaaagaaaacagtcagcttttgcagacatggtgtagcttcacagccctaggagattaatattttgtaaaggcaattgccctgtgacaattagtggggaaagaacaatcatcatttcaactttacaacactccagactgttcccttagatgcttgaactccagtgagaatacagaaaggtggagaagatggcatgcatgcttcatgtataggcggctcttccctcaaaaacaagctctttgcccttgaatgcaaatttactgacaccccaaaaacaatcccctatcgctaactaataaggcagcaactgctaaaaccagagttagggaaaatagaagagaaaggccatggtgaatgctgggatatgaatctatttaaaaaatcaattcctaagggttcaaacctcctttaacaacaagtcaccatttcaaattgttactataatgtattggtatttaatgccattcatgtaaaggagggcataatccttcattaacaccattgaatgttttggatattttcattatataaaattatgtgtcttctataacttgagtactggacatcaatcttgtcaatgatagaacactaatatgtaatctggtaagaagcccaccctatgaaagccaataggacatatgagatggatctcataggcagacatgctaagggcaagtttgagtggatatacattatggcaaattaacagcatccgtttcatagtcaagtgaaatatgcaactagcccagaatatattcttagattaaaatgttgtaagaacctcacattccatcaactacatgtattttttaattcctttctcattaaacacttgaagtctctttatcatgtggaaactaatgatataaatgaattagctgacacaaatgtcaacaaatcttttgcatgaatgaattctctttttttgtttcaagttatctccatcattaccatcttgaaaagtcagtctatgtgtgcttcatgtagaaaaattccaacatttactgtaattgcttaattaccagttctcagcaccttaataataacaggacatttgaggatttgcaaataacaacaatgtctaatttttcagctgcttattcacaccctattataagcaaaatggcaaacacatgcaacaggttttcccatcagcattagttaattttaggcagaggtttttatagatccaacaaagtaagaaagagaaagagaaagaaaagggggagaatactttccacaatctggtaaatattaataggtgctattatttttattatccaataaaaataaatattacttatctgatatacttctgaaggagttaattattctttcttcagtggttttataagtatatatagacatgtatacttatatatacatgtaaacatatatatatatatatataactgtaaattactgctattcattggacacttggtgctggcgtcttacatccattatttttttaaattctatcttggattttcatctgattttgcttttgtacttggtttctctctcttcttgcttgatttgtttactttgtttagttgtttatttatgtctcatgattaacttttatcttttctgtttgttatgtggtcttagatccaagcttgggtcacaatagcttagtcttcttatatgcacatgtaccttcctatggaaacacatgcatatagtttcagataactataaaaataatgctgttttatattaaaagattaaaagacttgctcatacattaaacaatttttttttttttgaaacagtctcgctctgttgcccaggctggattgcaatggtgtggtctaggttcactgcaacctctgcctcccaggttcaagcgattctcctgcctcagcctccctagtagctgggactacaggtgcgcaccaccacgcccggctaattttgtatttttagtagagacagggtttcactttgttgaccacgctggtctcaaactcttgacattgtgatccacctgccttggctctgccaggcactgtcctaatttgatatgtacaaaaataaaatgactctgagttcaggccaaggcaaagatatctcagagttgtggcatagttgtgaagagacagctagctctccacaaagattcttcttcctttctatagaggtaccttctcagcgggcatttcccagtcctacttctagttgtatcagtttctctcaaatatcccgtctgtaggggatcttgtcctctctcatttctttctttggcttgtgaagtttagttttcagcgaagggtctggacatcctagaggttagcaatactgccaacgtggaggcagttggaacagaatccattactgtacaaccccagagcccctaccccaacacccccccagccatgcctagcacacagacactggactttgtgtaaattagaagaactaaagaatggctttctggtggtaacctactaagattctaggattttctctaggtgcacattaatactgtgtccaatgtaaaatgtgtggttaagtgtcaggtcaatgaagagtgtggtgaggacatggaagaattagagttcaaatatatattatcaggaacattgaaggatgatgctttagaacaagtgaaagcctattctatgatattatttttatcttttaggtatagtactctgtatattcaaggaagctgattgaagatatagatcaatatcttgtagagctgatttatccatattgggatagcagccttaaagctcattaataaattagaaaataatattttcacttcagtagtttagcctaaaaatggaggtgaagcaattactttatttctctaaaaccaaatacaaagtaaactaacatatcaaatagcaagtttggggtgcactgcttttagaaataaaaaaattgaatattcattattgttgagttattggactttactgaaatacaaaaccagaaattgagaggcattattgctgagtttctggacttaaatataaaattattcattattgctgaatagaaatgtgagaactatgttagtgatggcatgctaccatataaagatttctattcatgctattcattttcatatcataagtaatatatgcattcattgtaggaatgtttttaaattgcagaaataaaatgaaataataatttgtaaatcaccttttgtaccatttcagaaatatgtctcgttactgtaatcctcctgctgcttcaaagttcaatagttggcctaattttatttttaccatcacttcccttgtctctttttaatcagtcattcaatttaataaacatttactgaacatgtaaattaaattagttttagtctttcaagattttaacaataactaccatttattcagtgtctactacagcctaagataagtgtttttatgtattatatacattttattttatatgtcaccttatttaatcttcatgaaacctctatgatctacctattttattctgcattttacagatgcatgcatatatatatatatatatatatatatatatatatatatatatatattttttttttttttttttttttttttgagacagagttttgctcttgttgccgaggctggaatgcaatggcatgatctcggcttactgcaacctccgcctcatgagttcaagcgattctcctgccttagcctcctgagtagctggaattacaggcatgcaccaccatgcctggctaattttttgtatttttagtagagacggggtttctccatgttggttaggctgatctcgaactcccaaccccaggtgatctgcccgcctcggcctcccaaagtgctgggattgcaggtatgagccaccgcgcctggcctacagatgcatatattgagtggctactatgtgctgggcagtgtactaattgtgtaattagctttatgtccctcaacctgaaaaatattatgtgatggatcagtcctgaaagctagagacatgtattcatttaacaaatatttattatctcatattctatgacagataccattcttttgtagactaaaaactcaaactccataaaatatttaaagaggtttacgttcagccaatatgagtgactatgtacccaggaatagtctcaagaagtcctgagaatgtgtgcctgaggtggttgggttacagtttggttttatatattacagagaggaagaagaaaggcatgacatctccaggctccaggactgggggacagaagcttacaggtcattggtggattctaagattttctcattgatagttggttgaatgagttaagatttgtgtaaagacttgaagtcagtagaaaaaaattgcttgaggtaagataaggtgggttgtggaagccaaggttcttcttatgtggatgaagcctccaggtagcaggcttcatagagaatagatggtaaatgtgtctttttagattttaaaaggtgtcagactcctagttagtctctcctagatccaagaaaggccaagaatatttgcaagctctaaaaaatgaagtaagattactttgctaggttttaaatgtggaatataaattgggaattacctgcgagagctattttgcagtatttaataaagttatagattctcatgttctataatgtacttgtaagaaaaaaatcacatgtacacaagaatgaatgcataaaaaatttcaagcattgttttatagcaaaaaaattgaaacaaagaaaaggagatggaattttaaaaaagtggcatgcctgtgtaatagaatgttatataatagtcttgttacagcaaagatcatatctaagagtctaattttcatgtctcaacatgcccaatatcggaaagatagtgttaactaaaaatttcaagttgcagaaagagctactttgccagatcatggtaagaggatttcttgttttctagaacataagaatctaacttttctagatgattccaagttatcatctgttctacaagttttgaacatactcataaactgtttgaatttttccctcttcttatttttgtgtatatttttattcatttaactgtattgtaatatttaaaaaacataggctatacatttctaaaagcacaattttgctcaaaaagttgtccagttttttgcacatggcatataactaaaatgtattaaatgaattatggaatgaagaaatgaatttacttttttgtacaaaattttaaaataaaatgtttttactcatctataaaatgaagaaaataatatctacctatgggatttttgtatataaagggcagaggaatgtatcaggtacagagtaggcattcagtaaataatacagggcattttaatgttggtaatataatttaaagtgtgtagtagccactactagtcatgaagagtttgtatgagtcccatgttcctatagtaaatgttttcttgtcttatagaatataaatgagaattaatagttagtactcaatgtcagacattgtattaatgtttcaggataatcataacacatggagatgagactccacctcatagcaagccccaacgaaagacacaaattgttccttagaaaatgtagggagggaagagggtagaaactacaaaccacatatgtccccatgtggtgacagaggtttccttgggagaaggaatgtttggctttatcatccaggaattcctggttgaaataagtttagaatataacagcaatcactagtatgctcaggtgactatgagatgcagttatttaaactcctgtcaggcacatttttctcacttttgatgtttgaaagcagaaaaatgtaatatattaaaatggaaatatatgagttttataaatattaattgatgtccttcattattttattctgtttgatccattctttccacatccacagctctctgcagaacccatttcagagaggttaagagacttcttatctaattgtaccttattaatatttggtggaactgggatgtgaaaagaagcctatcacaatctcaagttcatgttctttccactgctgtatcttgcctcgtgttacataatagtgcggcagattaatttctaattgtgacacatggaccagcaaaaaggctttatcaggatttgttcatgttaattaggcagaaacaaagttaatgcagcttagagcagcaaagaactttcattcaaatacattttacatctgtgaaacagatgtcatatttaaaagtctcagactacacaaagtattaaacttctcccaagggtagagagacatttggtgaaatcaaatactttatatccacaaatattgatatattattgctttgtgtaggccacacaaaataaaaatctagtcctcattagcttttctgatatactgagtaatgtcttaagttgtagaaagatttagaatgtcttctccatgcagagtttttatcaaaacaagaagaaacatttacatcatgagcagtggaatttggccaagcatacctaagaattagggagtattgctatcattctcattttacagtgcaggagacaaatcagagtctaagcaactccttccaaatcacagcataaataagtctaagtgcgctcatgtaaatgcagatattctgccaccaaaattaggctcctaatcaccatcgtgctgccctgactccattgtagactaatttttccttaagtatacgtcttttcattacatacatttgaatttgcttttctccacatcacaatccaccaagccacactacaccacacaggaaaatcccttttgccttactcctctctgtggaaaagtgtgatatggtttggctctgtgtccccatgcaaatctcactgtgaattgtaatctccataatccccacgtgtcaagggcggaaccaggtggaggtagttgaatcatggggctgttttctcccatgctcccctcatgataatgagtgggtctcaggagatctgatggtttcataagtgtctggcatttcccctgcttgcactcattctctctcctgccaccctgtgaagaggtgccttccaccatgattgtgagtctcctgaggcctccccagacatgtggaactatgagtaaattaaacgtctttcctttataaatcacccagtctctggcagtactatataaaagtgtgaaaataaattaatacaggtgtgtttgcttttttttatttttgcatccatatatccctattatatcccatgttagtctaacacttaaattgaaaatagattttttggccagaatatatatttttctttccagaaaataaatgattataaagccaaaggggaaattgatttactggataatagaaatatgatatccatatatgttaattaaggatgcctttgacacagcagaaattatccaaaaattatggatgtcaaaaacttaatgttttctctcacttttcattcaagacaagggactgccaccaatcttcccttctccattattattgtgttttccatttccacctgaaattctctctggactcagactattgtgagtgtttaatttgtatgctagaaactctaacgttgagagagaaaaaaatatgaaaataccaaatcatttaataatcattctttactcagtaataaaatcttatgttaaagtggtttcagtaaaatatagttttatataataaaaaaacccccacaagattagttagaacttattcctcaataattttaactcttacatagtgcctggttttgggaaatttcaatactgcttacacctgctctttgttgttttctcttttgttatgattataattaatctttcaaggagtacacttgtaggtcatacacatatttccattttctaatatcttttgtagggctagtggtacatttttttttgtacttacatgtaaattttaaatgagtgttttttttctatgtgattttatttcatacaggaattgagaaaattaaaaatgtcaatactcttacaattgcattcatctttgatgattgcaaataatttgctgtttttttctttgcaataacaatattcactttatgtatgctaatgaatgatacatgatttacttttggactatgggcctatatttagccataattaatatcgtgaaaaatattagtgaacaaacttttaattgtagttttaaattggttatggaaataaatctggccttacgcatattagattcattggaataacacatttatttgtgagtttttctttgcttctacaggcgttttaaatatttgacttgctgtatttaatttcatattattctataggaaaccacttcagcaggccttatttgatcacctgtggcattattctttgctaagaagtataggctcctttcttagtgttacaacagtttccattaccaaacctttgtccaaagccaatagaaaatctgacttgaaagtaaggaggcattattaaaaatctgaaaattgtggccatatacaaaagttaaaggagggaaaaaatataataaaactagaggaaaatataaatacattttgtctctagtgaatttgcagctggtattggaaaatcattttgctctcagggaaggttttgaagcagaaatgaaaaaagaatcaacatgaaccaggctgtgatgttctgctgtctgggagattagataaccaagggggaaacaaaagtgtctagaagcagtgtaaaggatttccaaaatattttttttcttgtccttttttgttcctaatttagactaaacagatatatttaaatattttgtgaacaataatgtagaagaaagtgacagtaggatacaatgtattgataaaatcaaaacataaaattaacatgtgaaagtaagtgagatgctgattttacaaagaatggaaaaatggtgtcaggaaagatactggcataataaggactcttttctgtctcttatcgacaaggaaatacatagacaattagatttatacagttaggttcaagatctaatacagcaggtaagtttgtatccataaccgtgtttagttaaatgatgaatactttctgtatttgtgaaggtggaggtgctgtataaagacatgaatgacttcagttgaagttatgcactcttctgtggatggagctcactatatggaataaacagatactgccctattctaagaaggttctaatgaagggtacattaagctaagaaggttacataaggaaagacattaacaggcccttcctacatacttgccaagaatgcctgaattcttagcatgatatataattttaaaattcacattgttatatggaagcatgtattaattcatatattattcatataaaatggactaaacttgttagtctatgtcttattttgaggccaaatgaacatgggttcaaatatgagccacttgttattggctatttgaccctgatgagagactgctagtcgtacccaaagtctcatcgccaactgttgaacattttagtaataacatcttctacacacttgtctgtaaagaagccctatgcagccttctatgtagctgtgtataaccatgaccaaattttacccactgggatgttggtgtaagtaagatgtgcaactttggtacaggacattaagaaaaaaactgtggcgaattctgaattccttccactttgtccctgtttctttttctccctcttggctggaacagagcaaaatcagcaaagaaagtcctacatccaaacatggaagccatgaattgaggatagcagatctgccttggtaacaatagattgcttaccactgctctctaatgagagaaagaattcagcttcgattgtattttactgtctatttgttacaataatttattctccacttaaaacaataaactaactcaattttcttaatgtctccactattaggtttcttcattagaaaaaataaaagataaaaccaatttacagtgttgcaatagttaatctgggacattattcaacttatattcagtgattattctataaaattaatattatagatgtacacattgtagaatccttaatgtgagtctctgtctgctattaacttgttgtcctacctcgatcagattattgatctttccatagtctcagttttccctctattaaatggcatagtatctacctcatgtattaatataaaaatttttaaagtattctcacatatattattaaacttattttatataatgcaaactgtattttattcctagccaggtggatgaaatcttgtgtgtgtgcagagacatcatttgtgaaagagagttttgaatatccttcctggccagtaaacgaagccagcatcagatctagtgcaaggaggaggtatctgagcataatacatgtagaaaaaggaaacaggggctgcagagctaggctaaatttcctcatattctcctgtccagggatgagatatcagcatgaggagatgggctcctattggctatccaattcatgaaggaacagggaaagccttaaatttttttttattatggttttgtggtgtccactgtattttttgggtctccatccaaaattgttcattagtttgactttgcacaataagaagagtccatatcacatggtgacagtttcctgagtcttgttttaaggctggtaaagaggaaaaccagagattatttatgtagtaggtctatctttctaattttgtttatttgttactaggatacagagatacagagataaaatcatttttcatcttgattatgtattccatcatctggctaaggtcatttataagttcatatagtatttttgtagattgaatacaatttttacataggcagtagtatttgtgaattcaggtagttctgtttcttcttgtctgataaagacactgttaattcatctttcgttttaatttcttggctaaaacttccatcaaaatatgaaatacaagaggtgaaagcagatatctttgttgtgtttcagatattggctgcggggagggaagttcagtctcccatatttaatcatgtaggttcaatgtagttttttcatagatgccctttttcaggttaattatgttctgtgttgtttctactttgtagtttttgtaacaaatggagttgggtttggcaaaggtgttttgtgtctattgagatttttgtgggggaaagtttaaactataaattgatttcgtaataaatacagggctattcaggttatctttttcttcttgattaaaatttaataatttgggattttcaaggaatttgattcatctgatttgttgaatttattagcataaagctattcatattattctcttattgcctttttactacttatagaaatttaatgatctttcttctctcccattcctaatagtcataatttatgttctttgtttctcctgatctgtctggcaaaagttctattcattttagtaattttaattattttctcaaataatcttcataaaagcacccaggcattctgaaaaatttcaggtataaaactagcttactttgaaaatatcggagaaacttaagatcaatctccatgacaacttaaggctgtaagatatttatttggcaattctttacctacttcttctttgatcaaggatgaacggaactttcatctcaaggctagtttgttctaattcatctgcaagaatgccaacaatttaggccctaattctttttcaaacgtagtgcctgattcttcacaagcacagtgtggccggccaactgtgtgaatctttcttctgttggttgtctcaggttatttagacagtttgctttactggcataacaatccatctgagctctatgtataattgctaacctacccaaactggattgccttccatctgttatcttgtgtcgttgttaacatgcattgaggagagagaggcaaacaaaattcaggaatacatataaacttgtctttgctttgtatttgcattttcttttttcttttatttttgagacagagtttcactcttgttgcccaggctggagtggaatgatgcgatctcggctcactgcaacctctgcctcccaggttcaagcaattcttgtgcctcaggctcctgcatagctgggattacaggcatgtgccatcacgcctggctaatttttgtatttttagtagagacagggttttaccatgttggacatgctggtcttgaactcctgacctcaactgatccatccacctcggcttcccaaagtgctgagattacaggtgtgagccatatatttgcattttctttctcaacacttgtataaaaacatacgagactcaagcattatgttgtgtaatatttcattgtaaaatacttgtttttgttactggacataatgatgagtgatttactggcatttcattttatccctattactactttcactattagttcttattatttctacttttcaaatgagaaaaccaaaacttatggaacatttacattgttcagtgttacaaagataccacactccaaagctcccacttatatagtcttatttcactatggtgccactcaactaaaaaaatgtgtataacagtcatttgaataagagaagtctatgggcttacttttgttaatataatccaatggttttatatctactcattttctaaaacaacccactgtcaatgtatgacactgtcattacgccttttttcctcccattttaatttgatcatagtactatcattgctccctgtatgaatttattttctcctcttttacttcctccctacattcatccctctttctttccatcctcttcctcctctttcttcaatactgagtgcctgtaaatacataatttgcataaagaattaaacagaccgttatcaatgctttgaatctcttcctgtattcccactcttgccaattgtcctccttgcataaagaatgtatctcttaaaatctgaaatataatgttgtagtgactgcccaaaataagaaaccttttgagtaggtggaaaagaaaacgtgcatttgtcctccttagatcctaacaattatgaccataatgtttaagtttactctaattttctttattgtgtcaaatctgctgtttaatccattcactaaaattttgatccccttaatatttattattccaagatagtatttttttcaaatttctcctcattcttgatggtttcctattgtttgagcatcttgttaattgcatccattatttctctgataattttgtgtacagtataattttctttagttttattgtacatctgcatttttgttgatcaaaatcagtggtttctcacttcgtttccccttatcataataattgccatcctcccatccagatattcctgcccatgctccaaaatttatgaactctagcttatgagttctcaacttcattctcccttaccatggcctttgttttcatgtgtttctaatctgttttattgcaaagacagccttaattttcatgtgtagtattcctgtaggccttatttgtcttatattgctgatgtacatctgcctcagctactgatatagcttggatatttgtctccgtctaaatctcatgttgaattgtaatcctcaatgatggaagtggtgcctggtaggtggtgtttggatcacagggcagatccctcatggcttagtgctgttttactgatagtgagttctcctgaaatctggtcatttaaaagtgtgtggcatctcccccccactgtctttctctcgctcctgcttttactctgtgaggtgtctgctcctgcctcaccttccgcaacaactgtaaacctcttgatgcatccacagaagcagattccgcatccacagtaacagattccgcatccacagaagcagattcctctatgcttcctgtacagcctgtggaaccaggagcgattaaatatcttttcctataaattaccccgtctcaggtatttctttatagcaatgcaagaatggcctaagacagctggtaaaggacatgttcctgtctctggactactttcaatcaactctttctccaatgttggtagcgagctagtagcgtaaatattccaagcatcctcatcttcaccatggcttgtcatggaaaaccacctgcttttccagtatggtgcattgcccccactggctatttgcttttcccattcactgctgcccctgctgggacttccagcttcttcagctttggctctgaagggttcctgtcttggtcaatttgggctcttataacaaagtaccatagactgggtggtttattaacagaaataattatttctcatggttctggaggttgaaagtccaacatcagggtattgcgtggtccgttgggttctgttgtaggtccttttctgaattgtagactgccaacttacacttgtatactctcccatggcagtcttggcctttttttttttttttttttttttttttttttttttttttttgagacagagtcttgctctgtcactcaggctgtagtgcaatggtgtgatctttgcttcctgcaactccacttcaattctcctgtctcagcctccctagtagctgggactataggtgcataccaccccacacggctaatttttgtatttttagtggagatggggtttcaccatattggtgaggctggtctcgaattcctgacctgaggtgatccgcccgcctcagcctcccaaagtgctgggattacaggcgtgagccactgcgcccagactgaggtccctttcataagcgtgcttatcccattcatgagggctccatttctacctaatatcagtatttccccttactatgatttatttatttattttattttattttattttaattttattttatttttgacaaggtttcagttttttgcccaggctggagtgctgtggcacggttatgctcacttcagcctccaccactagggctcaagttatcctcctgcctctgccttctgaacagttgggactataggcatgagccactatgcccagccccccttaatataaattttaagggggcacaaatattcagtccataatagttgtcaccctgccacccaggtatttctgcccaggctccaaaatttgtgagccctagcttctgagctctaaaatgtaggtgtttatctatgctagctttttcatcacctcttcagtgcaccaaacccatgttattttggagtaaatctcaaagaccagtaatatgtccaaaagtgattaataccctggatctagctatatagagaaatagtagagtccctcagaattctccagaaggtgcttctttgtttttcccattctttccttttcataggtgtatgtgtttatcttctcttttcataaatgtttatgattccaagtttttaaatgtgttcttggtgttcccacctgtttttcttttaactttaactgcaatatgtgaatccttttaggttttatagttcatgtcttttattttctgatgtctcatttatgtgtcaactgcacacatccactgaatttacaggtagctcaaaactcagttttccccaactatcattatgtttatatcatcttctatttttaaactctcacttacattttagtgtcttctatattacctttagcctataaaagataccacctcctcagtctctcagatagtaaacaaattgccattcttgatacttccttgactcaactacttccttatgtcctaaaatcaatgtttctaatttcttaaataaaatgcctatttattttctctttaatgtgctcctgaataggattcacttttctttagtctcctctgaactgtgaggttttctccatgcttgccccttgtaagtcaaattacaatttgttttacctttctaaagttcaattttgcttctgctatatccctctcttttcatctctatttttagattaaaataattgcatggatatatcttttttaaataaaaactttaaactacaaagcatgccattcaagggactgagctctacttaccttttcagacttctgatgtgatcttgttctgaatgatattccatttgtctttggatttccacgtatttttatatggtatagtcctaaatagtatttgcagttagttggttcttagtaactgttcactatatagctgctaaaatatgaaacagagataagaatccctttatttatcctatgattatgtatgtaggtaatatctatataaaattatatcagaaacattatgaatatgaatatcagaagataaatataagacccttataaatatcacacaataattcaccagctcttaattattgatgtttacttaagaagggacatatacataatgtttaatcttaattttggtcatttagtatataaccaatgcagaagatgcaaaaatgtatttacagttttgtacacttagacttatcagtcattatgcctgtgcatacataataatgttgtttggctaaattataagagcccaggctctgacattactgtggttcaaatctacattctattacttagcagctttgtgatcttgggcaaatttattgacaacaataagattcagtttcttaatttaaaaatatgagtataataatacttcaaagtggtactaaaactattaatgttttagcaggatatctgacaaaattaaaacaacataatggtatcatctgacagttctggaagtcacaatttctggaatcaaggtgtggacagggctgcttttcttttggagactctaaaggagattctgttttttttcagcttttagaagcctgaattccttctcttgtaacccattttccagctttaaagcaagtattataacatcttcaactctttctctctctctcactgacacttgcttatgtcttcacaggtttcttctggctctcctgcctccccttttctcttataacaactcttgggattttattgggcatatctggataatccagattaactctccttaaattactcacatcagcaaagcctattctccatgcaaaataacatattgacaagttctgtagattaagacatggatatttttgaggaggtggtaatattgtaaatgcaaaacaagtattttgggctgtgggtaggaaaaagagtgacaatcaggccctgaagtttgtttgggatattaagtaattattttttaacgacaggagagtaaaaagtgttcgatcatcttagagaaaaattctgtcagtggttcccaaaaacatatagaatggaaaataatttgcacattcattagtaagctataaaaataccacaatccttttttgaatgtaaatttcttcatcttgattttatagaggtacattttgcattaataagtatataatgtggagacatttgaaaactttataaactgtcccaaatgaagtaaagaatatattgcagttaattggtacactcctgcccctgacaactgcctatttgatttctctaactacagcttagtttcgtttggcctataaatgtatacaaatggagccaaagtcgatgtgtttttttgagttcagcttacttaattcagcatactattttgagatacatccaaacgcctcactagtgaatttattatttccccaatactcagtggcttaaaacaacaaacattccttatctcacagtttctgtgagtcaggaattcagtcatggcttagctgagtgcctctgtttcaggaactctcatggctgtgatcaaggtgttagctggggttgcaatcatttcaagacaaaattttgtggaaaatctccttccaagatacctgtgtgtctctgggcaggcctcaggttcatgttggctgtggactggagtcatcagttttcttgccacgtgagcctctccttagggcttctcatgcatggcagctttctgccctgagtgagggctccaagatagagagcaacaaagagtgatagatgataagagggagtaagcatgacagaagccaatatcattttataacctatatttccaagtgacatccatcacttttatcttattacaaggagtcgctatgtcccacccaaactcaaaaagacgacattacacaagggtgtaaatgacaggagacagtacacattagaggtaattccaatagctgcctaccagagactgccctctgacacctcagtgattcatgtttctctcacaaaatacacttctcttcacccaagtaccccaaaagtatcatcccattatagtgttatctcaaagtccagaatctcatgatctatttcaagcccaggtgttgatgtgtccatttttaactggactaattgcctttttgttgagttgtgctgtttataaattctagatatttaagcccatgtccttgtatatagtttctcttcatctgtagttctgtgaagctacaaagaaatgttatttgccccccaaaatacaaaatgcaatgctgatacaagcatagaaaaatgaatacagctattccttttcaaaaacagcaaaatggcagacacaaaagagtacatagcaattctgaaattcagccagagaaatattagaagttccttgattagggctcaaggcctaggaataattttcatgactacactctgtggactttttttttctgcagtctgtcttggtcttccttttctttttttcctttttttttggcatggaaagtttggatggatttgcaactgaatagttttcttagctggcatactgccattagaattctggggatagaataatctctttgtttctgttaaattatattgtcacattaaattaaattttaaattacattagaaaactatgttaaaattcaggttatagttacatgtgtggggatacatttttggactaatctgtccctttaatctgaatgtctatattttatactaatgtaattttcttgtgagacctgaaatcaagtactgttaatctgctgattatgtttttttttcaaactgtttgacaattataggtcatttccattttcatgtatcttttagaatcagcttgttaatttctttaaaaagtcccttgttatattaattggaatttcacatactttatgagtgaatttcagggaaaatatatgtgtaatattttgagaaattgacaaatgcttatcaaaatggctacaccactttacaatctatctgcaatatataatgttttaatttttccttacccttgccactacttatgtcttttaaaaactttagctctcctaatgactgtgaagtggcaacccattgtggttttcatttacatttctgtaatgactaatgatgttgattatctttatttattgtttacatatcttcttttgagaagtgtgtactcaaattctgcattcctttttaattaggctatttgccttattgttgagttgtgctacttataaattctagatactagatccttatcagatataataatttgtacatactgtctcccactctgtgagtcgtactttcacttttttggtagcacattttgaagcacaacagttttaatgtatataatttatctatatttttatttgtccatgcttttgacatcatagttacaaaacattgcttattctaatgttgtaaagatttacatttgtgtttcattttaagagttttattgttttatctattacatttaggcttttgatttacttccagttaacttttgcttataaggtgttggaatacaacttttcagcctatagaactgtctttagtatttctggagggcagatctactagcaaaaaatttctcagtagttgtttatctaggaacattgtaatttctccatcatttttaacagctagtttgctagatattgaactttagttgatagtagttttctttcagcatgttgaatatataatccaactccctcctagcttctgtggttttttattagaaatcagctgttcaatgtcttgcaggtaacaagattcttttctcttgctactttcaggattctggctttgttttgtcttctaggagtttgatagcaatgtatatcaatatgaatcccttttagtttatgctacttgaggttcattgagctactggaatgtagatttatggtttctatcaaatagagaaagttttgcggctttatatcttcaagtgttctttctgtctccttttctctctctatttctgtgactcccattatccatatgttcttaggcttggtggtatcttatatgctgtttatttttttgtcattctttttcctttctctttattagactgaataatctcaattgacctcttgtcaatgttgctgtttctttcttctgccttcttttaaatctgttgttgtgcccttctagtaagttttcaatttccattattatacttttctttttcagatatgttagttgtgtcttataatgtttattttgttattgattttttctattttgtgagatattgtctttatacttctattataaatattataatgtggcaaatctggaaatcaggttctcccctctctatggtgtttgttgttgctgccatttgttgttattgttgttgttaataagttttctgcaatagttttgtaaaatctttatttctggttgtatttgcttgtggaagtctcagcttgccttaattatcagtgagttaatgatttgacagagatttttaaatatctggaaccaatatatatattaacatttactatggggcagcgttgtatatgttgaggtataccttcaacactcagctggaaagtttacaactccacctttgtcatacatttctgcttgcaaagaccccaagtttaactagaagttagatctatgttctttgtatgtcttttaaactttaattacttctccagatatttgcaaaatctacaaatgcatgtgacttctagattttctgaaatatgtcagagctttgaaatttccttataaatctctaattccctagcttttccttttaagcttttttagttattctattgtttgttttgttattcaccatttcaggcagctttgctattcaagaatttcctctgattgtttctgaaaaacctctgtggtaaaagctatttgcattaggtaaattctgagtcagaacaaataacaacaaacttgagagtggggtcttccgaggaaccatcagagttcacataattagaattttaggggtatgtagcttgaaggaactccagctcaattctgttccctccagtggctaccaggctgctgattttgaccttgatttgtggatcttggttttcaaggctgcagtggaggtggagggaggggaatagagcaaattaacataactcaaagctcattgttgaagatatgaagattcagacatttttcttatatacatttttctttcttatatacatttctttctcatatacatttttcttctatacatccctggaatgctgcaagattttggtcaatttcccaagtttggaaacagttacttattacaatttttggcagtattttcattgctttaatggaagaaataatttggaggttgtttttccaccatttctactgaagtctccatacaattatatataatatgatgatttataagacttggtagatgtctacaatattgtttttattttaattgtgtcccctctgtttttgttttctaatgtttctttctgctttatcttggtttattcaaatactttcattattctgttttaatttctctatgactttttcagttatgcatcactttatttattcaaatgctaataatatccattaataaaataatatattgaagtatatttggagtaaatattgtaccacttctcatctgatactttatatttgctaggctatttcctttgcttatttccttcatgacgttttctactaatttttcctttacccttcaagcctccttattcgcaactactctgcttttatgacaatataattacaattacctatcccttccattttttctacgtttgtcatacgtattatttgtgaccttataaaacccagcttataatgttattatttttgcttttaatagtaggttgtctgtttaaattgagatttacaaaaaaacacattttttatattgatctcttgactgactttagaattccactgagccaagttttctcctggtattattttaatatttttacacatttttgtgttttttaaatttttgtttacttatttgatatgccttattgaaattaataataaaattttcaattatcatattttatttttaataatatttattaaaaatcagatgtgcatggttactggagttatgaaaatgaatgaaatttggctcctcccctcaatgagagtgaagttggaaagatgaaacctttaaaagaaaagatagtataatagggaagtattgaatgacaaggcattctttggcatcagaatggagtggcagcttattacaatgagaagttcagaagcaacttcacagaggatggaaaaccactaaaatccgggcagataaatagaaactatctagtttgaaggggattagatgtggatgggttggcacttttaaagccagattatacagtttagtttgctgaaattcagagtgaatgagccaaatgattctgtgagaaacctagacaggcatcagatcaagatgccttccttctgagactgtggggaagctctcaaatattttatgcagaaaaggatcaaactccaatttcagaaataacacattgacaagcagggtgaatggactggatggagagatgaacaggaacagaggtaatgagaccacttacaggataagtacgacaatctaagtaagaaagtatgatgtatgaatgaacccagtggtaactgtgatggagagaaggggtggatttgggagacttctaagaagaaagaatcacaaacactttgaaagcttatagtgaggagaaatgatgaaagaaaaatcgatattaaccataaaatttcaatcttgggttactgagagaagagtaagaaagtgccagcttcttactctgatacatacaagagaagatacagaatgagttcagactcgtaagtgaatactttggactttacgattgaaaaagttctgggtcgggcacgatggctgacgcctgtgatcccagcaatttgggagactgggacaggcagatcgcctgaggtcaggagtttgagaccagtctgaccaacatggtgaaaccctgtccctactaaatatacaaaaatagccgggtgtggtggtgggcacctgtaatcccagctactcgggaggctgaggcaggagaattgcttgaacctgggaggccgaggttgcagtgagccgagttcatgtcattgcactccagcctgggtggcagagcgagactctgtctcaaaagaaaaaaaaaaatgttttttgaataaaatttccatttttaatgaacttaactgtgaaaagaatttgtgcacagcagcagactttgcaggatttttatttcaatgtggagagttatatgggctcaaccctgggttgagtaaccccattctctagcacaggaaaactttaaaaagacactctttaactgtcttccttagtttgcctcaacccacagcttctccccattcgttgaattcccagagcgaggactcaataggtcagagttttgcattttggttctttagtgtattgaattagcttcattgtgtttttaaatttctccctctttataaaattatgttattcaataaccagaagatgttctgtgacgttagatcagtttctgtcaaataatatggtttaattcacaaggtggataattaagagaaaaaatgtgatgagaaatccccaaacaaataatttttgaataacttttagcttttttattaaaaaaaaaataaaaaaagaaacaggactatagattgagattgtctttttttctgggaaaattttccctcaagggaaagtgagtttcccttaatgcctttattggaatatcaactattctgtggatctcactcttacttgctcactgagctaaaaacttcttgaggacaatggcccctgtttgattcaccttagcacatcacttgatacatagcggggatgcagttaattctttcttccattcagttacattgaattggattttagctgagaatacacatgagaacatattgataaaggccagaactatggctgaataaaggtatagaaatgacagggcttatgtgggagacatgagagatggtcagggatacaaatccaaaaaaaatttaagaaagacttctgtaagcagtcatttgaaaaaatattaactggaaatacctagaaaacttgatgaaatggcctagtaattatagccaaattaaggacagaatttagcaagaatgagcacaaggaaagtcaaattcttatgcaatgcagaatgagaatcaagcaaagcttcgagactgcatggaaatgagattttaccttgtttttctgttgactcttaatatactgacaaagagtggtaaaacattctgactttttcacataactggctcaaataaaacccataaccttttaaaagataataactatatacacacacacatatatggttataaagatatatatacatatatgtgtatgtgtgtgtgtatatatatatatatatatatatatgaagaaatagaatcctacttaatcaattaaaactatgaaagatgcataaagggaactaagtcattaaagcatagttttcttctctaccttccctcaagtgactcatgccttggttatattcttccctaactttatatgtgtttatattaataaatatgaataccacatatatggagttttattatttataatttttagcaaaatacaaccttacgttgtacattatatcgtattttgacacaatgtgattttctcaattaccaacaaattatgggtagttcttcagagctaacacatttatactattattttaataatcattcatatttccttaagtatttaccctccagccagatctttacattcctttttgtctctcaaataatcaacaatgattattgctatataaatctccttgcatatatgtactgtattttttttttttttttgagacagagtctcgctctgttgcccaggctggagtgcagagtacagtggcacgatcttggctaactgcaagctccacctcctgggttcaagcgatttctcctgtctcagcctcccaagtagctgggattacaggcatctgccaccacacccagctaattttttttttttttttttttttttgtatttttagtagagacgaggtttcatcatgttggtcaggctggtctcaaattcttgacctcaggtgatccaccctccttggcctcccaaagtgttgggattacaggtgtgagccactgtgcccagcctcatgtgctatatttttacttcgttccaggacactaatatgcttttgttttccatctatttcctggttgcactttctcaatatttttgtggtctccctggctttttaactttgaggtattacaggcttctaaactaaattcttctcttctcacctattcttattttagtgttcagttcatccaatttcgttgctccaaatgccaactttgtgtcaatgttctctaagttcataaggccaataaaatgcctcttgtgaacttcaggctgcatatacaaatgacttctctatatatctgctgagaccttcaacaaaaaatatcacatttagcatgcctcaaattgagttcttgatcacttttaaacttcctgtacctggattcttccacatttcagttgattgcaacttcaattatgcagtaactatggccaaacaccaaacatttgtacttgacttctcatttgtcttatacttcatatctactctttgagaagcctttgtttgtgctactttcaggatatatttctgattggataatttcttatttctttcacaaataccaccctggtccatgctcccattaacaatcttctattcactgctatagcattatttcatttcttgtacattaagtcctaggatacatgtgcacaacgtgcaggtttgtcacatatgtatacatgtgccatgttggtttgctgcacccattaactcatcatttacattaggtatttctcctaatgctatccctcccccatccccagaccccatgacaggccctggtgtgtgatattccctgccttgtgtccaagtgttctcattgttcaattctcacctatgagtgagaacatgtggtgtttggttttctgttcttgcaatagtttgctgagaatgacggtttccagcttcatccatgtccctacaaaggacaggaactcatccttttttatggttgcatagtattccatggtgtatatgtgccacattttcttaatccagtctatcattgatggacatttgggttggttccaagtctttgctattgtgaatagtgctgcaacaaacatacgtgtgcatgtgtctttatggtagcatgatttataatcctttgggtgtatacccagtaatgggatcactgggtcatgtggtatttctagttctacatccttgaggaatcgccacaatgtcttccacagtggttgaactagtttacactcccaccgacagtgtaaaagcattcctatttctccacatcctctccaacacctgttatttcctgactttttaatgatcaccattctaactggtgtgagtggtatcaaaaccactggtgtggttttgatttgcatttctctgatggccagtgatgatgagcattatttcatgtgtctgttggctgcataaatgtcttcttttgaagtgtctgttcatacactttgcccactttttgatggggttgtttgatttttttcttgtaaatttgtttaagttttttgtagattatggatattagccctttgacagatgaggagattgcaaaaattttctcccattctgtaggttgcctgttcactctgatggtagtttcttttgctgtgcagaagctctttagtttaattagatcccatttgtctattttgtcttttgttgccattgcttttggtgttttagacatgaagtccctgctcatccctatgtcctgaatggtattgcctagggtttcttctagggtttttatggttttaggtctaacatgtaagtctttattccatcttgaattaatttttgtgtaaggtgcaaggaagggatccagtttcagctttctacatatggctagacagttttcccagcaccatttattaaatagggaatcctttccccattgcttgtttttctcaggtttgtcaaatatcagatggttgtagatgtgtggtatgatttctgagggctctgttctgttccattggtctatatctctgttttggtaccagtaccatgctgttttggttactgtagccttgtagtatagtttgaagtcaggtagtatgatgcctccagctttgttcttttggcttaggattctcttggcaatgtgggctcttttttggttccatatgaactttaaagtagttttttccaattctgtgaagaaagtcattggtagcttgatggggatggcattgaatctataaattaccttgggcagtatgaccattttcatgacattgattcttcctatccgtgaccatggaatgttcttccatttgtttgtgtcctcttttattttgttgggcagtttttttttgggtttctgcagttagatgcctaatatgattagacccagaaatgctaaggactctacttctaatagtatggagaacactgatagtcctttgcagaaactctttagagagttatgcaaaataaatgcatttgaaacgcctgatttactgctcagaagaggcaagaagtttagtgactctatacataatacctttgactatatgtggagatccaaggaacataatgaagctggttggttactcctaagttcagtgcacaaagtgatgaaagaaaattatgaactgagagattctatctcctggcttcagaagcagatactgagcctcaaatttgctaagattgccctgagtgagattcttatctcctgtagagaaacagctgaaattgcggaaaaacagacataagctcttatcatgtgagtggctgacctgcagtgaaagatgcatgcacgacctcgccaggtatctactgttaaattgagggcattgactggaaaagaaggggaccctgaaacttggaatggggacatgtgggaggaccccaataaacctggggatgctgggtttgtaaactctggtgaatattttttggccagaatgaagagcttccccatccccagtagtggcgacatccactccccaacccatgctgctgtcagcctttctacctttggctgagaacataaactctgtgctgcctgaggcaacggcaacagtgatggcctcccctgaggtagttgccaggcaagataatgttgatcatcctcaggagccacccccatcatctctgcttctaaatctataactaaagtcccggcaggccactagaggtgaggttgagattgtgacacatgaggacatgcaccacacttgaaaagaactgtttgagttctctaatttatgtaaacagaaatctggaggacaggcatggggatggatattaagggtgtgggataatggtggaaggaacacagagtcggatcaggctgaatttattgatctgggctcactaagtaggaactctgcttttaatgttcaactctgggcattgtaaaagtctctaatgctttatttgcattgttagccaaaatatggattaaaagatgggccaccgtgagcaagctggaaatgcctgatctttcctggttgtagaggaagagatccaaagggctagggaaatcgggatcgtggagtggattagtcactttagacctactcatcccagctgggagagtccagaagatatacccttgaccaaagccttgtgaaatagatttttgacggcagcacctgcatctttaaagagccctgcaattgctcttctctgtgtatcagatctaatggtgggaactgcagttattcaactataaaatttaaatacaatgggaataatttgatcccaaggtggcaggagccaagtggcagcattcatctgtcaaaggcaaggtgggtgtagctaccataatggacagcagacgcaaagtggcaatcagaatagtgtgactcgcgtagagctctggcattggctaattaatcactgtgtccctagaagtgaaattgataggaagcctactgcattcctatttaatttatacaagcagaaaacttctaggttaaatggacaaaatactaatttgaattataaaaatagaatcatggcccctcaattcatttccagacttgagccagtttacagacccagaacccctggagtgaaggagaggcgaggtccccttgaagaacggtacccctaatgtagggcccccactacatttccgacaatttatggagtgaatatttttcccctccttccccaaggaggcctccagccttttatcaggttaaccatgcattggggaaaggaaaatgatcagacatttcagggactactggacactggctctgagctgacgttgattccaagggacacaagacatcattgtggtcctccagttaaagtaggggattatgggggtcaggtaattaatggagttttagctctggtctgacttacagtgggcccagtgggtccctggactcggcctgtggtaatttccccagtgccagaatgcataattggcatagacatacttagtagctggcagaacccccacattacctccctgactggtaggttgaggggtattatggtgggaaaggccaaatggaagcctttagagctgcctctacctataaaaatagtaaatcgaagaaaatattgcatccctggagggattgcagacattagtgccaccatcaaggagttgaaagatgcaagggtggtgattcccaccacatccccattcaactcttccatttggcctgtgcagaaaacaggtggatcttggagaatgagagtggattattataagcttaaccaagcagtgactccaattgcagctgctgtaccagatgtggtttcattgcttgagcaaattaaaacatttcctggtaactgatatgcaaccattgacttggcaaatgcctttttctccattcctatccataaggcccaccagaagcaatttgccttcagctggcaaggccagcaatatacctttgctgtcctacctcagaggtatatcaactctctggttttgtgtcataatcttattcagagagactttgatcgcttttcgcttctgcaagatatcacactggtccattacattggtgacattgtgctgatcagatccagtgagcaagaaagagcaaacacagtggacttattggtgagacatttgcgtgccagaggatggggaataaatccaactacaattcaaggaccttctacttcagtaaaatttctagggttccagtggtgtggggcctgtcaagatatcccttctaaggtgaaggataaattgctgcatttggcacctcctacaatgaagaaagaggcgcaatgcttagtggggctatttaggttttggaggcaacacattcctcgtttagtgtgttactctggcccatttattgggtgacccgaaagtctgccaattatgagtgggatacagaacaggagaaggctctgcaacagatccaggcttctgtgcaagctgctctgccacttaagccacatgacccagtagatccaacggtgcttgaggtgtcagtggcagacagggatgttgtttggagccttttgcaggccaccataggtgaatcacagtggaggcctctatgattttggagcaatgccctgccatcttctgcatataattactgtccttttgagaggcagctcttggcctgttactggactttggtggaaactgaacatttgactacatgtcaccaagtcaccatgcgacctgtactgcctatcattaactggttgctttctgacccatctagccataaagtgggtcatacacagcagcgttctatcatcaaatagaagtggttatatatatgatcaggctctagcaggtcctgaaggtacaagtaagttacatgagaaagtggctcaaatgcccatggtctccactcctgccaccctgccttctcttccccagtctgcactgaaggcctcatgggaggttccctatgatcagttgacagaggaagagaagactcgagcctggttcacagatggttctgcacgatattcaggcaccacccaaaagtggacagctgcaccactacagccccttttaaggacatccctgaaggacaacggtgaagggaaatcttcccaatgggcagaacttcaaacagtgcacgtggttgtgcactttgcatggaaggagtaatggccagatgtgtgattatctactgattcctgggctgtagcctatggtttgtctggatggccagggacttggaagaagcatgatcggaaaattggtgacaaagaaatttggggaagagttatgtgggtggacctctctgagtggtcaaaaactgaagacatttgtactccatgagagtgctcaccaataggtgagctcaactgaggaggattttaataatcaagtggatagaatgacctgatctgtggataccactcagccgctttccccagccacccctgacatagccaaatgggtccatgaacaaagtggccatgttggcagggatggaggttacacatgggctcagcaacatggacgtccactcaccaaggctgacctggctacagccactgctgagtgcccagtttgccagcagcagagaccaacactgagccctcaatatggcaccattcctcggggagatcagccagctacctgatgacaggttgattatattgaacctcctccatcatggaaaggtcagaggttggtcttcactggaatagacacttactctgcatatgggtttgcctatcgtgcacacaatgcttttgccaagactaccatccatggactcatggaatgccttatccaccctcatggtattccacacagcattgcctctaactaaggcactcactttacaacaaaaaagtgtggcagtgggcttatcctcatggaattaactggtcttaccatgtttcccatcatcctgaagtagctggattgatagaatggtggaatggccttttgaagtcacaattacaacaccaactaggtaacaatactttgcagggctgaggcaaagttatccagaaggctgggtatgctctgaatcagcatccgctatattgtactgtttctcccatagcgaagattcatggatccgggaatcaaggaatagaagcataagtggcaacacacaccatctcccctagtgatccactagcaaaatatttgcttcctgttactgtgatattacattctgctggcctagaggccttagttccagagggaggaatactgacaccaggagacatagcaacaattccattgaactataagttaagactgccactttaggcttctcctacctttaagccaacaagctaaggagggagttacagtgttggctggggtgattgacccagactatcaagatgaaatcagtccactactccacaacagaggtaaagaacagtatgcatgggatacaggagatccatttgggcgtctcttagtattatcattccctgtgattaaggttaatggaaactacaacagcccctctcaggagtaaaggtttgggtcactccaccaggaaaatatcatgacctgctgaggtccttgctgaaggcaaagaaatacagaataggtagtagaagaaagtagtcatcaataccagctacgaccacgtgaccatctgcagcaatggggactgtaattgtcatgagtatttcctccttcttttgctaaaaatatttgtacatgtatacacttgtatgaagaaaatatctttattttatttcctttatcatatgacataagatttattgacttcgtatcagcacttaaatattgttaactttatgtgatagtgtttgggttgggggttggtgtgtttccagttgtacagaggacagttgtattacgttaggtgtaattatgaccttattattgtctttatttgaagattatgcatgatctcaggagatgtgtgtgggttcaacttgacaaggggtgtacttgtgatggttaacactgagtgtcaacttgattggattgaaggatacaaagtattgaccctggatgtgtctttgagggtgttgccaaaagagattaacctttgaatcagtaggctggggaaggcagatccacccttaatctggtggacactgtctaaatagctgtcagcaaatacaaagcaggcagaaaaacgtgaaaaggggagactggcctagtctcccagtcgacatctttctcccttgctggatgcttcctgccctcaaacattggactccaagttcttcagttttgggacttggactggctctccttgctcctcagcttgcagaaagcttattgtgtgatgttgtgatcatgtgagttaatacttaataaactcccctttatatttatataggagatatatgtatatgtcttatattatatatatcttatattatatatatcctatattttattatatataaaatatatatataaaatataaaactaacagggcatatatatatatgtgtgtgtgtatatatatgtgtatatatctatgtatgtgtgtgtgtgtgtgtatatatatatatatatatatatatatacataccctgttagttctgtccctctagagaacactgactaatacaatagcattgaatgaacttttgtgtttctctggtgtcagttgtaatatctcccatttcatttcttaccgaggttatttggattttctctcttcttttcttggttaatcttgctaatggtcaatcaattttatttatttcttcgaagaaccagctttttatttcttttttttatttttttattttttgtattttttttgtttgtttttatttcatttagttctgctatgatcttggttatttcctttcttctgctgggtttgggtttggtttgttcttgttcctctagttccttaaggcatgaccttagattgtcagtttgtgctctttcagtctttttgatgtaggcatttagggctatgaaatttcctcttagcaccacctttgctgtatcccagaggttttgataggttctgtcattatcgttgttcagtttgaagaatttttcaatttccatccttttgtttttgacccagggctgattcaggagcaggttatttaatttccatgtatttgcatgggttcaaaggttccttttgaagttgatttccagttttattccactgtggtctgagagagtgcttgatataacttcaattttcttaaatttattgaggctcattttgtggcctatcatatggtctatcttggagaaagttccatgtgctattgaatagaatgtgtatattgcagccgttggatggaatgttctgcatttatctgttaagtccatttgttccaaggtatagtttaaatccagtttccttgttggctttctgtcttgatgacctgtctagtgctgtctgtgggatattgaaatcccccactattcttgtgttactgtctgtctcatttcttaggtctagtagtaattgtttcataaatttgggatctccagtgttaggtacatatatgtttaagattgtgatattttcctgttggacaaggccttttatcattatataatgtccctctttgccctttttaactgctgttgttttaaagtttgtctttttctgatataagaatagctactcctgcttccttttggtgtccatttgcatgaaatgtctttttttcaccactttacttaaagtttatgtgagtctttatgtgttaggtgagtctcttgaaggcaacagatacttggttggtgaattcttatccattctgcagttctgtatcttttaagtggagcatttaggcaatttacattcaatgttaatgttgagatgtgaggtaccattccattcataatgttgcctgtgtatcttggttttttgggggtttttttgtttgtttgttttgtttttggtttttaagttctattttgttttataggtcctgtgagatttatgcttaaaaaggttccgttttgatgcgtttcaaggatttgtttcaagatttagagctccttttagcagttcttgtagtggtggcttggtagtgacaaattctctcagcatttgtttttctgaaaaaaactgtatctttctttcatatatgatgcttagtttcactggatacaaaattcttggctgatagttgttttgtttgaggaagctgaagatacagccccaattccttcgagcttgtatggtttctgctgagaaatctgctgtcaatctgataggttttcctttgtaggatacctggagcttttgtctcacagcacttaagattctttcctttgtcgtaactttagatgacctatgcattggcataacacatagcaatgtgtctaggtctctagcaaggccagggaatatttcctcaattttttcccccagatatgttttccaaacttttagatttctcttcttcttgaagaacactgattattcttaggtttggtcatttaatataatcccagactactctgaggctttgttcatattttcttattctttcttctgtctttgttggattgggttaatttgaagaacttgtctgaatttctttcttctacttgttgaattttattgctaagactttccagaaaattttgcatttctatctgtgtccaatgtttcctgaagtttttattgtttttgtttatgcaatctatttcattgactatttctcccttcacttcttgcatctttttttattgttatttatttccttgcattgggcttacctttatttggggcctccatgattagattaataactaacctcctgaattccttttcaggcaaatcagggatttcttcttggtttgcatccattgctggtaagctagtaggatttttgggggtgttaaagagccctgttctgtcatattaccagagttggttttctggttccttctcatttgggtaggttatgtcagagggaaggtctagggctgaaggctgtggttagattcttttttcacatggggtgtttccttcacatagtgtcctcccccttttcctatggatgtggcttcctgagagccaaggtatagtgattgctgcctctcttctgggtctagccacccaaaaagtctaccaggctctgggctaatactgggtgttgtctgtacaaagtcctgtgatgtgaaccgtctgtgggtctctcagccatgaataccagcacctgttctggtggaggtggcaggaaggtgaaatggacactgtgagtgttcttaactttggtggtttaatgctcttttttgtgtgctggttggccttctgccaggaggtggtgctttccagagagcatcagctgtgttagtatggagaggaacccatggcaggtggggccctagaactcccaaaagtatatgccctttgtcttcagttaccaggatgggtagggaagtaccattgggtgggggcagggccaggcgtgtctgaactcagacttttcttgggtgggtcttgctgccactgctgtgggggatgagggcaagatttccaggtcaatggagttatgtacctaggaagataatggctgcctctgctgagttctgcaggttgtcaaggaagtgggggagagccgggagtcacaggcttctcccagctcccacacaatccaaagggctggtctcactcctaccatggccccatcatagcatctagtctgtttccaggcaatgggcaagcagggctgaggacttaccgccggctaacccgcttcccagttgcaaaagaaagtagggctttagtgcttccactgtctgtggagtctacacacaggatttgcatcctcccctgagtccaagcaggaatggacactgcttcctctacccctgtattttgcttggctttctaaattcacactgctccaggtaagatcagaatattctcctataaactagaccttcagtttccccagtgggggtgtgtattcaagggcaacggatctccctttccctgtttcacagcctgggcacttacaatatttggggcatcttgggggccctgcaggagcaatctgcttccttcagagggtctgcgagtactctcaggattcctgctattcctgcagtcattctggggcaaaattaacaatgtgagcctccacatcctgctctgtctgtctgagttatagctgcaatccagtcctgactcccatccaccttgatggattaaatttttaaaaataaaactttatttaactctttaacataaccttttatacatttattggtgtgtaattaaaaattatggttaatacatgtccctttttcacagagactaatatattatcagttagcaagagactgttactgcttaatgtgttttatttcacatcagttacttattaacagttggattgatttttgtttcatttgcctatactttaagaatgtaatacattctggaatgaaggatacataatactcctcagtgacatgtattccccatgttttcacatttctttcacattgtgtcacatatttttgtgcaagttttggagataatgatcaatcatagtggaattactatatttctgcctttatttttggcttccactgaaatattataaatatgttttctacttataaacaagtatataaattatgtatcccaaaatattacagttttaagtcaatgacctatctttttaacataattaaactgaactttgtaaatgaatagctccaccaacatcttcttaactttttaaagttattcttccccaaggaatagaatattattttattgatgaactttgcattagagtgaaagctataaattttcaggtcctgatcctaatgtagtccagggtgaataaatagttttctagagtgaactcatgtgagtcacgctggctttctaagtgccataggttactacttaatgctaagaaagtgacaatttattaaagtaatgctagagattactagcattttgcttcactagggtgactgcattttctttttacttttttcacccctcattcctttgccgttctctaaagagcagttaatttagcctactttgttatgtgatgagatacccaaagactatctcttcttgctttaggacaatataatgtctatctttcagcatgaaaatacagcctgctttgcaaaatcccatggctctaagagtatatatgaggtgttacattcagaccctgctacaatgcccttggtatgactaaactgatttaaaaaaagtgggggggggggggcttcactgtatatgactaaaatctaatttatcttccaaatatttttacttatttcactgtaaaaaaaaatcatgggcatctctcttagtagtatagtggttagctaagcttgtaacctacatttaactggttactgagtcactaccatgtctatatatggagtatttctaatttccatgctcttttccaatctctttcatttgatgtctcactggtgaccccactcagagatgacatatttctatcatcataatattcctaactgattatctctattcaagagctttttctccatttgtcaagttttctgtgtctgcaactacccttattattcacctatttcattcattcatcattttttggcttacaaaaattaataaaatacttctctagagtcttaaaacccttttattaaaaaattcaagacaaaatactcaaggtttctctcaggccccattcctgttgcaaagtgtatattgcaaacagaactgagatttgagaatagatttggtggaggagagggaatcttgagagtaaaccactttgctatttcacagtggttatcatcataatcatataaactattagtcagtctactaaataactactacaatggtttcccgttagtgttacatgggaatctgcttatttcaagatttaaccaagctggccaagaaactaaaatttcattaataaaatgatcatctacgttatttaaaaactcatgctaaatattcttagaaagcaatgtaatcgaaatacattttcatgatatttttgtgtaagtttcataatatttggtgtaaggttatccaaaaatataaatattactgaattataatttactaatcttattacaatctaggttcaaattagtcatatcttcagaagcatttatgctgttaactaggtattataaaaactgtttattaattataaaaagtatatatatgaattataataatgttatacatgtggagtcagattcaagtcttaaaattgatagccctaaaattactgaaatttttatttttatatctgaattactagaatctatatagtgtatagtatatatatttaatagatgcttaatagatgctgtaggttaagaactttactatttctcttatacacttaagcctattcttctttaaatatccttaagtatctgtaataagaacctaactgtacacttagtataattttatattgctacattttgttagtaataaaaaaactaagtgacatcaaattaatttcactaaacatatttttcatgtatatatatatgtatacacacatatacatatcctgaagatgaatgccaattttcatcattgttaaacttttagaaattgttaaaagacataacacattctgcaaaaatgttttatacagttataagtacaatatatagatttataatttatatataatataacaacataataattaccaaactatctcaccttttgttagtttaatgacaagtattctagaaaaggttttagaaacatttggtaaatgaatttgttgatttactttgctacattttggtcatggattgacgcgaagttagagaatatgaaataggtttctctattgacactttgcgggtgtctgcttcatgaaagatgaatcttttcttctagatactaaaatgatatactaagagacataaataaataaacacattttcatacaagcatacaattgtatcacccaattcattctgcattcttcttttagtatccaatttactaatgaagtgtgaatctttgaaagctgtgtatttttgctcatttttataaaagatctaaataagcatttttaaatggtttcatctgttgaatcttactctgtgattcctgtcaaaattttgtcctggtaattttttacatgctttcaagaaagaagtgaaattattcccatactatcatttatgtttcagttgccctaattttcccagaaaaaaaatctttttctcatattgcattgtctttttctgtattttgtgttttccaaatgtcttctgagagttcagagactttaaaacctcaaaaatgttcatgttactatggcaagaaaactgaaatgctatgtgaacaaagttgtgttttttcaatgtttctacgtgtcagaaatgagaaaaaggtaaatcattgaggttatgtgcccaaaaaggtttaatataaaggataactgttcagacctctagggagaaacaatccttgaaaatatatttgtgaactgagaaaatactgctgttatttctagctagaaatatagcactggcactcttggaactatttaagtgaattttggtgttatagcagaatctttagcaaaaactatatgcagtttaaatggcaacaaagtgtattatctcaatattttaggtatttttcttattgaatacctcttctgtaatttattgttacttttctaatatctattcaaataatatttgataattttaattttagtaagtgtagatttgttactgtatttcaattaattaaaatgagagcctatttatcaactaaatatattactgctatttaaattttgagttaaagttttataatccctaactaaaaaaatactctatccctaaaaaagtactctttttttttttttttttttttgagatggagtctcgctctgtctcccagcctggagtgcagtggcgcgatctcggctcactgcaagctccgcctcccaggttcacgccattttcctgcctcagccccccgagtagctgggactacaggcgcccgccaccacgcccggctagtttttttttgtacttttttagtagagacggagtttcaccgtgttagccaggatggtctcgatctgctgacctcgtgatctgcccacctcggcctcccaaagtgctgggattacaggcgtgaaccaccgtgcctggccaaaaatactctattttttaatattctacatcaaagccctttatattagaggtgatttcatttttttttcaaattattaaacacatgactgtgactatgacttaaatatgtgcctcttttgtgaaaattttaataattaatttgaacctcaatttgtcctaccatatattttttttctagtcataaagttgaaatagaatgtcaaataattaaaaccaaatatattattttcacaagtatggaaggcaacaataatctactgggaatttattttcccaactttatggcagttagtggaatgtggatttagtaaaattataagggctatttttgttttaataaatattatttattgtttttttcttagatcaataactgtatctcttagacaaaccatgatagcaatatccatatgattaaccaagtgaaaaaaaaaaactgcagaaaagcaaatgatagtagtaacacacagggcactgtaaagggaagaaaagtcatagccaaagtaattatagatagggagttttcagagaacataatgtgaggttggaatataaatatatgctaaattattccatgtgtatttcacagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtaagaaaaatcatttttgtgattatgcaattaacatattaagaaaatcaaaaagtcatctttagaataccaatttttacttatatatatatatctggaggggatataaatatgaagtttcaaaatattttagtattttttgtggcataaagtgttaaagactattgggtctagcaattatattcattgaaattgatttctaatcatgtaagtgtaggtaatagttggatctcaaggggaaagaaacatgtataaatttgaaaacacgtggaatacttgcttaattgatatggctcttctatcacgtgaattctacatgtatattgttaagaacataccagcacattcaatttgattatttgcagagaagaaagattctagaatgtctgaaatttttgtctccaggtcttttaagctttcagtgtatgaccaaattataataccattaatagctgttgctacattaatcaatacaacttttcagatattcctaagcatttatataccttatttatttaaaaatatatgacagccccgtgaagtattttgaatatcatttttaagatgtgcaaactggcataaagtatttaagtcacttttgcaaattcacatatttagaaaatagccaaggaggcatttttccaggtttagctgaatgcaaagcctacactgcagccaacagaaccatgatccaggacctgagccaccctaatgatctggggctttttcaccactcactggtttctgtggtgtagctatttgaatttatttttgtttatttttcatttcatgggatgattttttaaaaagtagtttaaaaatggttcttctacgataatacttttcgactatctttatgagactctaagctttgtaacacatttattgagtaaagatttaatatatttaattttactgcatatgtatgagtattgttttagattgaggttcttatagtcacttagtcactaatcaaatcagtctgtgaatttgaaatatatatatgtgtatatgtatatatatgtatatatattttttaaaaatggaagatggtagcatcttttctctcaactccagattccagcccatgttagtcttcttgagctaggcaggtagctcctgcagctgctgtaggagcaggtaaggaagagagtgaggtcttcttccttagctgaagtctcagaggagaaagcagttgccaaactcgttccctctggaccccagcagaacacaggaaccagcctgcaggagcctaagagaggcccagaatactgtcgggcttattgatctccaaggagagtcgagggagaattaaaggcttcagcattttttaaccctggtgggtgagagtttgcatgggaactcaaggacagaattctctctgccacatcaaggaactgatacccacaaacctaatctcctctgccttaggaaggcaacgagctctatggtgctcccacctgtgagagtgctcctggtgagctatttccaaggtaagtaagggccccaaggagcacaaaggaaactgtcataaccacaggggttaaagcactagagagaaaaacaggcagagcaggcattacccaggaagacagtatactaaacagtagccaatacgagcattggagggcttttatggatgccacaaacagatttctgtaactcaaagccttttgctttaaacaaataagtaaataacaacaacaaagaaagtcaatatatggattgaaggcatgaatggtaactgattagacctgaattattgtcctggtacctaaaatcataactgactggaagaagtagctagtagccacagaaacaaacataaaattgtggatattgtgggaaaaagaaaggagatttagagaacatattcattagacctatcatgtgaataacatgtgtccttagagaaaaataaagaggaaatgggggaaaggagcaatcataatttttcttgaagtgaataatatactgactttacaagtttagtagactttccaagttccaggaagagtaaatagaataagaatcaaacataggaaaatcctggtaaagttttaaagcctaataaaaagagaaaaatttaaaaacattcagatttttaaaaattaggtgtgaataaaaatgaatatgttaccctcacatttattacatgaaatagaggaatctgttagaaagttgagtcccatttacggcctacagagaaaacactgaagccccaaatctattgtttagacaaatatgatccatcagctagggcaaaataaatatttggagaaggatctggaagatcaacagttgaaattgaaaatagttgaaataaatcagaacagagatctaaaagtcaaggaaaataacagagaggaaaaatgttatcaacagtgaactctggaatagatgtgtgtgtgtgtgtgtgtgtgtgtgtgtgtgtgtgtacactgagttaatacaaatggatatttttgagatattgtaaaaggatgccacataatctatgtgagaatcataaggcataaagtaatttttgcagaaaaggctgtgagttgaggacttgggaacaagtcaaagtcctcatttggggtttgggaagaaagatgagaatagtgaaaagttaatattcttaagttctcttactgagatgagtatggttgagggacaaaaatttaatatctgaaagtagtagagaaaaagaacaagacagagtaagtttcaactctctgtactactgtggtttcaggcaagattctattgaaagagttattttatgggaaaccttaagctgaatattggaaattatattttatcagtaagtttgtgtgtgtgtatatatacactcattactataggaaaacaaatacatagcattcatggtaataacatataatagatattgtaacatgaatgcatagaggatgatatgaaagtggagggagaaactcactttatattgtgttcataagaatgggtgatattttcattaactctgattttttttttttttttttttttttttttttgagacaagagtctcactctgccgcccaggctggagtgcagtggcatgatctcggctcacttcaacctctgcctcccaggttcaagcaattctcatgcctcagcctcccaaatagctgggattacaggcgtgtgcctccaggcccagctaaagtttgtaattttagtagagacggggtcttgccatgttggccaggctggtcttgaactcttggtctcaaatgatccgcccttctgggtctcccaaagtgctgggattagaagtgtgagccactgtgtctggccaactctgattttagaaacaaaaagttgatgatattataggcaaagatctgcagacaatggcagggggaacaaatctgtcctgctctctgtttttgtgcttttattgaaacacagttacactcctttacttgaagattgtctgtggtagttttggcacggcaatggcagagctggatgtttgggaagaaggtcatatcgctggcccacaatgcccaaaatatttacagtgttatcttttattaaaaaaaagagtttgtcagtctttattgtaagctattatagggagatcagaggcaaggaacaattagaggatggtgtcatagttttgatagacaaggtatctgctgatctatagcagttagtgttctgccagccctactggactatatacatatagacagaaatatagcgtttgttacaaatatatgggatcatgcttcttccctttgggtagatactgttagttatctaatgactatccaggcttcccttctgtgatactaagatagcctagttttgttagagaatacagctgtgttgcagaatatgcatgtacatgcacagaagatatctaaaggaaatagacacacacacattgttgaaggtttgcttctaaacactaggttgtggctttatttggtatgaaaggaataagtggttctaaatatgtaataaaaatcatttttataacactaacacttaaaaatgtactggtttctaatgctaactgaagactaataataatgtaagcaggtgacaacaaaatttttatcaacgtatggggcctgataaaattactttttttatcatatactcattaattcagttttgaatcattaaaacaatctctctccttatatttattcaattctttcttgagtgagagagagagagagagagagagtaaatgcactttatgtgctgagagctgtgatagtggctagtaataaaatggttaatgaaacaagaccactatctttgagcaaactgcagacttacaaatagaaaatttcaatatggtgtctgataagcaccaataggggaaccgtagacttggacagggggccctgcttgtggatgagagaagacgtcctcagtgaatcttaaataatgcttggtgatttatctgttagaaaaggtaaaataaatggacatttgacatacaggataaaatgattaaaaaaaaatagtccagcttgggatgtgtgtccgtgtgtgtgtgtgtgtgtgtacccatgcgtgtgcatttgtgtgttttggggaaataggaagatcatgcaaataatagattttctatatagctttgcaaatatgtcacaagaatacagaaaaggcagtaccagagacttccttggtgtgtaagattttatcagattattgtttcttgcatctcttgctaagtaatgattatggagccactccaagtaattgcactgcgctatattgccagtgagaaaagcataatgtggttgtatatttcttgtcggtgggcaataatctgccgacaaagtctgagacattttggatagctcagtacagaaagatgcaaaaataaactgaagtggtttctaaagcatgtcttaatgtaagatttgcatgtatctttttgatctatataatgtaatttcacccattatctagggaattatattcttctaggaacgagtttttcaatctttccactattaacactttggactggataattctttgttgtgagggtcttccctgtgccttgtaggatgtttagtagcagtcatggcctgtacctaataaatgcggtggtgttcctcccacaaccacaaagtgatggtgtcttcagaaattgccaaatgtcctctgggtgacaaaaatgctgtcagttaagaactactgccctagggaacatgcaatataaagaattaaaaatgtcaaagtagaaacacaaattgaataatatatttgttaaatttataatcctgtccagagagactttcatagtgccagaatgctcatgccgtgaactttaaaacaaaaatatgttctatctggctaggtaagaaattgcagtgtttaaatattaattgtcatcttgaagtgcacaatagtatgaaaacactgaggaaagtcgtagaataaaatgaagttatttgcacccataaaaggaagagtaatggcgtggctacttgggagccatgatggctctcattaaaaaaaaaattgtgtattgtatagcctgcatttagaagaccacttgaattgtgtttggttcctagtaaggtactggctgtcatatatgtgtgtgtgtgtgtgtgtgtgtgtgtgtgtgagacatgtatatacacatgtatatatgtacatatatgtatgtatatatacacgtatatatgtatatatgtatacatatatacatacatatatgtacatatatacatgtatatatacatatatgacatatatacatatatacatagatgacatatatacatatatacatagatgacatagatgtacatatacatgtatatttacatgtatacatatagataagtatatatatacgcatacactatacatatttatctaaataatttcaacagtaaacatatgtgaacagaatggcattataacattattgcgggcaaatgtaacctggattaatccataatagatgtacatatttgatcaatgcaaatttgagattttaaattttcctttttttgtgatatgcagtacattatcatgtcagtcttgatctttaccaacttctatcaattatttaatggaattacttcttcaatttctttctctatagttacattacatgcctaatttatatagtcttcagaaccgacagttaaaatatgagataatgagttaatgtgtttatcacaatacaaagatgaaaatgaccatgagatgaaatgatacttggtttttgagttagctgtcaagtgaatgattttagaaattaagatgaataaaaatgtatttgtaaatggtattacacttttcacatgaaaagcacatcataactcactaagaaatttagcaataatacaaagacataaaattagcaataaaaagctggtaaaggtgtttgtcttaattgtgtgtatcgtatctcttttatttaaaacaagaataattttatctgttctctttttatggagacattctcaaatttctgcaattacagtcttgctttcacctagaatcaggagtttctataactgtattaactgaaatttgtttctattgcagtcatttttttttaaatgttttaaatctagaagttgtttcaaaaagatcatataacagatcacaatgtaatttggcagaacataaactttactattttctttttcaaataaatatttctgtatgaaaatgtacaaatttttaactcttctgtgtattagtatacctatcattaaataccatttaaaagcatttaacaggtagtaacaggttatagaaatagtactttttaatgtatgagagagaataaatattatattttaacagaattataagtatacatttaataaactgtaggttcaatataacaaacttatttttgcagctacaaaaaggagattgtttaactgcaaagttcctttttcttggaaatgtattgaaacatctctaatcttcttcatgtctttttttttcacctccaatctctaaggccccaggctgttccatttgcagctgtgtttcttgctgcagagcaacaagaagagacaccagctgtgctgactttattgtgcttcttgttggagcgctgatttagttctgccaaatatcttgggatgttcaccctggacatctgccaagattctagtagccatttaaaaatcattaccctggggcataatgttcagaatggtatcattttaataaagcacagccagcactctaattctacatggaacattgcagtattcatgaagagacacattggacaactgacaaaccagaaagtagacaaaattttgcaagtttcataattttcttctttatttgcataactattcttctgtgtaagttagcttgtgttttgtacaaaccaacccacccacagtttagtggccacacacaatatttgctttatttgctcataattcggtggtccaggctgctcttccactagggtcatacattgcgctgtagtcatctaggagctcgaacagcgcaggtgcctccctcacctgcagtggtggatgctggttaccagctggtttttctggggtcttagctgggtggcttgtctctgatccatggtatctcatcctccaggtagggacctgctttgtgtgcattcttagggcagtagttcaagaggataagagcaaaaatattaagggttttagagaggagtctcagaagttctgtttttccacttttgctgcattctgttattgtatcccctcacttgaagcaagatattctctaaatgtttattgaacaagtacatgacaaccttttccacctacaattacgtctagaggaaagatttcttagaaatattggctcttaatttttggaacataattgttccaatatctgtttcattgggtaaagattctttttatttattttatatatctttaacttcgttgttgtaaattaaagaaaggcccaataaaccaacatagtttttaacttttattcaatgattgatgtgatttactagattgcattttactcttcaagtgattcctcagtctttccatttactttttttaaacttatattttaagttcaacggtatatgaacaggatgtgcatatacctatgtgacacataggtaaacatgtgtcatggggtttgttgtatagattatttcgtcattcaggtataaagcctagtaaccattagttatttttcctgatcctctccctcttcccaccctctgcccattggtaggccccagagtacatggttaccctcttaccacttactttttatgaatgtaggccagacttggaattccctaataaaactggtcaatttgcaagagaaaatacttaactagaagatacatatttttctgcataaattgtaccacattcatacagatttaattggtacatcatgttttaaaaaatatgatagccaaagaatgactttcatatgtataggcctcaatgtagaaaactgaaacacaaaacaaaccagtcagagattcttggcagtttaaagaggcaggttttgtgtaggtaattctaaaaaatataataagtgaaattattgcagtgatcaatggatcattgaggtatataatttggctttggaatgtagcacttctcttaaagtagagaatgtcttttttaaagaaaataaacagcaaaatatttactacaattgatcttagagcaaccttggcttattattttagcaccttccacctttacttataaattagtttgaaatcacctgatattatagtggtccgtagtcccttaaaaatatattttaaaaatctcagtatcatgtgcacctaacaaagtgtctaaaactaaataggtaataaataaaatatgtatagaatgagtaaacccaaattatatacattttcacagagacagagctattcttaaatgtgacattttttctatatttatcatatccattcatgaatcgattttctcattagaatcattcttattcattacataaattgactggaatgtcacatatatagatcctaataataacaatttatgttgtttctttcttactgaggaaatagaataaagcaaaaaatctcaaaattgatacttgtcatcattcaagtatcactaaaaatattaatcagtcgatgttgttgtccctatcttttaatcaaagcatataaattaaaattgtttgtatcattttataagttgaaaaagattttaagcaaatgctgaaattactgtattaggacatatactgaaattttattttatttaaacaatcaggatatgtgataatccccctcacttttaattgaacctgatttctaattctgtttggataattttattggtaggggggcataattttggatagttttgtccatttcctaggagtcaggtgttcagtgaatgttcagtgatcaggcacagagagaaagctcaatgtcagggatgtggaataggcccagtgattagatatagagtgaaggcaccaagtaatctgaaaaaaacacacacatacaaaatgaccaggtttatggtcaaggcatagtgaccaggcatagagtgaaaatggcacagcagtcagatataaacattgcaatcaggtatagctggaaggtgcaatggtcaggtatagacagaagacaaaatgatcaggtttagagagaaagtatagcatcagatatagtgagaagatacagcaattgggtatagaatgactacacagtgattgggtgtagagaaaattcaccatgatcagatagagagtgaatgcacaatggtcaggtatagaggggagacacagcaattggatatagaaaaaaaacactgtgaaggtagaaggtgagggcacatcacgcagagagaaggccgcatgtggaagaggactggcagtgccatcacaggtctctactgctttctaccagacttctgtgttctcactggttttcattgatcagtccttgatcatcatgaattcattctctctgtcataattgcacatcttcttgaaatcctctgagtttctctcagccaatttcacttcctattttagtatatagagaaattttcttgtactcatactctggcaaggagaaaactttgaaatccagtttggatattattgtcctgcacaagctaaatggccaatttaaatcttctcctgctgtgccacacagagacaccatggaatattgtggaagttgcgacctttcataaaagcggtgctactctctaagtttatcacaacagtccatgtagataccaagaaaaaagcacccccacacatagaaccaaatgtgatagcttttgttatatgcaacgtttgtagtaatttattacgtagtatagaaaacaaacacacacaaaaaaactagaaaaatataactatgcaacaataagcaacgtggaatgtaagatagctacagaaattatattaaacatctattactttaattatataagaatatatattacaaaagaagatatcattatttatctttcaagatcaataatttactagaatattattccgtagtgattcttctgtgtcatgtctcccccacctgtgaagctgtctataattttatatttttttgagacagtcccccaggctagctagagtgcagtggcagcacgattatggctcactgcagccttgatctccgaggctcaagtgatcctccctcctcagcctcccacctaaaggcgtgtgctaccatgcccggctaattgttgtatttttattagagacagggttttacaatgttgcccacactgaacaaaattttaattgttacgttcaagtgttctttattagtggattttgaattcttgtgttgtatcttaataaaaatgttctggtccattatttcaagtgctttattcagagataccaacttaaattgttcacttaattttcatagttgtcataaatactcaaatcataaatgtctcatccaattatttctaaaattcttttaattctttcctccaattaaattacctgaattttcaaaaaaataatcttttacataattgtcatgtagatatccatgaaaaattattgggtggggtaaaaatgcacagtgttttgtttagtgtatgtatatatgcatgaaactatattagagccctttgaatgaacagagatagagttatagaaaggcaggcaagacaatgttcaggttgccttccttaagagaaatagcactggacttgtatttatttttcttacgaagtataggtgtgacttctctaacttaaaatatccagtatcggctgggcacagtggctcacatttgtaatcccagcactttgggaggccgaggcgggaggatcatgaggtcaggagattgagaccatcctggctaacatggtgaaaccccatctctactaaaaatacaaacaattagccgggcgtggtggtgggcgcctgtggtcccagctacttgggaggctgaggcaggagaatggcgtgaacccagaggcggagcttgcagtgagccgagatcacgccactgcattccagcctgggcgacagagcgagactccgtctcaaaaaaaaaaaaaaaaaatccaatatcatcaatacattgaacaaaaagagattgaatgggagtggtttcctattgtcttttcagcaaagagatataagagcagcacttatgttgcgactgctttataactaaaaatacactgggatcagattccatgtgattaaagcaaccactgagaccaattgacagcgacataaagaacttagtgacataaagaaccaagtgacatttcatggactctgttccaccatgtttaactttctgtcttaaatatacatttatataatgtagtgagccaataatattctactgtctatacttttatttacctggttagatgctttgcaaacactcacctgtgttatggagggtagtgactcagcagcatttgcctccgagggaggacagcttgcaacaaagccacaccagcccaaccacatttcagagtatgtgagtgagaaatcaacttttattgcttaaagactctaaaatttagggtttgtttgttattgcaatataacttacacttagatatatctttctgatatatcaccccttgacatgtcagagaccatacaccaaaaagaaaccataaatatttcaaaaagaaaccacaataataagatagggtaccaacagtggataagagattccaaaaattcctagagcactgaagacattgaaactggattaatgggcagggggtgggcagcactgggaaatagatcaaatgtatagccctaaacattaaaggagaacattatcttgtccaagaaagtccttgtaaatacaagacacctggacaacttattaaattgaagctttcaaaacaaggaagagtctttttttaatctgtgcaatccgagaaaaaatatttttattctaccataaggcctttggtgaatttttctgaggatggctcaaaaaaggaatattgtgacacaagaattaagcagaaattaacttccagtaaaccaaaacgtccatatcacaggggaacaaaaacaaaataaaagaaaacagttcttatcaatagacaaatatcacaagtcccctcttctgatgcagttactcctgctttggaaatagaagggtactcaacaagcttggaaagaatatcaatgcattccagccacacttactaagaggtagcattccaattgaaaggggaaaacatcaactcagtttttaaatgataatgtgctatttctctttcaatcaaccagctgcttttttttgtttcatttttttggaaataaagcaacaagataaaagacaaggattaaaatgaacaaacagaataatgattaactgcagagaacactgtgaaattttgttgcattcattaaacaagaacagcataaaggtgacacaggacttttcttgccccatttgccggacctgcagcagggaacaccccacctactcagcccactgcgctcagcccctggcaggagtgagcatgtaagcaagcaagtgtggggtctggccaactgctttgagcatcaacacatgagcaagttctgtgtgaggctgcagtaagatcagatgtgtcaccctgaggggaatttgatgatgcccaggcagtggtgcctgagacacccaagccccagaggggatgttacaggatgctaattagctgtctgctgtccagtggaaagaggcgtgttagcagctcagtcagccttttaccctgctcttgcccatgactccaggactagcatggctctgggactggcttggacctgctgctgcttctgtcatacgaggcggctgccctccatcagcaaggtcagagggccagtgttatagactttctgggcaccctcatttggtgggtcttgagctcttgtcccacatccaagaagaatgaggtcatactgatagttgaagggtagtgaaggcagagaattttattgagtgaccaaacagctctcagcggagaagagatgggagagttgggttgtctctcttgaagtcaggtcatctctctgtgtggctgagtctgcagcttttataggcataggataaagaagtatgtactgatccattcaagagtttggaaaaaggttaaaacaaaggcaccagtcaaaggtgggaacagtgtaaaaacaattaggaaagggtaggtatatgtaaaataggtgaagggtgaagctcaatcaaaggaaagcactacaaagaggaagacaggttctctatctggtctgtgaatttgacttgtagcttggtcttcaggctttgaactgtctttggcttgaagatgaggtttcatgggatgcccacccctggtatgcctaggatttctctgcctcctgcctgtgtcatttcctcctctgaagaggtgcatctaactgctgttagaatagggatcatgaccgatattagctactccctgctgacaggggatgctgttttgggaaaacggaactcagatttccctcagaggcctatctgagggttcctggtaaaagggagctatcatcagaggctccagttgtgtgaccatttaaagtttgacagcctgtaggtgagaagaaacaagttttacaaggttaagtatgcatggatcaaatattaacttctcacacaaaaaacagttaaaaggaaagaatctagtgccgaagataacagatataagagatgaaatatactaatcattctgaaaacaatattgtgtcccaagctgtttcaccctggtgaaacaaattaaatcttaggtgggagcaattaaactttacaagagagataactgtttaagaaagtagatattcccatgggtgttcaggattaaggagtccttcataaagttaccttatgggcttaattactataaaggctaaacaagaaatgcttgattttgatgacatagctgtgtcacaatttattttatttatttatttatttttttgagacaaggtctcactctgtcacgtagactggagtgcagtggcataatcatagcccgctgctctcactctgtcatgtggactggagtgcagtggcatgatcatagcctgctgcagccttgaactcctgggctcaagaccctcctgcctcagccttctgattaactgggactacaggtgtgtgccacaacatctgtataattttttattttaaaaacttttttttttgtagaaactaggtatctctatgttgcccaggctggtcttgaatatctgggctcaaactcctgagctcaacttggcctcccacagttctgtgattataggtatgaggctataatttttttaaattatgggaaggcactaggcctttctcatagttttaaaaaatgcattaatttttttttttattttttgagacaaggtctcactctgttacccaggctggagtgcaatggcacgatcagggctcactgcagccttgtcctctgatggtcaattgattatcctacctcagcctcctgagtagctagaactacaggtgtgtactaccaggtctggctaatttttgtgtgttttgtagaaacagggttttgccatgttgcccaggctggtcttaaactactgattttaagcaatccaccagcctcagcctcccagcgtgctgggattgcaagtgtgagccaccatgcagactcatgcattaattcttgatggtgacaccattactttcaacttcattaagtaaaatggaagcttatctcaagaaaccatttctaaaacatgtcacacattagagagataattgatagaatacttcgacgattatttgagttcttaaacattctctctctgtatatatgtatttgtcaggttctaatatgctgagtaattcaagtttttgaatgcaaaggcatccagattctcattttaaaataagaatctgcaacagattgagtatctctaattccaaaatctgaaattcaaaatgctccaaagtccaaaactgtctgaatgctcacatgatgctgaagatgacatttgttgttgttgttgagatggagtctcactctgtcacccaggctggagtgcagtggggctctctcggctcactacaagctctgcctcccaggttcatgccattctcctgcctcagcctcccgagtagctggggctacaggcgcccgccaccacacctggctaattttttttgtatttttagtagagacagggtttcaccatgttagccagtatggtctcgatcttctgacctcgtgatccacccgtctcggcctcccaaagtgctgggattacaggtgtaagccgctgcgcctggccgaagatgacattttttaacactgaagagaagtgcctatatgatgaaaatgtgtgataggttcattgtaggactagagtagtgtgcatttgtaacagaataaaaaatcttgtccatctataaaatcaaagatgtaaaccactgctaataaggcaagtgactctagagaaaaattttaagtagccatccagcagaaagcctcctcatctccacaggaaccacttcctgttccctcaattgcttctgatgtttattctctcctaaaaaatatatagtagacagtaacattttagtttattgtttaatggctaatatatgtattctggtgatgctgttcttctacttagctactacaaatgcattactttttcactgcattaattgcatgcttttttttttttaccatttaatacttctgtgtgaaaatgattgtttagcagtagcaatataaattcagagtcagaaatagtggtgatgccaaacaaccacagattgtccacataggtggctgagatactgctttctgatggtttaatgtacacaaatattgtttcattcacaaaattattaaaaacataacttactttcagtccatagaaataagatgcatatgaaatttaaatgaatttcgtatttaaacttgggtcccatccccaaagtatctcattatgtatatgcaaattcttgaaactgaaaagaatctgaaatctgaaatgttggtcccaagcataagagatattcaacttgtactaacaatattagcatcaaatatagaacctaacctttatgtttggtagtgtgtagtcattactttcaaaatggataaaggagcattggggagaaatctgttaataccttctgtgtcaatcaaagttctagcagaaaaacaaatcaactggcagttagacaaatagagaaaattgagaacaagttacaaaaatggagggactgaaaagtcaaatagtaccctgtgaaacaatcactgcagcagtatggctcccttaaggctgagagtagtagtattacctaagcacagaacctggatcttatagaatggaccatggtagggggcagctgaaagggagctggaaccactgaagtactgcagtcttagccagagacatcatccaaagcagaaagaaggtgggagggagagagagacagaaaggcagggagagagagacagaaaggcagagacagagagattgacttattcttgtttttcagtttccatctataacttccccttattctgttgataaggaaagcaaatcaatgtcaatgacaggtattaagtttctgcaagcagagcagagcaggacagggtaggaaatcaatttgagataatatgcaaatatacttgtaagatacataagactagtgggcatacgatcagtccagtcaattttcactagagccatttactctgtacaactatgaagagaattatgagcattctacagggctgcagaggagcacaacagtgttgttagttcctggatattactcccttctaagtattctgcaacatactcttatttgacaaaatggacttaccgcctcggcctttcactatgggaaatgtgatagaaagcttcttctgcccaagtagatgcatctggactgtcattgtacaccagcaaggaccacacaaaacaaaaaggcagaaaatattgtaactattaaacaagattcagcagatcttgactgggtcaagtaatagtgtatatgagaaagactgctacatatcaaaatagatagggctggacttgaattctgccgtctccaattgtcaactatacaacttttttgaacttcaacttctctatgggtaaaacagtattaaatgtcattttctcaatagattattgttaacttaattattttattaaattcaatggcttataacagagggtttccacatcattggcacttaatacctattatttccctattattttttccatttatggaacagaatataaattgtacatgtgaatgtgaaatttcacattagttagtgccataaataagatcctattgaaagtgcacagaaattaacaattgctgtggttttatagttagtacacaaaatagtgaattttgttttggtactcagcccagatgtttcatatgtgtacttgcagaaatatttttttcttttcaattcagtgacttgagttaatactcaaaactttattaaattacacaatgactacaatgcagtgttattggtctgttggtgaaattacagttctcctgtatagaatgaaatttaagttgtatcttgacgactatttctttttcatgtttcctgggaaaatcttctgagaattaagccctaagagattccttcagagaagtactctgagccttcgtaaatctccagcttatttttactcaaagttcttattcaacattgaatctcttgagattttaacagagctgttaaccctgacaagtcatgcataacaatttgcagtctcagagagtatttgcttggtataaaaatgccttattaaatatttcaaattcgtctttagaaacttaccaggaagtctactctttctgcctctcattgatatgtgtctatgcaaaatacgtgctgtttataaagcagtagtaccaaaaaacaaacgaaaagaatgagaatgacacagggcaatacctaaagaaaataagatttaagttttattgtagaaaagatatcttgaaggcattctcatgtacttaaatctttctcagatttgtataaaacatcagctgagagaaactaatcctcagcatgggaacagctaactgtgttccataggaaatatttaccatgaaaatattgtataccaaaaagcaatgaaacttgaaatacaatatttttgtgattataacttttaagggaaacagtttcaaaatttaagaatgcttctaaagcacttttgaaagatttttctttaattgggaaaccaattatctagggaggggaactgttggtttaatatctattcatcaaatctatataataattcccagagaaaattagattcctattttaatattctggtggaataatggaattttagacaatatatattttcattttgaagtctagcacgtagagggtaataattttttttcttttctactatgcataaaatttgggcacacagtgtaaataaaggaattgctcagacatagagatataaatactgataatccgtttcacttgaacttttaacgagtgataaaattctttattaaagtgcccaatataatgcattaactaactttaaaaatgtcagcaggcagatcattagaagtgcctgatgttcaaaaatatcagatattcatctttatttactgtaatctacttgtaacaataactttttattttatctctcttatgatgtatctggttgcaaacataatacacaattacagatattttttttcttgacttttaacttcatagttttgcccagattaaaaagcaactataaattatgagaataaatgtccatttttcccactgaaactctagcacaccatattcatttgctagagttgccctacaaaagtgccacaggctgggtggctgacacaacagaaatgtattatcttacagtctggaagctagaagtctgagaacaaggtgtcaccagtttgttctctctgaacagagaagtgacctgtttcacagctctcccatagcatctagtggttcgctgaccatctttggtgtttttggcttgtagccacatcgccctgatatttacattcatcttcacatgatgttatgcctgtgtatatgtacctttctccacatttttcatttttataaggatgccagtcaatgtagattagaggcccgcactactctggcatgatcttctcttaactagtttcatttaaaaagtactatttctaaagaaggtcacattctgaggtactggggattaggacttcaacatatcaatttgggaggatatgatttaacccataacatataccttgattagtttacttattcatttactttttgtttattgattaattgattgtcttagtttatttgggctcacataacagaaagccatagtctaggtggcttaaacaacatttatttgtcacagttctgaaagatgggaggtccaaaatcaaggtgcaagaagattccatgatgatggcacacttcctggttcacagaaggccatcttcttgctgtgtcatcatatggcagaaggaatgaggaagctctttgtggccttcttaataaagttactaatctcttaataaagagggatctgctctcacacggtatttgcaaaaaccctaccctcaaatactgtcacattagaagttaggatttcaacatatgaatttgaggggcatatgagcatttagcctatagcattaataaaagcacacacttttgtctaatataaagaattactgaaaataccaagtcttataatttttccatctagatttcaaataaacaagaatttaagatacgaatatatttttctttcagccttaagctttctttccagtcctacctagtaaaagatccttgaacagtagggcaagagatttcttttccatccctgctatttatgtccactcctgttctgttctctgatgggctggcatttagttgggctctgctattcatgtgtgtgtgtgctcccttcaaccagcaatctgtgtactcaaagtggtaccctgatgccttcaggcactaccgaagtacagtacacatagtacacgaggcgatttgttgctctttgcttcacacacaaagacaattgtgtgagacttcctgtgcagaaatgtatgtagctgttaatgaccattcttttggatcagggcagagagttactatatatatatttttgtctgctctactaagtttcctttgttactttaaacaatcacttactcagtatcaccatgctacccttcttcctttttcatctcttttccttgtttttccttatttaacttgtcactgccttcgtgtatctcaactctcacttaacaaggctggacttttatagacaccccaagctaaacagagcaactctcctcctttcatgtggcaatttagcctattacagcaaaagaagaatgatcttgcactgtttgtgcttctgagctttttccatgaaatggttgcccagggactgctatttggacattaaaaactatttaggcttaaattgctatttcagggccagagctaatttcaaaacctgaggagtttatagcctagttttttaatggtccttattctactgttttctgtagttttccctttcccgaatcccagtaatctctatgtgcctagaactgttaacactcctcttatcagatcaaagaaagatttttgttgttgttgttgttgagacggagtttcattgttgttgcccaagtcggagttcagtggtgtgatctcagctcaccgcaatctctgcctcccgggttcaagtgattctcctgcctcagcctcccaagtagctgggattacaggcatgcaccaccacgtccagataattttgtatttttagtagagatgagatttctccatgttggtcaggctggtctcaaatcaccaacctcaggtgatccacccgcctcggcctcccaaattgctgggattacaggcgtgagccactgtgcctggccttcaaagaaagctttaattgaaataattttatatcatttttaaccatattttaagcttgctgcacatttaaagtctaatctgggtacctaacaacagactttgttttattttagttttttcagtgaggtaccagtgaaaatgtcttcaaaaccaacttttagtcgtagatgcctacctagtggtattctctgaataagttggaggcttgaatatcggttatggatcaagtgttgtgccatcacataaaaagtccctaatatgggccgggtgcggtggctcacgcctgtaatcccagcactttgggaggccgaggtgggtggatcacgaggtcaggagatcgagactatcctggctaacatggtgaaaccctgtctctactaaaaatacaaaaatttagccaggcgtggtggcgggcgcctgtagtcccagctactcaggaggctgaggcaggagaatggcatgaacccaggaggcggagcttgcagtgagcccagatagtgccactgcactccagcctaggtgacagaaggagactccgtctcaaaaaaaaaaaaaaaaggccttaatatgctatgttaataaataattatactttatagtggaagagatagtctatatgtgaccagctcaggacagtttgtggtgggaactgatttaatcaagccagaaaggttagcggtatattgagaaaactcacaggacacacaaacccaaactacctctctaagaatggagtagcacagaggcaagaacgcatctttgtctctaatacttgtaattttgagaccattgtagatttgcatgtaatggtaacattttgcaaatcttttttttttcacaatggtaacatcatgcaaaaccataaagcaatatcataaccaggttattgaaatggtacgagctactgattgtcgttaggtttccctagatttacttgtataaatttgtgtgtgtgtgtgtgtgtgtgtgtgtgtatgtctgtgtgtacgagtgtgctcagttctacagaattttatcagctgtgcctatttatgcatcaattaccataatcaaaatattgaacagctccaatatataaggatcccttatgcttccctgctataccaaacttccttgctctagtctgtctccctaaatctctagaaaataataacttgttattcatttctaaattttttcatttcaaaaacgctatataaatggaatcatagcatacaaccttttgggatttacttaattttcatttagttgattccctgaagattcatacaagttgttgcatgtacccatagtctattcatttttattgttgagtaatatttcatagtatgaatgtaccagttcatttaacaagtctctcattgaaggacatcaggatggtttccagtgtggggctatcatgaacaatgccactatgaatatttgtaagcaggtttttctgtgaacatcagtttttatttatttgttaaaatgctatggctgggcgcggtggctcacacctgtaatcccagcacttaggaggctgaggcgggcaaatcacctgaggtcaggagttcacagcctggccaacatggtgaaaccccatctctactataaatagaaaaaattagctgggtgtggtggcaggtacctgtaatcccagctatgcaggaggctgagacaggagaattgcctgaactcgggaggtggaggttgcagtgagccgagatggcgccattgtactccagccagggcaacatgagcaaaactctgtctcaaaaaataataataataaaataaaaataaaaaataaaatgccctattcaatttattgggtagatgtgtgtttagttttataagaaattgccaaacaatcacatttctatccacagtgtatgagtgacccagtttctcagcattctaaacagcaaagttactgtcaccatactatttgattggtctgtaatttgaaatctcttttagacataacacagctctcatcctctgaggatggataattgcaagtcatatttcttcttagagtctcattgttaaaatactatttaggggccagaatccttaatatattatacatatttatgatatgctaataaggattgttaggtgagcttggcatattctattttctaggatcccttgaagacacagaataaactttccctaaaattgtgtctgaagttcaacatggaagtacaaattttctttctttttttttttgagacagagtttcgctcttgttgcccaggctggagtgcaatggcacaatctcggctcactgcagcctccacctcccaggttcaagcaattctcctgcctcagcctcccaagtagctgggattacaggcatgtgctgccatgcccagctaatttttgtatttttagtagagacagggttaccaaaaaaaaattttgtgtgtgttaacaaaaaaaaattcaccatgtttgccaggctggtctcaaactcctgacctcaggtgatcccctagcctcagcctcccaaagtgctgtgattacaggcatgagccaccatgcccgggcctagaagtacaaattttctagttgaacggacattaggtcctgagtcattgacataattactaaaataaaaaactattaattgtcagtgcttccatattcaaataccaaaatgaatacaaaattccatacaagatcaattgattgtaaaaacatttttacttgatagataacccaaattagtaggtagaatttttctagtgatgtggaataaaatatcaagtatgcaccattagatgattcatcaggtacattttatgaatagatgtgaattcttagatgagcattcttacccactaattctgcaatgaagctgtatatcccttaatatatggttgtcatgttatacttagattaagttttcatttagaaacaattgaaatattatataggtgtatctaattatgcaaatcgtgttttaaaaagtaagcacaaagacacgatcatactagattcaataattttattacctcaaaatatagtattttaaatgttataaatgaatttacaatccattttcattttaaaaaatccagtgcgatgttggcactgtgtataagacactaaaggaatgagatttgaacttagtagaccagttggctgtgcgcagtggctcacacctttaattccagcactttgggaggctgagcggggcggatcaccagagatcaggagttcaagaccaacctggccaacatggcgaaaccctgtttctactaaaaatacaaaaattatctgggcatggtggagggtgcctgtagtcctagctactcaggaagctgaggcaggagaattgcttgaatctgggaggcagaagttgcagtgagccaagatcgcaccactgcactccaggctgaatgacagagcaagactccatctcatgtctcagaaacaaacaaacaaaaacaaatggacaaaaaaaggagaccagttatgtgactcattaattatgcaggtaataaataaaaagaatgtgtaagacagaaaatgacttgaatggagtgttgtgatgtcattgataatttaatatcaactcacccaccttcccaacttaatcacaaatcattccacctccagttttcagaacagtcatgaaacatgctatacacagctttatcataactctgatttaactgcaaaattagtagcaatttgatatatgagtgcaagccaaccaaatcttggttatattttattgcttttttaatgaaaatcaaaagagaccatcattcacaatgttaccaacacataaagagccatgttaaaaggtttgggaccaatattatattttagactctctttcattacagtcgatgacagggaaagaaagcaagtaatatgttttatacataaatttaattaaatttactaggacacaaccagtactgatctccatagctatttcagcatacccattttctgtgttcaaattaatcatatgctaaatgccatcacacactaaaatttgttttcctgaatgcacaggtacctctgttctacaggtgacagctactgatgcagatgaccctacctatggaaacagcgctcgggtggtttacagcattctccaaggacaaccctacttctccgtcgaccctaaaacaggttagtgcatttacacataactcgcatgcaagcgtttgctacagtaagttgcaaagcaatggtttttatttccatatgctcttttccattagatgatgtgattttaacatattttaaacatatcctcactttttctaaaacaatgtaatgaaataattgaaaataaattaatgtacatatattatgctttccctattatgttgataacccattatttatacccgtgcaagaaaatgttacttatccttcagtatttctgtaatacttaaataaataatctgtgtttaaaacaaatatggcatattacaaacattgagtgagattttcaaatatattatttgctccgcttgtatattagttttaattcttagctgaagagggtaaatagctctttgaaattttcctacattgattttgcttgtcacataaattgttaggtatacatacacacatatatataaaattgtattgtactgggggatttctatttcttgggttggcaattttttctaatgagtaaattattcagccctcaaatattgtgttaccaaaaaagaattaaaataatgtcaaagacataaatattttttcaggaaaaaatataaattctgctctccttttattttttactggccaaaacatattatgtcaatcatatcatgtcaatcatatcatatgacattatatcacatcagttatatcctgtcatatcaggccaaaatggtaatgaaggctgcttaataatgtattacaggatttgctacagcagcggaatccaaaaaccataaaaaaatcacatgtccccattgacaatcaatttgttgctaaaaatttggttaagtaaaactcatttttaatttagacaagtgttcagtaacaaatctcaagtttttctaaaattttaaggatgtacatatttatgagatggatgaagtagagagagatctaggatgttccagcagcaccatacatccttcttgagcgcaagatgcattctgaatcagatcaacatctggcatctccaagtaaatggcatagccacataactaatacaaaaaggagctattttttaatcataaatatctctttatacttctataattatatagcatataacccatttttcagggaaccttgttccataagtctacagattatagatttatttaccaatgtgttatgtgaggcacatccaactaaaaacatggtatagataagcactttctctctagctaataccactagattgtttaccaagagttttgtcattatcatgtttacaagaggatttgattgggtcacttgccttctttcttttcctggagtgctccaacatggaaatacactggcatgaatggatctcagacatacttgcttaactctttccttctttctttctttctttctttctttctttctttctttctttctttctttctttctcttgcttaactctttctttctttctctctctctcttttctttctttctctctttcttttaccttaaaaagaaaacaacgtagaacatatatagatatagaaatgaagaacatacacatgaatatatataaatatccttatatgcattataattgtagaatagattgtaatatgtagttaaagtgaaaaatagatattgggatataataaaataaataacataatgcaacttaaaatgagtatgagacctgcaggttctgttggttccaaggtatcacttaatatttaggaaaacatgcttattaatctagtaatctaagtggtggcacaaaaatgtacatatttatgattacacattattattcattagaagagcttagaattagttgaaaagctcgccattctttaatggtgatatttcacattttgttctattttcccaataataatatttgcttcaaatataaaataaatataaattcctaccttaaaatacacatctccctagaggaaagtaacaggaatgctgtttcaactgccttttttagaaatatactaacacacatgcatgcacatgtcacaaaggcatacatgcataaagacacatgcacacaaatatatgacattagtccattaacgatgccatacaaagccaaacatttatttataaatagttacaattatctaatagaatatcgctgtgatataaacagcctgtataaaattgtttaaaaaagttattttacactttttatgcatacaattggttaacaaacatcaattttgtgtgttcatgtgtctgaatgtgaatgtttgcatatgttgtgtgagtaaatacatgtatgtgtatgcacttggatggataaattaggtcactgagaccaatgctctaatagtgttggactgctgtagtttgtgatttgggggaagcaaatatatcagtaacataatatgtaaatacaatgtgcattcatttatgtacatatattatagtttaagtgagtaccttattaaacaacaaaaataagtttatctcaagtgtaaataggctgctattcaaatgctactctacaaaattttctttgctcttgcatttctttgttcctttcttcagagctttaatatattgaataaagtacatgcctccactttgatgtgtgttaatatcagtattatactggctaatgcatcatgggaacctatggatatctgtcctactaggtcattaaggaacaaaagtgtttttaaagatcttttaaatatgcaagtatcttagagagttagacagttatcagtagaaagtgctaagtagggtataaaataaaatgttcattagtcttcacaaacaacaaatttggcaatttgtgcttaaaaacccaattatgatgctgttaaacatcctcagaactaatgaatttagttgaaattgtgcagaaaagtgaatggaataaaatacaaacatactgaaaatcaaagaatcagttaagttggatggcatgttatataagaagcatggaaatagtagtcacttataatggtgtatattaatagtatcacttaattccattcccctaattagtatgactgcacctcagcatgtttccagttattttcattgaagaccaatcataataaaacataacttctgacccctcaaaatgtggacttgtgagtgcttatgactaaaatcagtgtttcgattgccttgtttccatgaaagatgcattttattaaccattgtgctcttccagagaccttggcttcctattttgtaaaccatctctgagtagctgtatccagaaaatgaattgtgtggctgttgagttactatgtgatacagaattaaattaataatatctgaatttttttacactgaaatcttatcagtatggtgaaacatcttgtgaaaaaaatgtattgtttttaatgactttcgttaaggtaattttatgatttgtgttcagtgtgtaccaacaaaggacaaatgtgcactaaaaaatgatggtttaacattaactaccatttaaaaggtacaggggcctacgatgataaaatataaaatacatatgctatttctggctagattcataggaagaaaacattttttacagttattaaagaaaacattttactatctaaggaaacagctaaacctaagcaatgcattttgaggaaggccactgagtgagaaagtcattttgagttatcagaaaatgaaattcaagagaaatctgggatgatggttgtttattagcacaactcaaatctcactcttacttcagttattatagtgtaaactgagttaaaaataaatcaatatttcaagttttctatgccttttcagaaaccataaaatttttgtcaggtggtgactacaaaagctgagtgatcaaattcctacacaaaagaactagttcccataacataggttggagacagaaccagaaatctaccaggtatcattccagggccttagaaacagaatggaaactttccatttccttacggaatggaagaccagtgtagtttttaactggacatgaaaatctcttaatgctcattactttcatggccatttgatgattctctgattgctgtttcatagttaacaacttatgaactacttaatattatttttgttagtgcatctaatttaagtcatgcctgtgtctatttcatacaagtatactgaatcttcctgatgaccaattcaggaagcctgaaaacctaaattaaaacctgatgtcacgaaaaatacaggagtatactgttttacaaaatcgtagttaaacctcccttacaattgtttatagtagtcaatatcagctcttttgaccataattaacatgaaatgtataaatcattgacagtcagtaatggagatcatacatttgtataaatgattctcatagtgggtttttttcacatgcccagtaaatactactaagccattttttaattttcatatttgcgtgtttatgttttaaactcatgtatcatttttcatacagtctttacatatcttaatgtaagaatatttatttataaaatatagcggctgaaaacatttacattgatacattctacatttaattgtcaggtacataaaaatagtaagatcagacaggctatctttatttatatacaaagagcataccacatttttttaatcaacactcctaatgtatttcggtattttaattttttgtgttacatgatattaaaaaggagtagacattgaacttcaaatattttgtcagtcagattcttttgcattaataacatctatctcacttagatgagatagaacactatctcagatgctaagaacacttagcatcaagtaaaattccctacacctaataatgactatcagtttcaaagacacagtcagattattatttattttgacatggcgttattataaatatcatgaagaaactgcttacttggcctttctaccaaagattaatatactatttggagtcacgttatagtttaattaatataatataaatatagcgtaaattataaatattttttctgaaatagtaaggtttattgcaaaagaagttgaggatgctttgtgttcaaattctagaatactacttagttgcttaataaattgatcgaattaattaagttttttgcttctgtttccatgtgtataaacttagaatggtaatgcctaaatcccatgggaaaatgagggcaatgctcttagtccagtccttggaaaaatataggactcaagttatcttgtctccttctttaagattgacaagaggctgggagcggtgactcaagcctgtaatcctagcactttgggagacccaggtggacggatcacgtcaggtcaggagttcaagactagcctggccaacatggtgaaatcctgtctctgctgaaaaatacaaaaattagtcaggtgtagtagtgcatgcctgtaatcccagctactcaggatgctgagccagagagaatcgcttgaacccaggaggcagaggttgcagtgagccaagatcgtgtaactgcactccagcctaagtggcagagtgagaaactccatctcaaaaaaaaaaaaaaaaagagatcgacaagaatttccaaaattactacattttgaatgattatgagaatttgaaatagtcttatctgaagtagtaaaaaatgattattttgtttgaaagaactttttagtcaaaaagttatataaatttattttaaaaagataagatacattatgaacttatatgcgattaaattctttccaaacattttctagaaatcttttacaaacatgataaataagagaaatataccattggaaaattgtgaatgataatctgtaaggagataaaagttagacaataaaataaccaaccttttatcttcggaattgacagtcttgactcagaatagtgtctctagatgaggtaaactgccatgctctgtctgaaacaacagccactaatgcagagctcttgacggacaataactgtgattcttcaagatgaccttttctcaacatattgtaacagaattcaatcagctataaaaatgaactcagttaaagacctcaatgaatttcgtaggatataattgaaaacaaggtttttcaacattatttcttcagtctgcataaagtagttaaattcatcaacattttttggttctctattacctccccaaatttatttcatttcatttttgctcagtgaggaaaaatattaagtctaggaatgatttctctatatgcttaaagaaactatataaagcatctttggaagtcctatagattttaaatttcattttgtatcatttcatatgaaaatctatttgacaatagttttcactttccaaagtcaatattttatatctattaaaagctaagacaataaaatatttaaattgtggtttacaatatctgcagaagataaagaagatttcacaatagaatatgctttgtcaatttatctttttataacccattcctattgataataataataacaataataattgcttgcacaaacaattttgcagtatgtcctcacttatcattcatagattcttggaaactgtaatttttaagcaaaataaagtataatgacaatatatattgtttccgtcaatgttataaggaaatgaagtaatggaaatgacataatttgaggacctgctgtatgtcccttctcttgcaatcaccattttaaagaacctattaaggacattgagaacttactgtagaaacatttaaaaataattattttatattctcagacaacagacaaacagacaaaaatggttaggtagtcatcatcaaagctaagtaatttgttcctcttggaaaaaaaattaataggttccatttactgaaaaaaaaaaaaaaatctcactttgtctactttagggaagaattccaagtagttcctgaactgcagcagattgtgtgaggacaacaacacaagaaaaaaaatcagctgtagatagcatttaagaaatagagagttattaaattctagtagacattagtggttgtctatttaatatcaatttctcattttgcctgtcatatcataactctgattttactcagggtagcaacatatgcagttaaaaatctagatttttccaacttccctgtatctatcaacactgctctggccagtgaggccactgaggtattttaggaaaatttggaaatctttataaaggtgccaatgctccctcaatcagctttatcatcttctggatttaaacatgtatttgtgatcatgtgacaacaagcacacaaagagaaggttacatggaaattgctgaagaaaaggacctcaatgaagtcactccgattatgttatttttatattcagatgcatgccctgcactaactgatacctgggacctttgtgaaatgcactttgcagacatatgaatcaccttcatagtacagtgcactgcccaggcaggtgttgagctggcttcctgagaatactttcattactttcaacctgaaatctatgaaccagagagagcacactgctctctctccatgagtaaccactttacagtttcagtgcaatatcaaactgcaaaaggacatttttcacactgatttaaatgaaatatcaaaaggtatattaggtttgctatttgggggaatcaaaatgaaactaaatgcatttttctctgatactccactgagaatgcatatttattagataattgtatttccaaaacaaagtaccaaagtactttacagacactatagatatcagataactctcctactccgtggcaagatcatagtgtccttttgacatcaacagaataatatctatcaaatttaattcctctgcatatagttctaacaaaatgcaattatagatcagtgttctattctagtcaaactattcgttgtagccctagatgaaacaattaagatggaattaggttgaattgtacacttaagtaaattttatggtatgtaaattaaacttacaaaaagctgttaagcaaacagagtaaggaaaccaattgaatgtacttcttcaaaaatatcaactgtttgtcaaaaaattgaccagctgctaccaggagagtaaaaaaatcatctaattcgctataaaatggtagttatacctttacatatcaaaaagataagaatcaatgttggtcaattgtagcatatcttatactatttcttcctaataaaagataaatttacttaatcttcttttttttgtgacctcgctctatgcctcctgcatctcaatagtaactattgagaaaaaaaaaatactgggaattattgtttagccaatagcgtggcaaatatattagctattaatactagttaatttattgtcaaatattaaatcaatagataacaggaaacattgcgattgtgttctttagtctttaaacctgattaaacataattcatgttatataattaccaagcaatttgatttttctttcattactttaaatttattctgaggtcatttatcctactgccacaggattaaatgtactgcaatcccattgattccctagattcttccctaacccagtatcttagatatgtacaatgaaatctagaaagcactagaatattattaatgttccacaatttttaccactatatatacacatatatatagaaaatacacatatataattttcctattatatatacatatatgtagaatacatacatatatataaatatgtgtgtgtgtgtgtatatatatatatatataaattttaagctcatacttacttctatatttcaaccaagcactgcttctatgttattttttcacttagtctattgatcttcctggcatgcccttcccacacaaatttacacttcagtggttgattccctggactcttagaactaatctctgatctttgagtaacatttttacattcctcctaaaacatagcagtagcccttttgttcatatggcatttcttctctactctgagagctctataagggcttcaataccatagatgttactgttgctttccacaccaggcctccctgagtgctttacacacagtagcaagtttttaattatctgtattttcttttatttctataaatttgagggatacaagtagagttttgttacatggatatatagtggtgaaatttgggcttttggtataataaacacccagaaaatgtactttgtacccaataagtaatttcccgttcctcattcctgcccacccttcagagtctccaatacttattattccccactctatgtccatgtgtacacattatttagctttcacttataagagaaaatatgtaggatttgactttatctttgcattattttacttaagataatggcttccagttccgtctatgttcctgcaaaagacatgatttcattctttttaattgctgagtaatattccacagtgtatatgtagcacattttgtttatccagtcatccattggtggatacttactgtatatttgctattgtgaatagttctaaataaacatatgggtatagatatgcttttgatacaatgatttcattttctttgggtagtagtagtagtgggtttgctgaatcaaatggtagttctattttgagtttttttgagaattctccatgctgtttctcagaggttgtgctaatttacattcctatcaacagtgtataaacattcccttttctctgcggtgtttccaacatttgcttttttttttttttttttactttatactaacagtcattctgacttgtgtaagctgttattccattgtggttttaatttacctttctctgatgaatagtgatgttgagcatttttttcaaatgcttgatagccatttgtgtctccttttgagaaatgtcttttacatgcttggcagcccttcgtatgcctccttttgagaaatgtctgttatgtcttttgcccactttgaaatagggttatttgtttgttgttgttgttgttgttgttgttgtagtttatgagttgtatgcattcgttgtagattctggatattagtctcttgtcagatgcatagtttgcaagtattttctcccattctgaaagttgttcacttggttgatttgttgcatttgctgtgcagaagcttttattttaatatagtcttacttgtctatttttgtttttgttgcatttccttttgaggttttaatcaggaattatttgcctgagccaatgtctagatgagtttgtcccaggttttcttctagtatttttatagattcagatattaactcttaatccacctttagataatttttatatataatgagaaataggtgtccagtttcattcttctgcatatgacaatccaattttcccagaacaatttgttgaatagggtgttctttcctcagtgtttgtttttgttggttttttaaaagatcagttggccttaggtatgtggcttcatttctgagttctgtattatatttctttgatctatgtgtctatttttatgttagtactatgctgtttggttatgatagccttgtatgaagaaccaaactgaaggcatcatattattggacttcaaattatgtctcattatctttattgaaggcctacattatctaactttaactacaaaactaagtttttaaaagttttgtagaagaaatgacttgtggattattatttttaaataaatattagtaatatttgtattttacataacatttgtcacgtctctgatcttctgtaaacagtttttattttgctacttctatcaattttgtaatattctagtttaggatttttccaaatgattgccaaaacagtagtatttcagagctcttagaaaactaaatatttttggaaacatgataaataaaataattctcagtttacaagtttacaaagtaaattatttctgagaaacgaaaacaacatgttttacatgtacataactaaaaaataaatctctggaatgcaagctcactgagaccttgcattactcatttttgtatcttccataatggttagtgcattgtgtgacacatagaagacaatatttgtttatatagaaataaaatctgactttgggaaggcagttattcaaaataataccatttctaatattaatgctcatggttttttaattgtcttattttatttctcaaaaatattcccatcttccatatattgaatttagaaaggctgaatgtctgaataagagaagaatcattaacttatgagtgttttatttttgttttttgagacggagtcttactctgtcacccaggctggagtgctgtggcatgaccttgactcacttcaacttctgcctcttgggttcaaacaattctcctgcctcagcctcctgtgtagctgggattacaggtgcctgccaccatgcctggcaaattttgtattttttagtagagacagggtttcacaatgttggccaggctggtcttgaactcctgacctcaggtgatccacccacctcggcctcccaaagtgctggaattacaggcatgagccactgagcccagccaaacttatggttttaaggtttatgttttttctattattgttaaaatctcaatttcattttctttttgctttggtcttatgtgcctaactctcccaacattttgggatatgccttttctttcttttctttttttcttttcttttcttttcttttttttccttttcttttctttcttttctttttctttctttctctctttctctcctttttctctctctctttctctctttctgtcattctgtcttccttccttccttctttactttctttttttgttgttgttttttgaaagagtttcactcttgttgcccaggctggaatacaatggcaaaatctcggctcactgcagcctctgcctcccagtttcaagtgattctccagcctcagcctcctgagtagctgggattacaggcgtctgccactgaacacagctaatttttgtatttttagtagagatgggtttcaccatgttgatcaggttggcctcgaactcttgacctcaggtgatccacacacattggcctcccaatgtgctgggattataagcatgagccaccgtgctgggccaagccttttctttaaaatacaaataaatgtctcaagctcccatcctatgcagtatcagaagaaagttccccaaaccctttcctccacatatttccgaagtaagtgccaggtgagtggtaagtgccaggtgagtggtaagtgccagttgaggggtaagtgccaggtgaggtatcagagccactgccatggcaagtgattggttcatgggtaataagaggaatttaccaacagtacaggtttgaaaggaaagttatttatttatttatttatttatttatttaacagagtctagttctgttgcccgggctggagtgcagtggcaccatcttgtctcgctgatgctgagaccagctcggtcatggagtccctaacccagtggtgctagaggaattaaagacacacacacactgaaatatacagtggggagtgggaatcagggggctgacagccttcagagctgagagctgcgaacagagttttacccacatatttactgacagcaagccagtgataagcactgtttctatagattatagattaactaaaatgggaaacaaagggatgggctctggctagttatctgcagcaggaacatgttcttaaggcacagatcgctcatgctattgtttgtggttcaggaacgccttaagcggttttctgccctgagtgggccaggtgttccttgtcctgattctggtaaaccaacaatcttcagcatgggcatcatagccatcaggagtatgtcacagtgctgcagagattttgtttatggccagttttggggcctgtttatggccagatttgggggcctgttcccaacatgtccccccctttttttttgcaagatgataaaagcaaaggcagctttatctccatgagctacttctcacaggaatcacgatccacatctgcagagtatataaagacaaacaacacaaattaaaagcacagtcatcattgaaatcacagagcctccaggtgtttttatccatttaaatgggttaatagctactaatccatctgcagctccttcaagcactccagttcctgacagtaagatcaggtgtgcctgggatgctttaaatatttgttcttttaattttgcaatatccaaaggcaagtttgtagagtgtccttctagatgctttttcattatttcccaaattttgatcttactaagagccattaatagtttccacaaatccttatgtttagctcctagagtgggccatatcatttgaggttgaggtgccactataccgccatgtttccagataataggaactcttgccacacttcttaaccatttctaccatctgactattttattcagaccagctgaacgtagtgtggccatggcatgcagatggagaagggcaattcaagctaaacatccccttaggggactattcagtaatgattccatgggaattattgtgcagcacctctgcctgttctgcaatgcaatcttcccaaacaagcacatttattttttctgaccaggtccaatcctgtttacaaataggtttttgatgtggtatgcctcagttataggagcagatttattatggtaaatactaagaccagaaagcaagtgtaactgtgtcatagagtgattacatccaggcattattgccagccaagattgatagtgaaggtgtaggcaactagtggcctttcccaaacagataggcagatgttcaaatcctaaagaaatattcataacagttccttcctcctgtgggtgagatgggcctctatcatctgtaggactgaacatccaagagctatcattagtgtatacctccactggggggtccagccaagttacaggccgtagaagtggtggaaaaggtaaatatgcccaataagtataattgttctctgtgtcagcccttgttaaaggaatactctaggcaatggtgatcaccactatcatagctatcattaagttactcattgtgactggttgtcctgctttcctcaggttttcttccaccatctgcgacagcttcttgatctgtccccaggtaggtggctgtgttcaacgggtgttgctcgtgacagttggggtcctcctcagcatgaacttgagcaatgctgccaatgatgggtctttgggatcctcccaaaacctcttcctgggtagctggctcatagtacggctttagatgtctcgatggtgcccaaattggctgttgattcagtcctggagaaacacaagcatagtctctaccccaagttattattttacctatttcccaaccttttgttatcggatctctccaccaaaccagttgctctgcttctgtctttacagctggtttctgtagatgctttttagctgctgatagcatctggcctttaggcaggctcaaaaaatttaaagtcaataatgctagattcagttgtatatgtggagtcccgtagtccctatttcccctcttttgcttttgtgactgtggtttcagggagagattcattctttccactatggcttgtccttgagaattatatgggataccagtaatgtgtttaatattccatatagataaaaatgtagctggaatttggctagtatagcctggggcattgtctgttttaatagaagctggaatgcccatcactgcaaaacactgcaaaaggtgacatttaacacaggcagaagactgtcctgattggcatgtagcccagacaaagtgagaaaaggtgtccacacatacatgtacataagctagtctcccaaatcagggaacatgtgtgatgtccatttgccaaagagaattaggttccaatcctcaaggattaactcctcctgtaaaagatgaggaatgcaccatgtggcaagttgggcaatgctggataatagctttagcttttttccaggtaatgctgtatctgcgtttgagaccagaggcattaacatgggttaaattgcgaaagtgtctggcattagatattgcagtagcaactaggcgatcagccatttgattccctgcagtcaaaagtcctggaagaggtgtatgagccctaatatgagtgatgtaaaagggtacattctactcctaactgctgtttgcaattgggtaaacaaagttatcagttgctcatctgtatgaaatcgtaactgagcattttcagttaattgtgtggaatgaaccacatatgaagaatcagaaatcacattaatatgcatatcaaaagcagtcaatacctcaattacagctacgagctccacttttggagctaaagtatagggcgtctggaaaactttacattttgagccagaataagaagctttaccattactagacccatctgtgaagacattttcagcaccttcaattggtataaatttagttattttagggagaacccaattagttaatttcaaaaattgaaacagtttcattttaggaaaatggttatcaagaatacccacaaagtcagctaaatgggtttgccaagtaagactataaaagcttgctgtatttgtgccttcatgagagggacaataatttttccaggatcatatccatgtaatttaacaatccgagttctcccatttcctatcacagtagtgatttgatccaaataaggagtcaaagtccatgaattagtatgtggaagaaaaagccactctacaagatcctgctcttgaacaataacaccagtaggtgaatgctgagttgaaaaaattagcaaatctagagtattctctggatctattttatctatttgagtcttatgcacttgcttctcaattagctgtaacactgtctcagcctcctttgttaattgttgagggcaactgagactaggatctcctctaaggatagcaaatggattactcatggcataggtaggaatgcctagggcaggtcgtatccaattaatatcccctagtaatttttggaagtcatttaatgttttcaattgatccctacatatggttactttctgtggcacaattgtagtgttatttgctaaggtccccaagtaggagtaaggagtagtagtctgaattttgtccagagctataattaaaccagtgtgagaaatcaaattttgcaagtgatcataacgttggagtaatatttctcaagtgggggcagcacaaagtatatcatccacgtaataaggtaacactgtgaaaattttttacgagtaagttcagctgcttgccgtacataagtctggcaaattgttagactgtttaacatgacttgtggcaacactttccagtgaaaacgcttagcaggctgcaggttgtttactgcaggaattgtaaatgcaaaccgttcacagtcctgctcagctaagggaatagtaaagaaacagtcttttaaatctatgtctattaaaggccaattttttgggcttataacaggagaaggcaatcctggctgtaatgcccctatagattgtataactgaattaatggctctaagatctgtcaacattctccatttacctgattttttcttaataacaaagactagagaattccagggggaaaatgttggagctatgtgacctttttctaattgttcagtaactaagtcctctaaagcctccagtttctctttacttagtgaccaatgttctatccaaattggcttatctgttaaccattttaaggtataggttctggaggcttaacaatggctgccatcaaaaataatatcctaaactttggcgggaactttgtctttctgcttgacgcaattccttcaaatcttgcaatttttttcctcgtcccataccagggacatacccctcttcacgtatcatatgttgaccttgagggctgtataattgctctggaattagaacttgtgctccccattgttgtaataaatcttttccccataaatttataggtacaaaagttataactggttgaatagtcccaggttgtccatcaggccattcacagagcaaaatataactactttgatatacttcaggagctttacaaactccaactatgttaaaatgagcaggttaaactggccatgtggacagccagtgctaaagagaaatgattgaaatgtctgctcctgtatctaccaaacctttatatttctttccctgaatagttatttcacaggtaggacatttatcagtaatttgattcacccaataagctgctttgccttgtttatttgtgcctccagatcctcctgttcgtttaatttcacttttctgatttccacatatgacacaatcaggagctgtgctataccctctcctggctctgctttccagggaacagaagtagatataataatttgaatttccccattgtaatctgaatcaatgactcctgtttgtacttgcactccttttacatttaaactagatctacctagaagtaatcctatagcccctgctggcatcatctgactggagacagcaacattctttaacagtcccattacaaaaggagaacctagtccatattgattaatagcttgtttaaatcctttaagtattttaaaaggaaaaggctcaaatgtagctataatatttccctgttgatcggcggggggcagggggggcagggggtgtgtgtgtcctaatggggaactgccaagcctctatatcaccctctcttctagcttgctaaattcctggctgaatagaactgagagcagtcactcgaggcactgcttgaacagtcactggggcaactactttttgccctgtgtcctccacaaaagaaagatctggagggtcaggccaccctttttcttcaaaataatgagggggtgcagaagggtagggacaaacctctccctcctttgccgctttagctttagctggcaaacaaacctgctctgtcacctcttctgttacttagttatactctccttcctcctcatcatcattgtgaaaaggttccaaagtggaatgaaccagagcccacacttgcacattgttaccctgatgcttccaagctccccttcttactcaccacagggattgcttaagagtactcaggtgtcctccagcttagttccatgttctccaaccgtcactctggcaacccttcgacccaggtttgagccccatgtataggcaccacttgccgagaccagctcagtcgtggagaccctaccccagcggagctagaggaattaaagacacacacacacagagaaatatggagtgcggagtaggaatcggggctgacagccttcagagctgagagccatgaacagagttttacgcacatatttattgacagcaagccagtgatgagcattgtttctataaattatagattaactaaaacaggaaacaaagggatgggctctggctagttatctgcagcaggaacatgtccttaaggcacagatcgctcatgctattgtttgtggttcaggaatgccttaagtggttttctgccctgggtgggccaggtgttccttgctctcattccggtaaaccaacaaccttcagtgtgggtgccatagcaatcatgagcatgtcacagtgctgcagagattttgtttatggccagttttggggcctgcttatggccagatttgggagcctgttcccaacacactgaaactccacctcccgggttcaagtgattctcgtgagtcagcctcctgagtgcctgggattacaggtgcacgccactacagacccagctaatttttgtatttttagtagagacggggttttactatgttggccaggctggtcttgaactcctgacctcagctgatcaacctgtcttggactcccaaagtgctgggattacaggtgtgagccaccacgcccggctgaaagggacgttttgttagttagaaagaatgctgcagcagggcgtggtgcctcatacctgtaatcctagcactttgggaggccaaggtgggctgattgcctgagctcaggagttcaagaccagcctgggcaacatggtgaaaccacctctctactaaaatacataaaattagccaggtgtggtggcacgcacctgtagtcccagctactcaggaggctgaggcaggagaatcgcttgaaccctggaggcgggggttgcagtgagctgagattgtaccattgcactccagcctgggggacagagggagactccatctcaaaaaaaaaaaaaaaaaagagagagaaagaaagaaagaacactgcagaagagtgtagcggggagcttcggcaacacaggactgagtgcaccgtggtggatttttccttaggggtatttgtaatccttaaagcaggagcttaagggtaatttggaccatattagccacttaggtcatgataaatgattatatttgtagacattttggtgccttgatgtgagcaagacttgcacaatacgtttcaacatgcatgcattccgtagatgtatagaaattttagttacttatacttttctgggaaagaagcctggtaccagatgctggttttagataatagggaagtctcattatttctaaattcctcagataaagagttttgtctctgtctggtctgcttgatggccaccaggtgatctttgctctcctcagaaaggagagctgagaagaaacttgtcccctgcttgcccagtcataaatcaattttatctctaagcggtactatcttctctttattcttgctggacaatagagccaatatgccttcattgcccccaaacactgttaatacaggacttcgggggaaccagactttttctaaattttgagggaatatgggagataattgtgatctatgaccaaaggggtcaacttgaaacaaattaaatacctccaaattcctcataactctgtgtcttaggagactaaatctcctgtttttatttcataagggtctcatctccctcactctttgggccatatttttttgtttgtttctatcttttcactgtcttccagaatgttcacagaaactcaaatattactatgcagagaaatatgaatcttctttgccttacttttgttcactgacacactgacacaaacaggatattttatcctttttcaggagatatatacagcagggattttttttcctccaagagaagttgtccttcacagagctatctgattaaacctcagtcattttttaaaacacataaatttcccactttgctaactagagattttcccaaatatacaagatttaaaatttgatattttagccatatttttatctttttctgtatctgtatccttagttaatttttttttatcatttacaataattttactgaccacaattactatttgtctttttgggatttcttgatcgatgcttatttttttgctcatttttttttctttttttctcactttgtttcctcactttgtttccacactttgtttacttaaattttttgcacttttctaacaaaatttctatttcctaatttttttctctgaatcagatagtaactaaagagttacacaagtatggattttaaagaaactatgatggaaacaaggcccatagacttttcctgggagataaatgaaagccctttctactgggaatgtttagatacaaatacatgtacaagcctgggagtccactgaaattgattggcagtatggatttgctatcagcatacctgtgcttgcaaaagacccacaggagactgtcattcttagtttgtgaagcagtcatcctaagcaagagcaaatgcacacattaaaagagagtgctttctgctcacaatccttctctgtatagaaactgtgcatgaaaaccccagaaattaaaggaaaaggtaataaccatttaaataacttaaacaaaaatgaaatctctctatctccccaaacactgtttgtatacacagagagacacacaggcatatacacacacagtcatgcgctacacaactatgtttcagtcgacaatgcaccataatacaatggtggtcgcataagattgtaacgttatgattttactatacttttttatttgtagaaatgtctagatacggtatttcagttgtttagatatgtgctgttgaacacattgatgttgtttggttcatgtgaatacagcacagatactcttattaaacaaataaagtttggttaggaaccctggtttgtagtataagttgtacagaattgtattcactcagaagcaaattaatttttatggagtataagatgattgctactttacaaaaatataattgtatcttactctttcgaaagacgaaagacaaaagagggcataagtatttctagaaaaaaattgtaataattcataaatatctcaaattaattgaatgtattcttaagtttgtatacatttaaggggtacaagtacacttttgttacataggtatatttcctagcggtgaagtcttggttttcagtgcaactgtcaccttaatagcgtacactgtacctaataagtaatatctcatcaaccacccccagtttgggctgctattaatgatatcatagactgggtggcttaaacaacaaacatttctcacagttctgaagactgggaagtccaagattattgcactattgtgatgaggaatctcctcctgatttatagatgactactttcttgctatgtcctcacatggcagagagagagatgaagagatagaaacacacacacacacacacacacagacacacacacacacacacacacacacacatggagaaagagagacatcatctctctcatgtgtcttcatcttcttataagagaactgatcccattcgtgagggcttacccttatgaactaattacctctcaaaggccccatctacaaatactaacaaattggggattagggatttaacttataaaatttttggggaaacaaacattcagtccataacaggtataaagttgtatcttagaatatgagctgtgttgtatagttgaacactgaagttggattctgtacactccctggatcctgactacatattttttgaaatatagtttggaaactctaactagcctttcatagatcaattgcaggttatttgggaacattgaataagacaatatggatgaggatatataacctaatgcaaaatatgagtgtaataagagattaatgatgtgcatataatcagtgagtatgcctgtgcttgtatgtgtattgaatagacactgaattaacctattacataaaaattctgattacttaagtattttagaattagaaatgtacacaaggatcatgatggaatataactcatataatagttcaggacagaagaaatgctgattagggttaagctagtgctctattctgttactgtaaaggatggggactcaattatgtttgggaacctgtagggaagagaaacagactgccacaaacatcctaagaaatacttatgcaagaaattatcattatatcttatgctgagggcctgcagttgctactcaaactttgaatcaaacctgagatggtgatcattcctgaagtttaaatggtgtaatcacctatcccaatctctccaagacacagaaatattgaatatctctttctttctctctctcttccacatcttttctctcccttttcaaaggtgtcatttatgtatacatattatttttatttttaattcacatacagatacctaaactattccatttttaagagtagaaatcatgcctatttatattttttattacattgattcctattttacaacattctatctacttataatttttaacttattgtgattttaaagttttattttataattaaaacacatagctgttttagagatcattatcaaatgtttggagatattttatatttttattgagccaaattagcttttgatatagtcaagatccatatataatattgagaaccacctctctcctgatgcttggattccaaggcctagttttatagattttataattctatgtatttattaaattgtaacatatggtccatacacaaaacaatagcaagcctttgatctcaatgtgcaagctcataaaatgataatgctttcataaaaatagatgaaagaaatcatttatttaaaaaaacttccatatcttaaaatcaggggagaacattaatcctttcactaagataatcttattatccagaatgtgacctattcttgtatacaggctatactttctaattgccatatgatgcagatctttgtaaaatgatttaatggaacctgaatttgctaagataggtgcatataaacagttatagatagaatttatctgaggttgagaagctgcagcatttacagtatttaaaagtagcctcacttgccagtgacagagaaagattccatgtgaatttcagtaaagtatacctgaataagagacccggagcaggcaagactataaactgccttcctagacaaagcccatgttcatctgaagaggatagaggtggatccctgggcaggcactatgaacacttagaggaatcaactctatttgctctttctgaaaattcatgggatacacctaaggctgtcattggccactcttaatggcataggtgtcattaagatgaaaggctttcaatttttcttcttgtgaccctaacaaagtgttttttattcacttattccagaaatattaaactttccttctcatattttcttcctttatggaaagtctagagccttttatcaggagtattcaatcatgccactttgttaaactttttttctgatgattttttatattattgtgagaaagtatagtcagagtttatgtgtaaactttgcataaaataatctacattttgcagttttactagtaccctgagttttaaaatgaaattctttaaatcatacattacgtattcaaatataaaccacttacaataaccaatatgcctacagtcaaaatgaatatattttcaatacacaatttaaataatgcatcagttttatgtagttctatttatatgagctatattaaatatgcaactgagattgatgtatagctaattattctcattccaaatagcccgtatgacttaattttgtttcatatttgaaaagtcagagaatcacctgcagcaattgcaaaatattgggatgtatgtgggagataggtcatatttttagaacacagaacaagatattttccacttctctagatattttctgtttttcttaatacaagcattaaattactcatttcagctggagcttctactatttttatagctcttgtagaagcaaactcactcataagattcatttcaactgtttcattcattgagctagtatttgttgtttgcatcttatgtgcaagactttctgttgagtattgtttggttaatggaataaaacaaatggttatattgcagacaacaatatctccccttcttagaacattaaacaaaacttccaaactagcactcacagttattcaaatgaactatgcctatcatatttctccagtagaataggaaaaatgtgtttgagcttatcataagccccatttataaatgataaatgcattcagtcctatggagaacaacttggtggttcccgtactctcatcatagatgataaatcatattcaaaacaggattcaactgaaaaatatttttggctgggtgcggtggctcacgcttgtaatcccagcactttgggaggccgaggcgggaggatcacgaggtcaggagatcaagaccatcctggctaacatggtgaaacctcgtctctactaaaaattcaaaaacatcagctgggctctttttttttttttaagatggagtctcgctctgtcactcaagctggagtgcagtggatcaatctcggctcactgcaaactccgcctcgcagggccacgccattctcctgcctcagcctcctgagtagctgggactacaggttgtgccaccacacccggctaatttttgtatttttagtagagacagggtttcaccatgttgaccaggctggtcttgaactcctgatagagatcaagccactgcactccagcctgggcagcagagcaagactctgtcttaaaaaatacgcacacacacacacacacacacacacacacacacacatatatttggtgcagactgcatataaatgttcagtcttcttttccactaaatcttatgttggttacataatatacccatattctctatagcatatctttgccaataaagtatacctacacagttctttctaggtttatcatgaatatattttaaccatcaatcaagatataagttttaaagttttttaaaaaattacctggagaatttttttagatgaaaacttgagagagatgaaaaaaccctatgcttacgctgatagttttaattaaattcatgaaattgttaccagcaaaatagatcatcttatttgataatagagcagtaccatcaaccttattttgatttttaggtgtgaggctgcattccagttttgattgctgatactgatgatgaactcgctcctgaagttaatcactctcctcacacacataaagaaatttaacttctggttgctgtaacagtcaaaggttgctatacatagtgcttgcaataaattctgattggatctttagagttgaagttataggaaatgtcaactcacacagcactaacccattcctgattacagccccccaggatgctgattgcaatgtagaaaactttgtaaaggacaagggttgtgtgtcattgtcagcgaactttgaaacaataattgtgattttatgactatttgttattactgattgtatgtcaagcgaaaaaaaacctctaatgcatttttaggctcttaatgccttctaaattttacataaagtagactagctatttctgctgtataagcagattactaatcattcatttggtccctttctgggtagcaagttgatacttaatattcaagagccctgcatccttagatttaacactgcagtgatattttaaaaattatcctttgtagcaaagaaacaacataaccacaatttatgaccttaatgtgtacttgttcaataaacaaatcaccagtttggagacagaaggtcaatgtggaaaaaaatatgagtgtatccttccagcaaattactgcattattttctatgcacacacacagagatctggaatgataattctatttcccatcccccctttcacacatacaggcatgcacttggtgcacacagtcctgcaccagaaaaaactcgtgtgatcccacaggcaatcaagtgggatagagggcaaagctctgagttcagtccacactaattatggaccctccctctgtttcagggactatcctaggtactgctgtacactgttctccagctatggaaacgtctgctttcatcttaacattttctagaaatctttattgaaatggaacctaagccatctaaccttatcttttttttttttttgagacagagtctcactctgttgcccaggctggagtacagtggcgcagtctcagctgtgatccaccatgcacagttgtccttgttgttcatttattcaacaaatcatcactaacattcaataaacagttaatttttatcttttacaaagtgctggaaactccaggagacaataggaacaaaaaaataaacacacacagacacacacacacacacacacacacacagagtttaattctgaattaacttgagaatctgtgtattggacaatatagtaataagattttaaaactggtgaatatgtacatgaactcaaaaatattaaatatctgttattattgactaaactttatagttagccttaattaaagcttcgtaagtgtgatttaagacatgtccaaattgcttttcttattgtcttggcagagggagtctctgaaacagagggaggctccataatttcacaatatgtgagcatatgaaggcaatcctattagttaacattttatcattaatactctttttaaaacattcaggtcccttaatagaaattttgaaccctatagattggctcttttatctatttttcagtaaccaatgctcaaaacagagtttaaaatagtagagagttgtggagaaacaagcagtttgagaaagcctaaaaaattagatttgcctttatacatatataaaaaaattaaagatacatacactattgacgaaattagacctattgatgtttttggaaagcatttttatttgtggaggctgagtttctgtttgtgcgtctgttttttgtgtatatacgtgcacacacataattgtggatatcaaatgtacaaaagaggtaagtagatgataatggtctcactgagatgaattaaatataatgtgagatggaacttgacccagattttatcttcaagtccccttaatattatctagaggcctcctgtcataatcttttttttttttttttttcagacagagtctcactttgtcgcccaggctggaatgcagtggcctgatcttggctcactgcaacctccagctctcaggttcaagcgattctcttgcctcagcctcccgagtagctgggattacaggcaggcaccctatgctgagctaatttttgtatctttagtagagacagagttccaccatgttggccaggctggtctcaaactcctgaccagaagtgatccacctgccttggcctcccaaagtgttgggattacaggcatgagccaccatgcttggccttcctctcatgatttttaaagcatttacaatgccttagtttgtagacaaattatgagtacaatttggaaaagattaaaataagatgccaaagtcaggcaccaagaattttccagaatggatatatgaagagtggagcaggttactaatcatgtagaaataatgaaatgtttcccaattagaaatgtccaagaaagatgcacttcagatgttttagatggttgtaataattgaattttttaaactcttcaaaaaaataagttgatttaattctttcacataatttctaatgttattgttttaaatgtaaaattatggactatattttattaattctaaaagtgaagattgaggagtagtaagactataattaaccaagcctctgataactatcatgctactctctacaattacaagatcagctttttttagatcccacatataagtgagcacgtgcaatatgtgtatttctgtgcctggtttattttatgtaacataataacctccagtttcatccatgtggctgcaaaaaaaaaaaggattttattattttatggcaaaatagtattccattgtgtatataagccttattttctttatgcattaatcgattgatagccacttaggttgattccatagctttgctattgtgaagttatttgctgcaatagatatagaggtgtagttatacctttgatatactgatttcctttcttttggaaatgtatacctagtagtgagattactggatagtatagtagttttatttttaagttttttttttctgggaaatttccatgttgttgtacataatgaatctactcatttacatcccaactaagagtatataagagttccctattctctgcatcctcaacaaaatctataatttttttccattttaataatagccattctaactggggtatgatgttatctgattatcattttgatttgtatttccctgatgattagtgatatctagtattattcttatacctgttggccatttgcatatcgttttattagaaatgtatatttttctcctttttcactttttaattagatcatttgtttttttccgctgaattatttgagtttcttacatattatgactattagtcatttgttagataaataatttgcaaatattttatcctattaaacaggttgtctctttattctgttgattatttattctgctgagcagaagcattttagtttaatatagtcacatttgtctatttttgattttgtttcatgtgctgttgaggtcttagccataaaattttggcctaggccaatgtcctaaaatgtttcacctatgtttcattatagtagttttgcagttttgggtcctaagtgtaagtctttagtacattttgagttgatatttgtacatggtgagagaaagcagtctagtttcattcttctgcatatggatattaagtttcctagcaccatttattgaagacagtttcctttccctctatcagtgttcttggtacctttcttaaaaaattatatggctgtaaataagtggttttatttctgggttctctattctgttccattggtctacgtgcctgtttttataccaataccttgttattttggttactgttagccttgtaatatattctgaagtcaggtaatataatgcctccagctttgttcttttggctcaagattgctttatctgtttggcctcttatatggttccatatgaatatgaggatagatttttttttctgtttctgtaaaaaatggcaatggtattttgataggaattgcattcaatcaagattgattttagtaatatggtcatttcaacaatatggatttttttctttccaagagcgtgggatgtcatttaatttgtgtgtctactataatgtattttattagtgctttgtggtttttattttagaagtccttcacctctttggttaaatttattcctaggtatttttatagctattgtaaatgagactagctttttaatttcttttttagctagctcattattagtgtttagaaactactgtttatttgtatgttgagtttgtatcatgcaaattaatttttttaatctggcctaagtgtttcttagaagaatcttcaagtgtttctaaatataagattaccttatcagcaaagaaagacactttgacttcctcctttccaacttgtctgccttttatttcttcctattttctgatgtctatggctaggtcatttagtactatgttgaataggagttgtgaaagtgggcatcttgtctttttccagttcttagaagaaaggctttcagttttctccattcagtataatgttagctgtgggtttgtcatatatgacctataagatgtgtttttttctacacctgtaggaatgttaggaatgttaattttatcaaattcctcttatgtgactctctgtttttgtccttccttctgttattgtgatgtattatatttattgatttgcatatgttaaacaatcggtgcttgcatccttggcatgccttccactttatcatgatatattgtctttctaatgcactgttagattcaatttgttaatattttattgaagatttttgcatttatgttcattagggatattaacctgtagcttttgttgttattgtgtcattttctagttttgatatcagaataatgctggcctcatataatgtgttaggaagaattctctactcttcaatttttgagaataatttgaggaattttgatgttgttttatacatgtggtagaagtcagcagtgaaacctttaggtcctgggattttctctcttttgaggcttttttattgctgattcaatcttgttaattgttcttggcctgttctggttttctatttcttcttgaattaatcttggtaggttgtatgtgtccagaaatttatctattttctctagtttttctattttgttagcatatattgttcatgttgtctctgattttttttgtatttctgtggtatcggttgtaatgtatccttttatgtttctgaatttattaatttgggtgttttctgttgttgtttagctagtggtttactgactttatctttttaaaagacaaatttttcatttggttgactttgtgttattttgtctctattacatttcattcttctctggtctttattatttctatccttatattaagtttggggtgtttttagttcttgattttctagtttcttgaagtggattattagattatttaaaatctttctattttttgatataggtatttattgatataaactttcctctcagcactacttttgctgtatccaataggttttggtgtgttgttttttcattttcatttgtttcaaaaataggattaaaattattcttcttaattttctcattgacctactggtcattcaggaccaagttgattgatttccatgcatttgtataatttccagaattcctcttgttaccagctagtagttttattacactgtggtttatatatatgtatatatatatatacacacacacatatataatatatacacacatatatatatttgatcccttcataattttataatgaccttctttttctctttttactgtgtttgacttatagcctgtttttatctaagtataactacttctgatcaccttgggtttccatttgtatggaaaatctttatccattcctttactttcagtctatatgtgtctacaggtgaagtgaatttcttgtaggcagcatatcatagatcacttaaaaaactattcagacagtctaaatattttaagtaaaaagtctaatttatttatattcaggtttattattgatatttgaggacttattcatgtaaatgttttaagtattttatgtttgttttgcatatcttttgtttctttcattctttcttattgtgtatcattttggtttggtggtttttttgtagtggtaacattggagttctttctcttcctcatttgtatgtttaaaactctatcagtgagttttatactttcatgtatttcacaatgatagatataagccttttgtttccaggtgtaggacacccttaaacatttcttgtagggatgatctaatagttataaattccttcagtttttgcttgtctgggaaagactatttcttcttcattcatatagcaaaactttgctgtgtatagtaatcttgattgccaatttttttttaattttcttttagccctttgaatatatcatcctatactctcctggcctgtaagatttattctgagaaatccagtgccaatctgctgagagttctcttacatataacaagacaccctgctctttgtttttagaattttctatttgtatttgcatttgacattttgactataatgtgccatgaaaaacaccttttgaatgtatccatttgagaatctctaagtttactacttctggatatctaaatcttgctagacttaggaggttttcagttattattttgttatataggttttctatgccctttgtatctctttgcctttggaacatcccaaatttaaatattttattgctttatgatgttctatatgtgacatagattttgtgtattcttttaaaaactttttatctgactgggttatttcaaaaactgtctttaaattctaaaattctttattctacttaatctagtctattgttgaagctcttaaatttattttttgtttcatgtattaaattcttcatttctgggatttctatttgattcttttttatgatatctatcactttgttgaatttctcacgtaggacatgaataagttttcaatttatttgtattattttgtctgtgtctttttgttttcatggaacttctttaatatcattattttgaattcttttttctggcatttcatactttttttattgaaatctgttgctgaaaaatcactgggatcctttggatgaaacatatttccttgcttttttatttttcttgagttcttatattgttatttgtgcatatggtgtaacagtcacttcttccattttgggatttgctttcttagaggaagacttttttataaagatgtatttatgctgttggctgagcagggcactttaaatttgattatgggtgcattaagtagtatagtcttcatatgccttcttcagctgtaaagaacagcaatgatgtctgtgatttcctcagtagcttaggtttaattgtaaggctatagtgaggttttgctggggaagaggattctagatgggtcagtccctcagccccagtgattccaatgataggataagcatgactgtcactaggctcccaggcagtgtatgtagtcagtagcattagccagtccaagtgagccagttcttgaacctctaggccacttccttctttgtgcctgtgacagtggtgggctggttgggtaggtggatctttgggttttgggtagtgtgtatggcatgagtgatggcagtaatggtggtgggaaaacccttaggctcctaagcagcatgctgtggtgttaatggtggctgctgtaagctgggtagggccatcctcaggccctcagaaagagtgtacaggtgccagcagtggtggatggggcacggtgattcccaggcccttgggcagtatgttttggtactgcacaagtggtgccaagctgggtgggattgtcctcaggcctcttggtactgttcatgggtatcagctgtggcaggtagggttgggtagaccccaggcccaccatcagcagtggtgtggacagatagagcctgttatcagggaatgtgtgaatgtgttgtgaccttgcttctggaggattgggtcttctttctgtggcggaagccacaagtatcagctctgaggctgtggagagtacacgcttcatgctctggagatggcggcagtggctgcagcagtggcaccaacagggacgtctagtctctaaggcatgtgaaactgcactggagccctgccactgctggtggaggtaggcttgctttcagtggtagcagtcccaggcaggagggtttcaggctctggggagcatgtgctatggctcccttgtcctatgccaacgaagtttgctgcatggcccattccccaagatacaggacgctgtgtatactagagtgctggggaccctgccattccagtgggtgtaactgatgtcatgccactgtagtcctctgtgtgaatgtaagacaagtgtgcaaggggaggaatgtcagtgaactccagtgactgagatgcaggggctatttggcctcagaacaggatgcattctgatggaggctggtctttcaaaatggctctgggatgcaacttcttatctcttagcaggtgtgtgggaccaagtggagcatcactccctcccggagcaatgccatcacactctcttcaggtagctccccaagccagtctcacagcatgccggcatcaaggacctctccacgtctggaactgctccacacagtggggagcctttccaggctcccagctgatcacagccaaattagttgctttgcttccctttctttcagtgtctcaggtgcttcctgtcacttctttgctgaattccagtgttacttcttagatactctacttaaagtgatcatccacttgtcatgttggtttttctttgtggaggaggttagtgctagatgtcttagtcagccattttgaaactattcccgtgttgtaatgttattaaattccaacacagtttccttcacaaattctcaatactagcatataataattttttatttttttttggttgggaagatattttgttatatttctagttgcaattacaagtcccatgttttactgtgacattgtgaaaagtagtgatttaatgaacttgaagtacaatgagttcagctgtaaatcttgttctgaaaacacaatgtgttccacagttgcggaacacaaaacacatttgccacaaaattctacattcgtttacacacaatttcatccataagaaacactaggtgaacacagacaactgcatcccactgaatacacaaaatgtatgtatttgtaggtgcgcgcacataaataggcattttaaacatctacgctggctatctcattgcatgtgtaatgagccaccaacatccatatctggtgttccaactttccatcaaattttgaacaactttccttccattacttaacaattcacaagctgtaactcttccaaaacctactatcacataaaaacttcaggtttttgcaaggtaaggtaccatatttattgcaatattggtgaatttttaaatcatttaacacttggaaactctttttactaagttcttaaagtttgtcttatttatcatagtacaaagttttttagtgtcatgtccttgactctatttttcccataagtcctatgatttttactttgaaatgttttattgcgtgctggtttttaagaatttgtatatattttgcattatatcagaactaacaataatatcaaatacatattagtatgaattaattaatttattcatattacaagtatcctgtcagttgactacccacacttctaggaatttattagatatagcatacaatactttatgctcaccaaaccactttcttctttctggcacatgtaaaatttcccattctcctttgcagtcagtttggggctataattcaaatggagtgtggaagaaagtctatatattatttctgagactggaacttaaaaatatcctgtgtgatcctccagccacctctcctgcttccattggtcgatttgtcagtgtccgttctgagactctctctcttcaaaaagatggaacttaacatcaaacattgtttacacaggtgatgtaatagcaccaaagccaaatgggacaatgatgtaagagagagctggagtaaccaaggcagaaggagctcatgagtcagggaattgaaaactggatccaaccagggcatgctgcctggatgcgtctatatctgtggaggaaatgtggccatcctgaggatgccacccaaagcacaaagagatggggaaaaaatcctggcaactaatattttcccacacatcagtcttctgacagcacctcccatgagggaaagggtgggagacagtcagaaaggaagttgttcctaataacgcaccaaggcagaaaagggctggaaatgagaacaacaggaataataacctgtacagagtgactttggaaccaatgtgtcccagattgtgtagtcataaaataaagacaattgtggtccctggagggaaggtgtctagtagaggaaaggtgtctagtagagtcacctgaccagcactggactgtgctacaaatatatttaaaagcatttaacatgctaagtcactgaggtttctgattgtttggctacagctattgtaattcatagagatatttcattttccctacttgacatttgtatttgtatcgtagtataaatatctgcttctgagagggccttgatttctctttggttccacagaagtaggttaaagtgcaagattcagttatggagcacatgatcttaacgaatcccatcagttgtttcaggttaggacatgtcacgtaagccattcagtcagaatctttaatttatccctacaatattccttccttttgaacatgaataaaaaagtatgtgactctggaaaatttttacagccatattacaacctgagaagtgtcaggtctacaaaaaagctgtaataaggaatggaaagataaaagatacttgacgacacatttttgagctttataataaaataggatctacctctcgaaacttcaattgtgggaaatcaataaatattatttattctttaaggcaatattctttctttctgcctctctctttcattcactttttatttctcagagtaaaaatatatccaattccaaattacagggttttcaattttaaaaattaacattgtttttaaacatgtagttttattgaagaaaatctaaaaaatgtagaagactctaaaaattaaattaaaaaatctctttgtatctgaaaaaaagctatagtttacatattgctattctgtattttattatttctgtacatatattttaatatatattatacatataaatttagttatatggctaagttaaacttattttattaaaaatgatattttattagtgacattttctttttccctcaattctttctcttttaattggcatgttggtgtgtatgttaattcctaatattaaatattaaatacaattttaattcatatatatttggtagaaaaatgtataaattaaatgctatgatttttaaataagatcatatatttataggattttgaaaatgattaatagatatttgtgtgaaatgcagcttatattcctgcctaaattctcccatggttaaagtaaaaatagtagacatttgtctatgattttttgctaaaaatatgagagatttctcagctggatgggaaaatgtcatgaaaaacaaacaattagaaactatagaaaggaaaatcaaatgaactgggggcacggagaagttgatataaaaggaaaggatgacaaagatataaaacaactctgaggattagagcagctcaataatctttcctcactcattcattatgtgccagttcctagttctctagagagtctagttgacctacaggcattcaagtttcctggcgatgcaggcactgcctaagaaatctgcatagtggtttgagaaacagtgaaacaggggacacgtgtgaacaatatatatagagaggaattatctcagaggaagattaaagaatgtgcctaagtaaaattgtaatgagtgtgtattggaaagctcttacagatgatgtttcaagtgcaaagttgaggatcatcaaagatgaagccagatgaattcaaagtttccaaacatatcaaataattttaataactaccacccattctgcttgtaataaatgcccattatcagattactcttaaataaacccaaaatcagagactttaaatgatccctttaaaatcacaaaacaagtaaggttgaaaagtggaattttaaaacaatctaacatcttaaagtccattagccagagtcaaacactaccctcttttatttaatccccatcctagcaagaccacaatcacaaacacataatatgcaggagaaaaatttaaacagttatcaggattaaaccagcatgggtatctatgaagctgcagaagaggccatatggatgacaatagtaatcaactgtctaagaaacacagcatatattagaaaaatagaatatggcaaaaactattaaaatactacagtatggtttttaattacataaaatatgaaacagaattgctaagaaaccatgagaaattcctttaagcaacaatgtcagattaggctttgtttcctatttgcacagaggtctgttgatcacttgcagaacacaaatttcagaaaatttaaagtctagatagatagatagatagatagagttatatgttgaactttgaacattttatatattgaatatatatatatgttctgtaaaaatggagataatatgtgcatattgttcaaatctataaaaaaggaaagaactttcaaagcagtaaagtattggaagatatgatgaataatacatgtataaaagataattaactcccgtagtagtaaaagtcacttcaaagcaacagtgatgcatttcttcacctatataattacgatcctttcatttatcaatttagttagctgatactgcttaagatggctggatgaaactaacacttcatgtcctgcatatataaaggaatttgatagtatcaatcaatgccttgctttttgggcaaatattatcccatcatttattttaacagagagaaagtaagataaggagtctgtcaaagacattttagagaattgaaaagaccaacaacaaccaaaagacattgagtaactcacaaagagtgaaagagagaccagttacactctctgccctctgcttcctggagctgggaaacaacaacaaaaattgactggagttaatagaacataaaagcttagaagagagaggactcagcccactctgtgactcagcaatgggaaaaggatggggtaccattcagctgaaggtggtgtcttagaagcaaaaaagaaggacctcatggagggtgactttgacctctaaggaccagtgctaccttacaggggctgatgtctttaaggagtacaatgagctggttctgagagtgccaaaggacaaaaacaaaaacagaaagggaaacaggaggaaagtagtgcagtcaagatgataaatgatgctgatgagaataagaaacaagaagcagcgaagacttttccctcctccagtgttcctttccccctctagtgtgcctgttggcagaattgaagagggagcagctgtcaaagaagaaatatggtttacaaagtctaagtcttagcttcaggaatcaaagtataaataaaggcttaaataaagagagatttggagttgagaaataatagcttccaaatggtcatatgtatcaagtgtcctaagttcttttacacctcttctaggactcaatcttaaagaactactcagaaacttaaagaaaatttatgaccaaagatactttctgtggtattgagtataagagcaaagacttaaaaaacagcctaaatctttaaacaaggggaagtagcaaaataatttatcacatgtttatataatagactacatgatcattagaaatgatgaccacagagattttttttatgatatgacaaataattgaggtaaaggtgaatattctataacaggttagggtaaatatttatatgatgcagcacagtaagtgaaaaaaattgcagattaaataagagaagattatctctctctctcaggtaacagcccagctagactgggtttgtagggctactcaacatcaaggggtcattttggttcttacatttgtttaccttattactcagttatttattaaggtattttcctggttggcatttcagctattgacaaggtaaaagatgtcataatgttggaaaagcagccaatctttaggttgtttttgagacactgccacaatataagaaagtagtttttagttattaaaataaataataaataaagaggactgcatctgtaataaaactattcaactaaaaggactttatttttatttttacttttgttttaggctcaagggtaaatgttcaggttttttatatgggtaaattgcatgtcatgagggcttggtgtacagattatttcgtcatttaggcaatcagcatagtacctgataggtagtttttgatcctctgtctactcccaccttgcgctcttaagtcatgtgttcgtgtgtaccccatgttaagcttccacttataagtgagaaaatgcagtatttggttttctgttcattcattagtttgcttaggataatggcctccagttctatccgtgttgctgcaaagaacatgatcttgttctttttaaggtggcatagtgttccatggcgtatatgtaccatattttctttttttagtctgccattgatggacatttaggttgattccacgtcatcgctattataaatagtgctatgatgaacatatacatgaatgtgtctttatagtagaataatttatattcctttgggtatgtaccaaataatgggattgtttggttgaatggtaattccttattaagttctttgaaaaatcaccaaattgctttccgcaatggccaaactaattcacattcccagcagcagtgcgtgtaagcattcccttttctctgcaacctcaccagcatatttttagactttgtaatttttttattctgtctggtgtgagatggtgcctcattatggttttgatttgcatttctctaatgatgagtgattttgagtatttttttcatatgcttgttggccacatgtatgtcctctttcgaaaagtatctgttcacatcctttgccctctttgtaatagggtttgtgtgttttttgcttcttacttatttatggattctggctattatacatttattagatgcacagtttgcaaatatttatcaaattatataagttgtatgtttactctgtttattttgttttgctgtgcagatgttctttagtttaattagtcccacttgccaatttttgtttttgttgcaattgattttggcatattaatcatgaaatctttgccagatcctatgtcaaaaatggtattttccaagttttcttccagggtttttaaagttttaggttttacatttaagtatttaattcatcttgagttgatttttttatatggtgtaaggaagtaatccagtttcaatcttctgcatatggctaggcagttatcacaacaccatttattgtatagggaatcctttccacatggcttgtttttgtcaaatttgtcaaagatcagatggcggtacatgtgcagctctctattcttttccattggtctatgtatctgtttttgtaacattaccatacagttttggttactttatccttttagtatagtttgaagttggataatgggatacctctggctttgctctttttaattaggattgctttggttatttgggcttttttggctccatatgaattttaaaatagttttctctaatgctgtgaaaaatgacattggtagtttggtagaaataatattgaatctgtaaatggctttgagcagtatggccattttaacaatatcaattattcctatccatgagtatggaatgtttttccatttgtttgtgtcatctctgatttctttcagcagtattttatagttctctttgtagagatcttccgcctctacacttagctgtattattagatattttattctacttgtggctgctagaaatgggattgcattattcatttggctctcagcttcaacataattgatatatagaaatgctactgatttttatacattgaaactttaccgaagtcatatatcagttctaggagccttttggtggagtctttagggatttttaggtatagaatcatatcatctgcaaagagagataattggacttcctctagtctcatttggatgtcttttatttctttctctttcctgattgcactggttaggacttccagtactatgttgaataggagtggcaagagcaggcatgcttgtcttgtcctggttttcaaggggaatttttttagcttttgcctattccatatgatgttggctgtggatttttcatagatggcttctattattttgaagtatgttccttcaatgcctagtttgttgagaattttcaacatgaaggggtgttgaagtgtatcaaaagacttttctgcatctattgagatgatcatgtggttttttgcttttagttctgtttatgtgatgaatcacatttattgatttgtattgatatgttgaaccaaatttgcattccagaggtaaagcctacttgattgtggcagattagctttttgaagtgctgctgaagttggtttgttagtattttgttgaggatttttacatttatgttcatcaaggatattggtctcatgttttctttttccattgtgtctctgtctggttttgatatcagaattatgcaaacctcatgaaatgagttagggaagagtccctcctcctgaattttttggaatactttcagtaggaatggtaacaactctttatacatttggtagaaactcgctgtgaatccatctggtcctggacattttctgattggtaggctttttattactgaatcaatttcagaactcataattcatctggtcagggatttaatttcttcctggtcgagtcttgggaggttgtaggtttccaggaatttatcattttttttctaggttttacaggttgtgtgcatggaagtgttcatagtagtctaggaaggtatttggtatttctgtgagtttggtgatttttttgtcttctgccagctctgtgattggtttgatcttttttctctggtttctctaagtgtgacagtagattgttaatttgagatctttctagctctttgatgtaggcattaagagctataatcttccctcttaacactgctttacctgtgtcccagtgatttgggtatgttgtatcttctcatcagtttcaaataatttctgaattaccatcttaattgtattgtttacctaaatgtcctttaggtaggtgtaagttgattaatttccatgtaattgcatggttttaagtgatttttctagtatttatttatacttctattgcactgttgtccgagagtgtgtttgctgtgatttcagtgttttttttttttgatttgctgaggattgttttatgtttgattgtgtgatcaatatagagcatgtgctatctgcagatgagaagaatatatattctgtggttttggggtggagcattctactgatgtccattagtcacatttggtcaactattatctttagatctcaaatatctttgttaattttctgcctcgatgatctgtctattactgtcagtgatgtgttgaagtctccactattaagtctttgtaggtctctaagaactttctttatgaatcttggttctcctgtgttttatatatataacatatatatttaatttgatttacacacactaagagaagttaggtctgcttgtcaaattgaaccctttaccatggtgtaatgcccttcttgtcttttgatcattgttgctttacagtatgttttgtctgaaattagttatcaaatatctttgttagtttttaggtctcaaatatgagtaattaggtctcaaatatctttgctaacacctgccttctgtttctcatttgcttggtagatttttctgtctccttttttttttagtttacggttgtcattgcatgtgacattggtctcttgaagacaggatacactttggacttgcttcttcattcaacttgccactctgttccttttaattggggcatttaccctgtttatcttcaacgttaatattggcatgtgtggctttgatactgccgttgtgttgttagctgtttgttatacagacttgattgtttggttgctttatagtatcaatggactatgtacttaaatgtgtttttgtggcgaccagtaatagtcttttattaaatttctgtatttagtactcctttaaggatcttctttaaggcagttctggtggtaatgaattccgttagcatttgcttctttgaaatggatcttatttcttcctagcttatgaggcttagtttggctggatatgaaattcttgggtggaatttcttttctttaagaatactgaaaacacatccccaatcgcttctggcttgtatggtttctgctgaaagttacactgttagcctgatgcagtcccctttgtagatgaccttactcttcccaatagctgcatttaacattttttctttcattttggccttggagaatctgatgactctgtgtcttgggaatgttaccagtggcaaatattcaaattaccggcagcaaatccatacgtgtctaaagcaacctcaattcttgcctcctcagattttttattttgactgaagggcataagggagaaaaagagaccaagggaagttttagagcaggagtggaagtttattttaaaaggctttagaacaagaaagaaaggaaagtatgcttggaagagactcagtgagcagcttaaataacaagtgtggtgtttaacctggatcctaggactctataggctggcccctttcttgtgatttttcccttagggtgggctgcctgcatgcacagtgtgcttcttgcccttgggaagtgagcatgcacagtgtgtttaagaagttgtatgtatgttcatctgagatactcctcactttcccggtggattgctgacagaaggtcataccctgccattttttctcttaatgtgcacgcctgggctcatgagaccattacctgagattttattggaagccctttttgctactccctggcacctgaattcaattaacacgttaatattaacagctgtggatcatcaggaaatggcctctccctggtgctggctgccaatttatgactttttagagaggcaatgtgataattgccaaaccattgctgacattcctagatttggggaagagtcctctcctgccctgctcctgcctgtctaactacccataataggaacagtcatcttatatagtatctcacagggattctctgcatttgttcaatttgaatgattacctctttagcgaagttggggtaatttttatgaataatattctcaaaaaagttttaaagttgcttgctttctctgctctttcagggatgccaatgagtcgtagatttgatagggttatgtaatcccatatttctcataggttttgttttatctttattttttattctttattttttgtctgactgtgttatttcagagaccagtcttcaagcactgagattctttcctcatcctggtccatgttgcttttagtacttgtgattgtgttatgaaattattgaagtgagtttttcagctctatcagatcactgcttttgtttactttttttttttaatgattgttgcaggaagtcagggaccccgaatggagggacaggctgaagccatgtcagaagaacataaattgtgaagatttcatggacgtttattagttccccaaattaatacttttataatttctcacacctgtctttacttcaatctctgaacataaattgtgaagatttcatggacacttatcacttccccaatcaatactcttgtgatttcctatgcctgtctttaatctcttaatcctgtcatcttcgtaagctgaggatgaatgtcgcctcaggaccctgtgatgattgtgttaaatgcacaaattgtttaaacaatatgaaatctgggcaccttgaaaaaagaacaggataagagtgatgttcagggaacaagggagataaccttaaagtctggctgcctgtgggccaggcggaacagagccatatttctcttctttcaaaagcaaataggaaaaatattgctgaattctttttctcagcaaggaacatccctgagaaagagaatgcgttcctaaggggaggcctctgaaatggctccattggggacatctgtcttttacgtttgtcgttaagggatgaaataagccccggtctccagtagcgctcccaggcttattaggactaggaaattcctgcctgataaattttggtcataccggttgtctgctctcaaacccagtctcctgataaaaattatcaatgacaatgcatgcccaaaacttcattagcaattttaatttcgccccagtcctgcgatcttgccctgcctccatttgccttgtgatattttattaccttgtgaagcatgtgatctctgtgacccacaccctattcgtacactccctccccttttgaaaatcactaataaaaacttgctggttttacggctcaggggcgtcacggaacctgccgacatgtgatgtctcccccagacacccagttttaaaatttctctcttttgtactctttccctttatttctcagacaggctgacacttagggaaaatagaaaaggacccacatgaaatattgggggctgaatttcccgtgataaatgaccgtttcttcttttatctcttgtattgttttattgccatccttcaattttctggattggatttttgctttctcttgaatgtcaatggtctagatttgtgtaacgataaaccggtgtgttaaaaagctaagaatccttccaaatttaagtttttgctaccaacagattataaaatattatttggaagctttctagacttttcaaatcaacaataaagttttatttatatgcatatgtctatactgaattatcaaatatttaactatatttaatgcatattaatagttgacacatcttataccctttttatgccctgttgtatgtataaagtctgtgatgtcaattgactacttaccattagatttattgtatttaagagtcaatagactagtgatgcatatagttaatattaagacaagcaggtacaaataataacctccatccgaaggaaaaattgttagaaaaaattcctaaacattattttaaaaaagaaagaaagtgagacaaaatattttattgcagaagctaaacatttagataaattgtggagaaatgccaataggttttctctttttctttgttatttccctttttaaatttctttggtttcacaataaatttttgcaaattttttattgaatccttaagtgacaaaaagttttaatacaggtctttcattttgcaaagtcaacttctaatttactgaactctcatttgcatattctagtgaaaaacatttcttgttttttatccattaagtttggtccttattcctcaccaaattcactaacacataaatgtaggaggttatcattgttttttctattgctacctgggacaaaaaaataaaagaaggtagtaatctagaaaaattatcttgtttatctcaattttctattcagtttgtgaggattgtgttaaatttgatttgtttaggtgacttatttctttaaagatgtgattaaaaaaataaagatgtggtttatataatagttgtgaagtaagactgcttggaccctcgtctgaattcacactttcaggctaggtcaacttagcctgaaacttactaacctgtcaatgagtcagttttccctgtaaaaaggagacaataatagcagccctttcacagctttattatgagaattaaatgtgtttataattgtaaagagtatgttgcagggtgcattatcaatccattttaaacattccaattacaaaaatatgatatgcttttgaaattcaaagaatgaaaatataaaatacagaaagctggttgaagttacttgatttaattaaaagaatattctagtaaaacattttatagagatagttggatttaatgtctaaagaaacaaccactaaatatatctgatgatttataattctttccaaatttatgctttacgttagtttactttaaagattttattttttatttttgaaggtttaccttagtttaggcctaagttaagaaagcttaaaatcagataaagtctggatatagtctagaactataacatttccaaactatcattatcaagacttattaataaaatataactttatttgctaaaataaatagcttacaaacatgtaaattatctgttttaaatggttattgtgatttttaaatattttctaaacctataaactcttaatccttagtcaatagtttagtttctgatgatatttaacctgacaattcctagtaattcctggcagtctaataagtttctcaacaacaaaaacagaataaagcatggtgtaaagacagctctccctggattatctctcatttcctcaatgtctcaaatcagaaaaaaagtaattcactaatgtcacaaaccattgttttatcttaaatgaaataaatattttcttgtccttgattgaatgcaggtgagcatcacctaaagacatttctgatttaattataaatgaatatgtgtcttaagaaaaggtcatttctgaaaataactggattgagaggtctttattattgtctataataataggatttaagtttcaaaatctgacacttaaaatatttctgaccaagagatggaaaacaaacactatcatcaaatattattattgacaatatttctatcacaataaaattgtatttttattttttaaagcagttattgacagaatatttcttacagcttctcctctccctgacagataatacttatactgttgttattatattgttctttttcactgacatcactattcctatggagctgattttttcataaatttttttaaaaagctgttaggatattaataccatagaccagtggagaaaattttactaagttgtttggtccttccttaacatttgtgaggattagaatatttacaggaattacatagataaaaagttgtgtgaacaaatcagtttatttcagagaaaatgagttataatttattcttaaactttttagtcacaaagtcatcatcaggataagatttatgaagtaatccaattccactcataaaactgttattgttaatttactaagtccttttctaagtgctttaagtcagttctcacagaagttctgtaaatgttagcagattataatttgtattttattgatgagtaaactggaacataaaaaagtgagaatacttgctggacctcactcagctaatcagtagtgcctgtgcagcaaactctgcctttggcctcttataactaggggatgctgatattctcacaaagaaatcagcctaaatattgtttgttctgtatcaggatgcagctgtggaattggattctacagtggctttgtgaacacagctccaatcactgagattttaccagtatttaatgcttcgtaatattttcaaaaacaacatattgtttagcttttggggatggagggtagctcagtttataccatgaaataataatgtatcatctgtatttgcattgactgtgaatacctaggaattgttcctacatgccagtatttcttgttgcatcactggtggtgactatcttgtgatacaaaggaatcaggtgcattgtgcataaagggcatctcgagtaatgcttttggcctgccttatgaattgggctagatgaatagccatttctaggtctttgcatttaattttcaaaattaggtttctccattgtacacatgacttttctgcctttactctctttcctagattgtatttgttttctttttcatgatccagtttatccatcatatccagccaaggtaaatctagatattgagttacttagaattaaattgattcggttttaaaaatcctatttgacaaattcccatgtcaaaatgatgtaacctaatactaagaatacaagattcagcaattctcatcaggtgaattttatccatatttggaactctaaacagaaccacagaggagtcagatatgaaaaacacaattaacttaatatcaaatgtagataattagaattctagtaaagtattagcaaatgaaaaagcatcttttaactaattaagcaagttgactatcaatggtatatttatgtgaaatatatggaaaacaatacttttatgcattacaatgtattgtgttattttttcttaattaccttctactttaactggaagagcaaattctatttaaataatcttagattggatgaaacaaaagcacagaaggtggtgacctgagagcacataaattctcatcagttttctccttaattgactgctcagtccctgtccctgaactttaccctcttctcagtttgataaattacttgaataacgtaatttcttaaacaaatttttatttcttacctataaacctctaataaatttcaggtggtgtctaagtgcttactacttatctctacatacatatatacaaatactgaaactcatgacatgcactaaactgaactaataactagatactcatcatttcctatttttaaaattttctttttcatcacttatacatttggtttagccacaaaataaactagacattcttctagacttttccttttatttcacttccttatatttagtctagcatcatcaaaaatggtgtaatttctgcaatgcattttgagtctgtcaactcttctttattcccattaataatacattaatggtcatttgtcattttgctccagaagtgctgcagtgttccccagttgatcttgtcgttcagcttggtctcctgaattcatcttacctggtgagcagaggtcctgggatagacttcaaaggatataataatctctggaagcttttaaaaagtattgccatttccacccgcagccatagccttcatattcacacaaagctagaatgagctttttaatataaatcgatcatgttatacagctacttaaacaattcttcaatattctccaatccttagagataaacgttacatttgtcctgcatggcacaggagccccttcatttcctaatctttgcctcagtgcagtaacacaaaattttggcttccattatttgccgtcatttataaccagtatttgtgttatttaaaatctatgcagatacgctgtttttgaatgtacttttctcttttcactaacagaattttctgttgcttagaattttcatatgaaaaccacaatttattttactcttcatttaccttatgccattgaatcgtttccatgtttatctgaaaaaaaactgtttagcaacttttactgaaagacattatcttcatagagttaccaatataagccttattttttcctttcctgctagttctatgcacaaaattttctctatgagtattgtttcccagatctgtagggcaatctacacctctttttcctagttcattcccactcattctaaagacctcatgtcaaatgggacttccagatgtgttcaggttcacttttcagttctgggaccctgaactggtagtatcagcatcgctttggaacttgttagaaatgcaaactcatgagtcttcactcacatccccactagatgttaagatctataacataaaatttgattctgtttttgttgttttctttgtttctgttgtgttaaccattgtatttgatataattgtaaaaagccttgcatatagtatgtacgatgcacagaggaaatagttactgagtaatgaatacatgagtaaagtcattgctgggtatttccttgcccttcttgttatcctggaacctctttgctcttgtctaatggataaacagatataaagatagatctattaatgagatactaaattttccagtaacaaatgttgcctctcttctttctcaggcaaagtgaacattagtatcaatgagaggttgggtgcagtggctcacgcctgtaatcccagcactttgggaggccgagacgggaggatcacctgaggtcaggagtttgagaccaatctgaccaacatggagaaaccccgtctctgctaagaatacaaattagccagatgtggtggcatgtgcctgtaatcccagctactcaggcggctgaggcaggagaatcacttgaacctgggaagcggaggttgtagtgagccgagatcaccccactgcactccagcctgggcaagaagaatgaaactccatctcaaaaaatatatatattatataatatttaatagaataatatataatataatattttatatataatatatatcatatagttaaacatatattatatataattatattacatcatatattatattatattgtattattatgatatatatgatatatgatattatatataatgtatgatatattatataatatatattatatatataagtgagattgtacaaatcaagttggaagtaatcattatgctctgaatatttagttactttatggtatgaatgtccacatagacacagagtgtgtgttgaagttgaagtatcatggaaagctgactaagtgggaaaagaaccatatttcagatttagatttatgtataatattttattccttattttaatataatctcaagaattataatatagtacagaacaatggcctgctttgaaaccagttatatggataaagtacttgtttctgtggatgaagtgttaacacaaggatatacatgcttgcactagtatgaatgtttcatggctgagatgtcatccagtcagggaacatcatgacaatgcaccttgaagtcaccttcatttcttatttttcacaattaattaagaaacatcattcattacaagactattttcaattactaaaataaaaactcattcacacatcttttaaaccacactgagctcttttgactctcacttattttattcaaaatgaagcgaaactgatacattttttattattttatatgatactgacttgataagtctctgcagccatgcttgatagacagttatctcttcttaattaaatgcatagcatttacattttaaattcctataacaggtcttttgatcatagtgccctaaaacagagaaacttttaatataagcggatgtttattatcatcttatttgttttttaatgctaataagagtcatagaaactaatagactattaatgaggactttatgccactttagaagtttgagtgaaaataatataaaaatatatgttcaaatgaatactttcacaagagcattcaaataccaaacactcacagactcacagagaatagcttaatattgtctcattcaaaatgaatagttaaaataaaatgtaattgcatagaatgctgtttaatttgtaactgcccaagcaattatttcagatttgtcccatctcaaatatgtgaatttttattttacagtgaaaaaggctttgtcattatcccacgtaaatatgtatactgactatgattttgagagaaaattaaggagttttttatagtttttttattagttctattattattggttaaactaaatatctgaaaatatgtctaaacttattttttatcgggcaggccacatggctagagagtaagaaatacaactaaaatatccctctagcatagaaaataaatggtaaatggcatttgtttgatgccatttggtatatcagatgatacctggtgatacttcattggtatatcagaaggttagaaaatcatcagactgcatcttaatatattggtaaaatatttcatcattatgaagatatgaaaatatataaaactttgtaaagcagaatatttgagtagaaagatacctaaacattttgatagaataaacatttgtgtaattttatctgtttaaattggcaaataatatatatataatcagttataatatttatgtagcctgtttaactactttgaatgttactcctgtggttttgtagctcatgattagcaaatcagtttatgtgtgtgtatgtgtgtgtgtgtgtgtgtgtgtatatatatatatatataacatatatattcattgtgattataagtctcatgaaattaattatattttaaattgcttaaatatgtttttatagttttaaggagaaaacaatatataatctattttaataattaactgattaagtattatatttatttactaccacataaaagttaatattgactatgaagtatgccaccacgaatttgttcaactgcaattttacataataaagtatattttgatcagttttttacagataaaatatcatgtaatattgagtcaacataaagatatacatcatagtatttatttttgtcatttataaatttagttttggtgaataaaataattttcttagctgaaattttaattgctaatttataaataacatatttaataacaaacacatatgttaatatgtttggcaagcataataaattaagaaattgtaattgaattaaaaactttattgagattatttcaacacttaaaaaacaccaaatacgtttaagtgccaaattctcaccataatttaaagctgaatgatttatttgatgctgaattaatttttcctttgatacatttgtcctctttatatatcttttctccattatccaacagaaacttagacaaggccacaggtaacttttttattaattataatataatagcttgtataagttattaatctcaattctatttcccagtttgtgcactcacttcttgaatctcttccctgacccttactattacttctgtgacactgaaatatcctagttctctttggatgaagaacactttgccaaaaatcagttgtcttttgggaggttagctgagtgaaattgatatttgaaggatagacatagtgctgtttctgtctacttataaaacaactatcttaaaatttttacctataccacaagttcaacctgtccagattcaatggccataatttcctcgggaaatccttttttagtcacgtgttcttcattggctcgtggtgtaatattttatctattcccccaggatggacatcaggagatgttttatcattttcatcattttatcttttacaatggattatcaaaatttacattatttgccaggtgtggtggcgtatgcctgtaatcccaaaactatggaaggccaaagcaggaggattgcttgagcccagggcttcaagaccagcctgggatacctgatgagaccccgtctctagagaaaataataataataataataataataataataataataataataataaaaatcatacaggcgtggggacatgactgtggtttcagccagtcaggaggctgaggaaggaggatcacttgaaccccagaggctgaggctgtagggagctatgtttataccactgcactccagcctgggtgacagagcaagaccctgtgtcaaaaaaaatacattttattttctgtaaaatactgatgaataatacttgtgtcttgttctagtcctgctaaatgtcattgttacattctacttaacttttctcactagcctaagatctacttgaatacagtctttttctcttcctgcatagcaatacaatgaaaaatattaaatcagtgctttctgtgtcacatattctgtgttacaatatctcattgctcagtattaaaaatctaaagttctgtgttattaagaacttaaatttaaatgttcttaaactttcaccacaatattaactattcttcccattgtaacaacacacttctctcgtaggtcaacttcctcacacttctcttacccaattacccatttccatgagaaatgattttcatttccagaagaatgcccttttttatgttaataccctgatccattctctctatccatctataacttacatacatatttaataaccttcaacatttttaagatcaaagaaatttactctttttaatgaaaacttataatctcttaattgatagcaaggaatctattctcagatctattcatataagctaatactgtctaaccaacacgaatgaaatttactgataagaagcagcatttctttaactaccagttgtctttcagttttccacatacaaaaattaacactgagcatggagtatctatgtagatatagattgataattttaatattaaaacattttagacaataaagtacaaatgcatctggttattttacaacttattcccaattattcttttacttatacagaaaataattttcctccagaaaataaacaggcatctaacattaggtcaaatgagtctaataaatctttcatttagttttgacatcgtttatttaattttataatgtagtatttcacacttcataatgttaaatatatagtaatcaccataatgaaataatgtaatataatttttttctaaacattttcaacagatattcctctgcggtttttaaaaattatttttataattatgttgacaattgtactggaaaaatctaccaattattacttatcataattgctgtctatgtgtggaagtcatcttgcttatgttagatttcctcaagccatgtattatttcaaatatattcatgaagtccgcaactctacgtcagtccttattctacaagtggatatacagagatgtaaataaaactgacatggtccttgacctgcaggaaaattaaagagattctttatgccttagttttaagagctctaaaatggagatcatgataccaaccccgtaagtgtattttgaataacaactgatttaatgcagtgaggggcatagaattttatctcatgcatagaatacattgaataaatgttagcttattccaatgcaacctgaactggcaccaggatttttgatggccaaattataggggagactcatttgaatttatatttaactaaatattttaacgtctttgcatatatatttgggttgttaatataatttatgtagttgatttatttataccaggttttggtatttcacaatattttttgtccttacagtcaggcttttgtttgtttgttttttactgagattgaattttgatttagcgaacccataatttatctcaattttgcttaatatacatatttcatcagctttctatgtcagtatatgaatcatatgaatcacaaatgcaataatcacaaattacaggggtgatgagtttatagagtgcttctaaattttgctagaaatttatcttgagtttcacattaatttttcccataggaccatttgatcatggagcattaattaaggatatgttgagtgtccatgaatattattttctctggaacaaatttctctgattgttgaaagggctactatgagtgaatgtcaaatagaaatttaaactaattgtcactacatttttgaagatttcatgttatattataattagattaacatgattaataatttagtgttgctgaatccaatttagttcacagggattaatgcagtttatagacatttttgcacagtactattttaataatgtactctactgttatataaacccgtcatcttcttataaaatattttttctatttaaacttttttcctcttaacaatttcctaaactacatgtgtaacttatggtactggaatatctaaattaaaaaaaaaagtcttttaagtgtatcttatgcaaggataaatataatcttttccccaaagaaataattccatcatataacaccggatatcatttttaaaaatattgcgtgtgaatattaataaatttatttaaatgaaaaatatgtacactagtcaaataagttgagaattagagttaagtagtgtgtgcaggattttcagtgcctaaaatagtaatacaaagtgaaatcatccagcaggagatgtggtagtttccattttccttactgaacccaggaatcatggcaaaacggtctcattttcattccttcagagattatctctcaggatttggtttctccaactttcacttggaaaattctgacttagaagagtattaacttaaaattgccttcaggtcttctctagcaagctaaaaatatagatgtatgtatacagacactcaaactcaaatcactctcaatgaatttccatatatttaagaagatttgatcattattacaaaacttgaaaacagaaggaataaacaggttcatataaatgtacaaatagcagttagtattagtataggttttatatattggaaattattgcaaaaatacatgataaaactttaaaaatagaattttgcagggggatagaacattttttttctcattaaagcattttcctgtgataaaattctgtcgttatttggaaggttccacaaatgtccattagcaatgtgaagggaaacatttttgaaagcattaattttattatctttaatgcatagttgcattattgtaatatgtaaatatttggggaaaaaagaacgttgttaaatgagtacttttgtgtaatttccagtttctcagagtttaatgtgacgttttctcatctcttacaacaaaacaggaactttaagcgggcatatttattctcctaaacttttctaaccaatttattcagtcacctttgttcactttgtattgtttcttaaattataacagcttagcttaaattataagctaggcctacctacttattattcgcacgtacgtagtattttatttgttatggaaatgaaagaattggtacagagtgctataattttaaattcagtcatacattgttttagtctgcacatttttgccttaatttcacacactatacaagtcatgagtaaaagaaaagctcataattactgcacagatacagaaaaataggccagatgtagtgctgcacatatgtggtttgtggctcatcagattgttattaattgcatagtaaagacagactagatagttagaaaaaagacattttaattattttatcaaacaggacaagacatcccaagctactggaactaaaatgcagagataatataaactgtacaattacgtacttttcaggtgataaactacatatctatggtattgaagcataaagtcacagcaagaatttttgtatggttatatttaccttctttatgcacagtgagaaaaacactctgagagtagatgacccaatttttcttgtttcttatgccctcaaaatatttcgtgcatttcatcagcacccctattcgtatgaagaacatgttggcctaaaataaatgccggaatatcaagagaaattctaaagatgcaacatcagcatctcaaaaatgggacgcaagtaaaatgaccgatttttaaaagaatatatatctttgttagggatttaaaacctttgtacatatacgctgtttaaaaaaaaaaaagtcatctttaaaaaatgtaaaaaaaaaatcagtgaaaaaggtaagccacatggtggctgtgttttagcagaacccacgcattgccattagttcaccctatgggcacggtcatgttaacacagttgaatttcagtctgagctgagacatgctcgttatgaattattttgttctcctgaggtgaagtaaatgaaaaaggctgacttattgtatcttcccctctgagttatggcttctgacaaacctgcagtctaaccccagcacttctaaatgggtgaccaaacattatgtgattccccaaatttaaggatagacagcggagggtaaattcattgctcactgttctatctgagcttgagtgtatatgggtcaggctcttagaaaggtttcatttttccctgtagagtttttctcatctccaaaatatggcattaactttgataagatccttgtcctcaaaaccttgttccactttttaaaagagaaagaacaggtcattctggatattacactgtattttttattttattttataatatgagagtttcacaaaataactagtagtattagaatttgcttcgaaatcttactttactaattatctttgtttgcatataccctctccctagttttgttaaaaggcaatatgtgaaaaagagaagaaagttaaatattattttattttaaaagaaaaatattatgttctatcaagtatcatttatatatttaacatattgtatttctttttgatttacaagcacaccaagattatcaccagtacattactatcactagtattagatgggtaaatactatcactggtatttattttttacaaaagtgccttaagaaataaaatttgtccaaaaactccagtcttattataaacttaaaataattggctctaatatgttttgggatgtttatttggaaactcaaaaagtaaaagaaaattaaagggatcagaaaataagtgctaatataattagctatgtaaatgtaacttttttttttcaaagcctaatggatagtggtgtaatcgatatgcttgtcacaagatctactgttttatctttgtcttttgtttttttctttctttgattggttggttggtttttgtcttcccactgaaaatgagttttttattctcaattttctctttttttttcaccgttattgtattagtattagttttctattgttgcttaacaaattaccacacactttcaggcttgaaacaatcccatctcttgcctcacagtgctgaaggtcagaagtccaggtggctacattgaggcctctgcttagcctctcacacagctgaaatcaaagtgctagctatgtattatacaacacacacacatacacttacactgatgcaagtgcctcagtgattttaaaaataaataaaccaaaacacagaaacttctacagactctgccttcttggtttaactaaacttgataattttccctacgattctttaagcatttaacttcatatttgaggaagtcagaaaagaaaattgaagacaaatgagcttatagtacagcccgaaatgtatatgcaatttattacacatttaagcacaaccaagtaaaagaaactgtaaataatatacattggctttgagaattttagcttcttatgacagaattgatggcatctttcagcaggcgtgactgagtatgcgttaatctctccttagggaaatatacaattactgattgtggtaattctttggcaggttcacgtatgttgcctattcagcatctttattattcactctcagtgtttcactgtaaaaaatgagaaatgttcataatgaggcaaaaagttgttttagttacattttaaaactacttatagaaactgaaagagttgaacgttcacgtatgttgcctattcaacatatttattattcattctcagtgtttcactgcaaaaaatgaaaaaatgttcataatgaggcaaaaattattttagttgcattttaaaacgacttatagaaactgaaacagttgaacatacacgtattcttgtgaagagaatggcttaaatgcttagaaatttgaaaactggggtttatttttatccatgttgacaggataaagggtaaaattgaaacattttagcttgtgattttgttataagattctcaaattcttttaacatcacttcaacagcatcaacagcttgataatttataaatttgctaaagaactagtatcatatttgtcgtagtgcatttgtgctgctataacaaaatacctgagactgggtaatttatttaagaaaattattttatcaccattttggaggctaggaggtccaagatcaaggtggcagcaggtgaagtatatggtgagtgctcaagtactctgcttccaagatggggccttgttactgcatcctcacatggcagaaggcagaagggccaatgaggtaaaagctatgtgaagacacttttatgagggcactaatcccgctcataagggtgcagcactcatcatctaatcatctcctaatggccccgcctcttaatactattgtattagagattaaatttcaatgtaaatcttggagggacacaaactttcaaaccataataatttggcactctcatatttaatactttcaacagtgtttaaaaatttagaattggtactgcagatacagacacatctcatactgatcaaactcccaagtgttttagattttcttatttactatttgtttaatatgagatccacatatagtaatttaactattttgatagtcatttgctttgataatcatttgacattaatccaaagccatgccataaatgttcagaatcattttaattgaacgtaatttaacaaagcattgagaaaggcacttgtgttttcattttttccacaattacttctcttgatggtggtggcagttattatttaattatagaatgtagaaggacaattgatttgacttataaatataaacgactttctaaaatacagaggttaatatattttataaatattttagaagtttaaaagtatcattgttcaattcccacctatgagtgagaacattcagtgtttgggtttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctcttgtgaataaatgagaacacatggacacaggaaggagaacatcacacaccagggcctgttgtggggtgggcgaagtggggagggatagcattaggagatatacctaatgttaaatgatgagttaatgggtgcagcacaccaacatggcgcatgtatatatatgtaacaaacctgcaagttgtgcacatgtaccctaaaatttataatttaaaaaaaaaaagaaaaaaagaagtttaaaagtatcaaataagtgtgctagataaaatcagtttactcgtgcttggtactttttattataggcagttataaaattaaaagtattaacaacaattaccatgggtgcctcagatgtctcaaacagtttcacacacactttgaatactttatgtaaataagtactctgaagtattggaaatagaatactgttattctccttttagagtttgggaaactagatctttttggaaaacttgtctagaggcacacagattgcaatccaatgcagttttttaacctgctttgctcaagagtccatgttgcagtaagtcatcattttaacaaaccatgagttttaattaaaaataatttttatgtgttgacatgagatagacatgctataattctttgaaggaaagatcattgtctttttagctcttatgttacatataaaaaggataatatctatataaaaatgcaaatatagctgctaaattttaaaaatgtacaagaaaattgcataaagcaataataaagagataactttgatatatgagattaatcatatattaatttagaaatctttgtaatatcagcatcaattttgaatataagaattgttttagtgatcagagagattaaattctagatacaaagcatcgtcaatttcctccagtgtaatttatcctggggtggccctcttatgccaggactaagagttgtccattgaaggaggccctcatgttcaaaatcttagccgctggcacacagttcctaaaggcaaactgcagactttctgttaagaatgaagagaaccaaagtcctgcaggggaaattactattcctcacctagtccaagaaacatgtgcttcctagagtgaggagaataagttatggattttcaggttgttttagagcctagttcttgtaaagagaagatgttttatagaaattaatgatattttgcttttcaattggaaaatacatttaaatctaattcagcaaaactaaaagtgtgtatttttagatcaagtgttttcaattttacaattaaaaaaatgaaactttaaattacttcagagaccatggattattagtaacagcaactgtataaacctatttattaaaaacaaattgataaatatttctataaatttcaaactgtatttcaaataatatctaaaacccttcttttctaaggatatatgaattccttatactgctttatattgagacatttgaagtcgttggttctaccgaatttggattgtgtgatttattttttgaagttttattggagagttaatgttactgaaaaacttttatatttttatcttcacataatacagattaattgattttaaaactttgaatgttaaatgattatttttaatcacaagtttttattcttctttgttctatcacattccctcccaagtgaaaatcttatatgtatacacaaaagctttgaacaaatttggtagcaaactgtaattgatgacacaagagagtacaagtttaattaactagattctgattagattttataaatgttacaagaaatgattagcactgtcctaaccttgatttttaatatgttacatatcctgtaagacctaagactaatattattttcaccaaacctcacaatatagttaattgcctgcttcttcattcccataccatgttgtttatatttcaattttatcccaacttgctagtaggtagttgtataaataaatggttttctcccaccgacacacacacaaacacacacagaaagagaaagacagagagagagagggagagagtaaattggcatttcaatctagacatataatgttctgcttggaatttaacctagcactgggcaccctttagtacttcacaaacatacatttcaattgttactctatgtataaacatcaaaattgagatcagaaacctgtataaatatttgtcaacagaaacctagtggtttttacaatatgtcatcagtttctatttttctttgtttgcttgtttgcaccaaaagtgcaacttttggtcactcccacctgacattttatatatttatagacctttaacaagttctaattctagttcagctggaataattttcttaaactcatctacatttctaagctgtccaaacgaaataagaaaatgtatttctaaactgacactttttctagagtcagactcaataacacttgattaaatgccagcataatccacctatggtagttttaattttaatatgccatctctatctactacaaaaattacaaaattacattttaagaaaaaaatgatttaaaaaagttaaatgttgattctgaatgttttaaatttgattaaagaaaaaacacgaattattattatcactagactttagaagatatggtaaaatcaaattgaatatgatatcctggcagtcattccagttaaaatactgaaaagagttgccttatgattattttttaatgtgttcagaaataagttactcagaagtaaatttcctgcctacttgcatggaaggtaactctaagggaaattgcattcaagttggttatgcctgagtatatttcacagccagaatttcaattactaaggaccttacattagtgtggcaagagaagtctgtcagtaaaaaaaaaaaaaaaaaaaaaaagaagtgagtagactaaaagtatctcttctctcgtgcttcctctgtgtatgggcagaatcaatttgctttcatcttaatcccaaatagaagaagcaattgactttggggaaatcctgtaaaatttattgctgacagcctgttagagagtgctttctaaggatgacagaacacatgaattgattttgcttccagagacaccgggataactgattctctcaatcacagagtgtagctctggggtttgttgtcacttttccctgcagtttgaaaggcttatatcaaatattcaggaggaaaacttaagaggagacatccaatgtagcacttaattagtgtgacatatccaaatgccattgcctgtatgtagatgatacgcagagttagtttactaaatatgagagaaagaaaacattgacaaatatgacaacaggatttaaatatttccaaatatattaataaacaaaacaatacatttattccacaaatattaaataaaatcaatcttaagatagtttagatagaaactctcttccttattttaaatatatatatattactgatacattagtgaatatatatatattcactaatgcaacaactctaacaactctaatgtctataatgcacaaatgcatataattattaaatgcaaaggttgatattaaaagatgatttcaaatgcaattcttcttgagtagataatatttatatcttatcatcatggaatgtgtgtatatagatacatgtacatatacatagacacatatgcaggatgtggtatgcatatacatatacatgtatcaatatatattgaaatctagacacatatgctacagaggaagggaaatactgggtaaaagagggcagttccctggcaaaggccccactctcaagcctagaaaactgcagcgctaagtgcgaactggcattccagcttttgtgcctaaatgttgcttttgggcctgccacacccccctatcctgtacccatataaactccaaaccccaggctccatgagcagacgcatggttgaacagatgagcacagaagcagaagagcagcatggcagaggagtgtctgaatgtcgagagtaattcagcaggggatggttggaggggagaatggctgtgagatggtcaaactccaggggaagatgatcttcctagtccatctcctttccagctcccattcattctgctgagagctacctccctccgggaataaaatcccccgcctttaccatccttcagtttgtctgtgtgatctgattcttcctggacaccagacaagaacctgggtaccaagagggcactgagctggttatcacttaagccatcagtgagcagcaaagctaaaagagcacagtagcatgcccactggagcttcaggagtcgtaggcaccaccccttgacactaccatggggccggagcccaatagcactttccccagctcttaaacccgcctgtctgcgtgctccctctcctgtaaggggtttgaatgcacagcggctaaacagatgagccacacgtctgtgacacatcctgcaaagggagtcaaggacctcttccagttcacatatgcatttatacatgtatgcatgcatataatcagatttcatatattggcatataacatattgtagtttcaaatatactggtgtagacaggattttcactttttagttatgtaatacaaaacaaggaaaagagtattatagaagtgctatcacctcttcttgctcttatcatcataactccatcaaacatgcaataattaaacccaagaccaaaatgcacccattctatttttaaaattctctgttacagggctgtacgtgagtcccatccttctccctcaaagtttctgcagaggctgctaaagaaaggctggggactaaacaaaataataatgccttgttgtacttccctgtgatgagaagtatgagatttatacacattatgggcaaaataaatgactcagctctagttagggaaacattaacaagtcacactccagcctcttctacaagagattatgcttgaaaatgtgataaagagggccttattggtgagaagtggcagcatagtgcccatcactcactcacttcctctagtcccttctcaggcaaaggcatggaattctcccgtttaccttgagccaagtgcaggccatcacaagaatgtaccttgctcactggagcttaaggatcctaggagttgataggagaggctacacagcacaggctatggtggaagagacagaaagcccaggcttgacttgcaacaagatgtatgtgttctaccaccagcaaaatgagatggcctggggggatctttctctaggggactgcctggaagtttaaaagaaccttcagtgagagaagtgccagatttctttgatgtaaaagatgatcaagaagttctaagtaaggtgccaccaatgggctggacattgtctaggtgaaggtgaatgcagtcacaggtcactagtggggaatgtcagaatccacaaaaatggtacctgagaaagattcagcaaggatacatcaaccacagagagggtaccaacccgtgattacagtgaactcggccatgtttgactgtgcagcttttagcaaatcctccccttcttctaggtcttattctgaatggttctgaaatagccgctaactagggattagagagagaaaaaaaagactcaagctcagggtctgctattctagactcgattgttgctatgcaatgactaccctggttcagaacttttaatccctaagcaaggaagaagtattattaagttggtgtaaatgtaatggcggtttttgccatttaaaagtaaaggcaaaaaccgccattactttcgcaacaacctaatatattggtatctaaaaaactaagagatgtctgaggttttattcagaagctgaaaaaaaaaatgtgttttcccacaaagcatatgcaaataaatcaaggggttaatagtaggtcagtttctggttagaagccaagtcgaggtaattcagtaaaccagctaaacctgcaaagatttttttaccctccaatatgaagccatttcaatatctaagagctgtccttgtaaatgaatgcatcatttttctaaatttaaagaaaacgtttatttataatcttaattataggcatagtttgccccctgtttgccgtttctgatgcctctcttagcatcatgcctagttctgtttcttgtggtctcagggttctgcaatctgtactccacaattcctccagactggtgttttgagaattcagagttcagttgtttcattttttctttataaacgccaatcgtcacctcctcaccacccaaccccaacactttcagaatataggccaactgttttgcagcattgatttttgtgattagtcttcttacctacttttcaggatgatgtatccacattcttaaattcttttttttaaaaaaaactctttttgctctaatattcctcataaatatcatgtctgcacatatcaatagaatatagcagttctactagctgactccttccccattattttttggcctggcaaatgtctgtttttcctttgaaatcgagaaggtaacctctgatttctcctagtgacttccttagctttttaaaaccatcatgctgagctaaatcctcctattttgctatgttatcctcttgctaatttctctcatagcactaggtctgtcatagcaatagtaaaaaataataataaattagacacacctaataacataaaaattcccagaaaaatatgacttctaaagaatatcacattttaatcatttagtttaaacatgtgaatataataattatattaaaaagaaaaaaatttaagtaataacattaatgataaagtgtaaatattaaaaaggctgttctacttaactgtataaaaattacataaaatgttagtagtaacatgaatagcattaatagctatgaatcgttaatcatttacttaagcctggatatgttttgtatccttgcaaagaaacttacaagtgttaatatgtatatatggtatatttttcttttattttctaaatgaggaaactgctattctgagaggttaagtaaattcacagagctaataaaaagtaagactgagagtgaaccctatttctgattcttaagtttttgcagttaaattctagttttcaaaaaatgattatttagactgataattattgtttttactatacctgcttatcatagacatttatcccttcaaatgaaaacagaaatgcaggttaatacttttagcttagtttctgagtgttctcaagggccttttcatggtgaattagggaagcaaggaaaattttatcttatagtttcaatgagattaccaaataatttccagtttgggatgtcttttagatgaaatactgtctctgattaaacttttatctgtctcccttaacgtcttctttgacagaatttgagttgttatgcttttgatactgatagggtatgctgacctctaaccagttattggctgatcttgaagatctggaaggccaggtttatgttatgatatctttaataatgtttcagaactacgtattgaactacctatgaagaaatgtctttgacaagcaattctgttgaacacatttttttaaatccagagatttttttctagcaattttatttctacaatattttctgaaatttttaaatttattttatttattcttctcagacacatttaggaagcacatactgaagagatcatgtaaaacagtggttacataaagagtgatttcctaaaaaacttgaacctatgagtccataataacttgtttgagaaataacacacacatcgtctttgattgtagactgaggctaatttactaaactattattaggtatgctagaaaaatatattaaaacaaagcagttgacatataatatgctcatgtatttttagcttactaaatgtactcttttttgtctacttttagcataaagcatattgatagtaataattatcataagttcaaccattttaatatgataattttaagataagttctatactagaactggaacaaaattaaaatatattttgtcttgaaatgagaatttaatgcattgtaatttatatagtttgtgtaaaaccatctgaaaagagctaattctgtcattattcttccctagtacatttgtgattactcccatataaggcttcttagaaaagatgtggaaatacgtttaattttcccctaattgaatgaaagatccttgtgactaggacccctattatctctttcatggcagtatggtatatggtactcaatgtcatgtcacaaaatacacctgtacagggattggcatgagaaaatatgcttcgcttgcttgttgtggaaatccaacagatttttccaagtgtgagtgtcctctttattttctctttatctccattagctcagacaatgtagggaggaaatttggttcctattattaatattagcttttgcttttcaatttgtcttatttattgagccctatcaatttgtacagaaagctgtgaatctacaatacgaatttaaaaatgttttgaccaaaattattagttaacaaaagtgactgttgtggttatttatatttctaatattagtgctttatctgtctattgtatctgtatttttcttttatggagataggaaattttaagcccaatgttttgggaaagagggatttcttccaaagtgtactacatagaaagcaaccttaattaaacattttatgatgcttttgctcccaccatcaagaggcagcttttgtgttccttcatttttcacattgcttcatatcatacatatcatattgcatatgtgtgtacagtaagtattgaaaattatattagtatattgttatatatggcaatggagttaatagcaaaaattccaattgcaaaaagtaaaattttttaaaatttgagccataagtcagtaccagttgtcaatcattcaagcatgtgtgtctttgacatatagtttgatgagatgagaaaacagtattgactcacagtcatccaccattactcaatatgtccacaagaaagcataaaaattctaaaattccttgacccattctgtagaaaaaaagttaggtgaaataacaaatacatatatataagaaccctggaagttttaggaaaaaaaaggtagccatttaatgttggactttatcatataatatataatgtaataaaataccattttttcaaaagcctattttttatgatgagacctttttgatgagaattttagaagaactgtgggcattgaaacccaatattttaccttgatatattgaccattttattcctttttaaagtgtctattgcaggtattagtagttgtgaagggaaaaccacttgttttgatgccttttacctcagctagaattcaaagacataagtcaattggttaaaagctgtaaataagaacaggaaatatttacatatcagtaaatatttttggatatttcttaaatagatgcaaaggtagaaaaaatcttccaaatatttaacccacatgaagccaaatattgagatctcagaatgatagagactggactgaagctgaacacatatctttaacttgtatatattttgcttcttatgtttaaaggggagtatgtaagatgacatctcatgttagactagttccttcacttaagggacaaacaaatactattgagtttattggcattcaaagactatttctgttctacaattgcaaatatattaaagagcacaggcatttctgtatggatatctcaagatttgtgagaagctggtttaatattaatctttattattacatggatttctaaaatggttaggcctgagcaattgatttttagattcctctaccatgtcgatttctttcctccttacctgaaatatcttaagaaaattgtgagttacagaaattagcagggatggatgagaaatagcttctgccataaaactatccttcctgggagaggaagggaaatatggagcctatcaagaatatacaaccagagtcacaaaataaagcaaatagcttcattacattaaataaatatataaatgtcatttttgtctaactctgcatgaaaaaaaaaacctctccatatacaaaatttaatgtactgtgtgaagagtaagagtgagaaagaggatatttggggtcataaaaataaaagtattataatattggttcgaagctaagcttttttgattcattgttaaaatgactgaatggaaatcaacacctgattataaataattcagcatcaaagacaaagagatttcatgtacaaaaaagctgtgaacatcaatagaatagctaagaggtaaaagacaaaaaaaagagatagaattaattaggcagaccctgatatttgtttcaaaagttgaatttgaaaacaataaaacaaaacataaaaattgatcactgatatgcaactacttaggagacattctagatcatctaatctgactgcctccctttattattattattttatttatttatttattgagaccaaattgtgctctgttgcccaggctggagtgcagtggcatgatctcggctcactgtagcctccgccttttgggatcctgtgattctcctgcctcagcctctcaagtagctgggattaaagctgggcgccaccacatcaggctaagttttgtatttttagtagagacggtttttcaacatgttggccaggctggtctcgaactaccgacctaaagtgatccatctgcctcagcctcccaaagttctgggattacaggtctgagccattgcacccagcctgcttctctttataactgaaacattaactgaaagtccaaggctgaaatatgcttcgatatggttgtagaatctaagacttcacctcaatggtaagtttgacagttctgccttcaattgtcttgaaaacaaatcacatttttattttttttctgcctacatagctctattttcaagtatttttggatttcaaatatttttgattaccaagacagacctaaactatctaatatgaattgtttctctattgattttctcaatttttctcctactgacaaatgaaagtagggttttcaaaataattggtggacacctcctctattccaccttcagtctcctctagggtgtatgcataatgaataaaagagaatacaaacgcagggtgagtatgaagtgatcaatttgctgcagggcagagctgatctaggttttcagacacaatgaccctctgattctactggatgtggttcctgtgtaagctccacagggagcagagatgacattactgcttttaaattgcctctatgtctctatgtgcttgttgctagcctccagagtccactacaataggcatcttttttttttttttttttttttttttttttttgatggagtctcgctctgtcacctgggctggagtacaatggcatgatcttggctcactgcaacctctacctcccgggttcaagtgattctcctgcctcagcctcctgagtagctgggactacagttctgtgccaccatgctcagctaattttttttttgttgttatttttagtagagacggggtttcatcatgttggccaggatggtctcaatctcttgacctcgtgatccgcctgcttcggcctaccaaagtgctgggattgtaggcgtgagtcactgcacccggccttacaataggcatctttaaattacattattttctaataccagaagggatccaaaattttgcatttcttgcccttacgttagggatgtctacttttatttttttaaccttaagtcagtaaagaccataactcctgcatctttatcttatgaactcatagttctttcccagactggtgagttttaaatatgctaaaatctatgattaactttgcaatttaaaaaaatgcaacaatgtgtttcagtgctatttccttccattatggttctcccttccaattaacagcattttaaaatctgaacggtcattatttttcagtgagaaagtttccttctccaccttatcctcatccatctttttctcttctatcccttcttctatctttgaccattgcatgttgtattttattttttaatactttgttgtcatttataagatactgaaatccatcccctgtattagcattgctctctcattcctgctttctttactattctccagaagaaaacttcagtatttttcatacatcctttattccatttagatttttcagtgttgattctgtagtatcttacttctaattttttattaaattaatttaaggccgggcgtggtggctcacacctataatcccagcactttgggaggtcaaggcaggtggatcacgacgaggtcaggagtttgagaccagcctagccaatatggtgaaaccccatctctgctaaaaatacaaaaattagctgggcatggtggtacgtgcctgtagtcccagctactcaggaggctgaggcaggagaatctcttgaacccaggaggtggaggttgcagtgagccgagatcacaccactgcactccagcctgggtgacagagtgagagagactccatctcaaaaatagtaataataataatttaagtttattgatgaatgttgtattttttttaaatgcacttttttctcacgtaggctgtgtgtttatctgcatcccagtcttacccatctcggtaagtgctgtaattgctcaggtcaaaaaataaagataaacaaacaagccattcctgacatttttatttctctcctcactttacaaccagttcaccaataaaccttctcaacttttccttcaacatattatacatcctgaatctaattactttattttcacctctatttctgctgtcttaggtagagacatgatggcctcacattgaagatctccatgtcatcatttgtcgttttcttctatttattcttttcttgcttccatatattgtattcttcgcaaaacaacaacagaaggatctttgtaaaatgttcacaatcacagtaatgttaatagatgatattatttctattcatctacttcttcctttttataaagtaaatgtatctgtatacctgctactttaagattttcaggagaaagttcactttctcacctcatcgatagcgttggcattatggcttctagggtaatgagatgttaatggcagtcgcatgagtcacttcccagcaaattttatccatctttcttgtgtttcctttctgccttaggacgtgcttattcagcactgattccagaatgaaatgacacagaaagtgaaattgcagctgaccaaagctcaaaaatatatgatataagcaagaaataaatcactactctttacaaaacagcttagcctatacaggataagacctcttctacctccactaccacgaaccacccaatgcttcatgcagaatggaagtcaatagccagagcctacagactatccgttatttagccctctctacctctctgctctcccgttactttacctcccatccattccactccagccacattcgctcctaaggttcttggactccactagttccctctagctttgcagtttgctttgactttcactactgcctggaaggctttctttacataagcatatggctcattccttcccctcattctctgataaatactaccttttattaaatgtcttttcctataactgcacataatattcaaactgaatcaactacatatctcctactccattttttgtcttcataaaacccattagttacagctttgaaagcaacagcagtattggataacatttattgagtagttaccacatgcaacctctattctaagcatttttgatgtatcatctcatttcatcttctccataatactatgaaggcattgctattctcttattttgcagagcagaaaggtgaaagacaaggagaaaaaggaatttaatcacaatcacataggattaagtgaaagtccctggaaaaacctgggcattctcttttcagggaatgcacctttagccagtatggttggcgagcctgagcttgtctcagatgtgctgatgtcttctccttggggttgcacattatccatctgaaatcttttgggattctttgcccacatcagaagttgcaacctgctttgatgtaacctggcattaccatttcagaggttcagcagcctgagagaggtgcagatgcttcacgggtcataccaagccccagcacagaaaacaaacatcctgttcaatttttttttaggatccatatatggagaatatgcatttaagtaactagtctgtcacaactttcttagtataattatatcaaaacttctttctagctatgacccacattgtcagaaagagctccactgtacaaggggaaggaacaactgttcccagaattatctacattccattcactgttgctttgctagctctaggctttcagacatgggtgcttcagaatgacttagatacacaccacaagaaacaggttttgaacacattgctttcatatattaatcccttactcatttttttttggcggggtgaaatcaaaccatgatgggatctatatgcttcttgcgacacagaccacagtattaggaagtaattcacactttagccctaggaacttttctattatttgtttttctagcttccttgataaactactggaagcttatgctgcttggataacttctactcagctacaatgctgagtagatttttctcttattacaacattaatttggtcaattcagttgggttctaagtaagtggtttgcttaatttatcctcttttccaaaagccacagctaaaaatctcttgctcaaaattaaatttagacccaaatagggaatataactagttaattgttcctcatcagtgaagtgagaaggagaggcactatgtatgttttcccttaactttattaaagaggtatattgaaaaattaaaaactggatatatttaaggtataaacttgataatttgatgtatgtatacattgtgaaatatttatcacgatcaaactaacttattcatcatgtgaaagttaccttttgtgtttgtgtttgtgtgtgttgataacactgaagatctatcatcttatcaaattttgagtatccaacattttagctatagtcacattgttgcacattagatctccagaactaatttattttgcataactaagactttgtagcccttgaccaacatcttcccatatcactcccaacctacctgtgaacagccactagtaaccgtcattctactctgaatgtgtgagcttgacatttttagattccacatgtatgtggaattatgcagtacttgtctttctgcatctagcttatttcacctagcatactgtcctctaagtacatccacgttattggaagtggcagatttccttcttttaaagggtgaataacacttcattgcataaataaaccacgttttctttattgatctatcaatagatatttagatggtttctttatcttagcgattgtgaattacgctacaatgaacatgggactatagttatcttctcaaaatattgatttcatttccattggatttatccagaactgaaactgctggatcatacggcagttctatttttacatgtctgagaaaccttcatattgtttttcataatttctgtgccaatttacattcccaccaatagtgtacaagggtttcactttctccatcacctcgccaataattatcatttattttgtgacagtgactggccattctaagagggctaaagtaatatctctttgtggtcttgattttcatttttctgatgattaatgaaattaagtacctttatattaatctggtagcaatttctcttcttttgagaaatgtctgcaaatctttacttgtttttaattcagctaattatatatttgtttatatctttgttgtttttttgctatttaggtgtgagttctgtatatattttggatattaaccttttatcagatatatagtttgcagatattttctcacattccctaagttgtcatttcattctctttattgttttatttgcagcaaattgttaatttgatggaactatatttacctattttgcttttgttgcctgtgtctttggggtaattatccaaaaaaattattgcctggacaaatagcaagaagccttccccctatcttttttttctagtactgttacagtttcaggtctcacctttaaatctttaatccattttgggtagacgtttgtaaatagtgagaataagggtccatttaaattattctgcatggaatgtccagttttcccaacactatttttcaaagagattataatttccctgtattttctttgcatcctttttaaagatcagatagccgtagatcactgaatttctttattagctctctattcagttccattggtttgtatatctgtttttgtttaagtattatggtgttttgattactgtagctttgaaatatattttgaaatcagagagcatgttagttccacctttgttcttcttactcaagattgctttggatattagggtattggcagtttcagatgaattttaggatttttttttctatttccataaagaaagtcattgggattttgatggggattacattgaatctgtagaccactttgggttgcatggacattgcagcagtgttgattcttctaatccgtgggtatatgctgtctttccatttatctatctatttaatttccttcatcaatgtttttaattttcagtgtacaaatattttgcctcttcaagtttattccaaagtattttattctttttgtttttgtgaatattgtctcttccatttctttttcaaataattcattgtttttgtatagcaacacaaattattttgatgtactgatttgggatcctgcaaatttactagatttattatttccaacaggtttttttgttgttgttgttgtttagtacctctacatatatgcagaggacctgaaaataaaggtattttcttcaaataaagctaatttttctttccaatttgggtaccttttattttattttatttttttcttgttgaattgtactggctaggacttcaagtactaagttgaaaagaaataatgagagtggatatcctagctctatactggatcttagaaagatttcaattttttccataaattatgattttagctgtgggcttttcatatatgaccataattgtgttgagaaagcttctttctatacctattttgttgagagaattttactgattaataaatgctaaattttgtcaaatccattttctgcatctattgagatgatcatatagttctttttcattttgttaatttgttgtattacatatgttaaacgattcttgcaaaccaattgataaatctcacgtggtcatggtgtatgacccttttaatgtgctgttaaattactttttatagcattttattaaagacgtttgcatctatgttcttcaagaatattgaccaatcattttcatttcaagcagtgcctttgtgtgattttggtatcagggtgattcaggccttatggaatgagtttagaggtgttcctatttcttctgttatttttggacaagtttaagaatgattgatattaatccttctttaaatgtttggtggaatataaccatgaagatacctggtcctgagcttttgtttgttgggctttttaaaaattcaatttcctcatttgttattgatcaattctggctttttttttttttttgaaaaatttagattcggtaagttgtatgtatttctagaaattttttcatttcttctggattatccagtttgctggcctataattgtgcacaataaccataaaaaggatgctttttgatccccttcatttctgaggcatccattgtagcatctccttttttattactgattttatttatttgagccatctttctttttttctcattccagctaagggtttgtcaatattatctttcacaaaactaatttagttctgatgatttggtctattttttctctccagctgatttagttataatccttatattttttttattctgccaactttaggcttagttggtttcgttttactctctctagtttcttgaggcttaatgttatactgtttatttgaaatatttcatcttttctaatatgggctttaactgctttaaactgtcttcttgggactgcttttgctgtatcccaaaagtttcgatacagtttgattttatctttgtttgtctggaaatattctctaaatttcattttgacttcattttaaccgaatagttgttcaaaagaatgctgtttagtttccacatatttctggttatttctgttttcttattgtcttgccgtattcctttgctatttgatgatttcttatagtggcttactttgattcttttctctttatctgtttttgaattgattataggttttatctttgtgattagcttgagtcttacataaaatatcttctattttaagttgatgaaaacttaatttcaatcgtataccaaatcattacacttactcctcacccacatataatacccttgtaatcagaatttgatgctttctatattgtgtatctattaatagatttttatattttaatgattagtttttaaaggaaattatggacccctattacagtgctacattagtctgcatatgactgtatatttagccacaccagtaaaatgtttgttttcatattatttcatatgtttatgttttagttacaacttgaagaactacctgaagcatttctcataagacagatctagtagtgataaactacctcaatttctgtttgtctcaaagagtctttatttctctccatttaaaagataatttctctgggtatagtatgttgaatggtagattttctctttcagtattttgcatatattatctcactttctcctggcttgcaagatttctgttgagaacgacattgatagccttatggtaattcccttgtatgtgatgaattgcttttctcttgctgctttcaaaattatacctttgtccttggcattgtacaatttgattgcaatgctgatatgcagcattatggaaagattgcaataggatgtgatatgtcagcatgcctgttgcagtcacggctgtagcacgcaaggggcatgtgtctgtggagcaaatggctggagcacagggctatttgttgtggcagtggctctgatgtttatagcacttgtgtgctctctgaagaagtggcaccagtattttaggtgcagttgctcatggagagactgtgcctctgagatcccagcatgcaagtggttgtgggagggacaagggtgtagtcgctttgtcccatagtgatggagcatcagttccttttctcaaaagatgcaggggtacttccctttctagaatgtttgggacagctatggctcttgatgtctttaatagcaaagattgcttgggtgttctgtagagcaggctgttagggcatccacccagtggctgctactaataacctctactcttcctctttgtttctagccatcttcgcacttccttactatgttaaacttcccagccatcaggccgggcgcggtggctcacgcctgtaatcccagtatttgggaggccgaggcaggcagatcacgagattaggagatagagaccatcctggctaacacggtgaaaccccgtctctactaaaaatacaaaaaattagccaggcatggtggcgggtgcctgtagtcccagctgctagggaagctgagccaggagaatggcgtgagcccaggaggcggagcttgcagtgagccgagatcgcgccactgcactccagcctgggagacagagtgagactgtctcaaaaaagaaaaaacaaacaaaaaaaaaaaaaaaaaaaaaaaaaaacagcaacaaaaaacttcccagcgatctgggaggggtgggatgaaagcaggtcctttgaatattgcccaaaaagtctgaagaaactaattgttgactgctccccttgttattgaaaaggaaactcgtgggctgggaaatccctctttgcattgagctgtgtgatgggatgatgcgggcaaaatggaactccttatcctatccttttaatataattagtcttttttctttactgtgttgctgcagctttttaactgaactcctgagctatccagaaatagttttcattcatggatggctggataatttttttatgtggggcgcggggggggaaggcaggaacctcctactgttccacttgctgataccacctcatgctcatccaggaactgttttaacttatgcagctcattaaaaaaaaaagaaaaaaaaaacttagtaaagacttaaacacattaaagaaacatttgctcttcatctaactaccaccttgacttcaatatttatggaagataggatgaggtggaatttctttccacataacatgggaaaagaggagaaaactaacgaataatccatatttactgcataacattaggagttgtggttctattagatggtatgcacttacggcaggaaagccttaagaaagtgcagattttaaaatgtctgtttaatatcctctggtgaggattgaggtctgactttgatagttatagtctcactgtcgtaattctagaaattttagagaaaatatggtacttctattaggctgtatgcaacattaatgatcatcttgtattttattcagttattctttcatttaacaaatgtttactgtcgacttgttatgtattaatatgaataagcattcatataaggtatttgggttttgttaacaaacgaaacaaaccaatattcacaaacacctggcttacattctagctgtcagaagttgtgaagagaagatgggcaataaataatagaaagataatacaaaaagaattatagagaatgttagaaggcgatgatagaaaatatttatgacacttattaaagcatggtacacagattttattcaggatcgtcatgatagatgtagaaaccattgcattgggttttgggtgcagcttaggagtgagattagggtcaagtctgaataccacaaagaaaattgggaatttatatccaaggagttgggtgaggaaaagcaagaggtcactggatggaaaattactaataggagacatcaagagaaggtgaagtttcttgctacaggcaggccgggataagcagacattgactggtgattggtgacgaggaacccagtgagacagtaagggtgattaggtattgacgacagaggattcgagcgaaattgacttagcaggattcttgctaaaactgggaaatgcagagacaaacataaagcccaaaatcattggctagtttaaaggagagttcaggagagcttaaatagcttttggccaaagatagaatatttgtcaggcgtaactgctgcgaaataaaaggtgcaattagaagtagaaataggaatcagtagtgtagggaccagaacaaggaaatgtgtgatattaaatagagagtcgagttggcatggcagccgtgatattagagtgtccaattctaaacaatccacctggtgaggtaaatgcatatattaattacttcaatttaaccattccacagtgtatgcataattcaaaacaacatactctgtgcaataaatatatgcaattataatttataaattaaaaatcagaagaaagaaagaaggaaaaaaggaaggaagaaagaaagaaagaaaaagaaagaaagaaagaaagagaaagaaaaaggaaaacaaaaaaacagaaatctacctgcgatatatagatttccaaaagcactagtttaatttttccctgaggagtaaaactgcattagaggaaaggcacagatagtttggattcaatttttttctctcagttttgcttgagaggagacagtattctgtcatttctcgcttaaagagaagaatcaaaccacttataaaaggtaaatccattgttatgtaaataagttacaaaagaaaactgttgcaaaatgccaacaggattagagatgtgacaaagaatatatcttatcctgatttcagcttgttttattttcattcttaacatccaaaggcattttttttttgctaacttgtaagaaactgtgaacatagcatgagaaaattctgatggaatatggaagacataaagaatgtatagagtacagttatttatttttagtgaccatagtgatatcaaaaaattatataaatattttttatctttataaatgaaaatactttggatttaatttatattgataataaatgttggagattagaggtagcagtatatataaaaattaagagtcaaaattttaaaaggtaaacaatcaaaagttaaaccttaaacacattattttttacactcaaaatagattatatgaactgaatatttacaaacaattgaaaataaagtacaacattttagccacaagattatttgaataaaactatgtcatgtatttttggttggaaaaaacgttttgatgcatgttttttttaaccattaaaacaggataactatgtggtgtaatatatatgttaattatgtagaggtagccataccactttgcatatatccttcaaaacatcatactgtacatgattaatacatacaattttgtgtcaattgaaaaaataaaataataaaaagaagtgtaattaatatgtattaaattccaaaactaggtatacttgcaaatttagtttatagtcctttttctgtatcatttattgtcctaacttaattagactatataaatatcaggggagggctttttaacttaataactgaaaatcattgattgagccaagtctatttcagcaaatagtggtttatgggtagtatttcacaattcatcggcactttactaagacgaaatttttctttactttcaacaacattttcttgactgccataacctataataaatatacatgttgaagaaaaattaacaggaatgtctcctttttcttctgccaaaacacatccaatgatgcttacatggcagtgcagttactttggataatatgatcctgaacaaccatgttaaacttgttaaacatatcattgaactctcctttcaaaattatgtttagaaacagtttgtaactaaagaaagtaaaatatataaatggatacctagtcagatgagtaggtagatagatgatatgtagagaaataacatatagtctgcattctaagaatttatactctttgtttgtttgtttgtttgttttggtcaaaatacagtgtagtcacttacctcaatcacttattaatcatttttccctacaaattgctacatgtttccaaccatccagtgcaactaccaaagatgactttgtcatcaagggtttacaaaacaaccatctctcacttctgatctgccagaatggttctggtaaaaatggtaacaattttggcatgataattaaactatgagaagatgacttttagagtttccatatgtatttttgtatgtacattttgtttaatgtaattgaagcactccatagtaatcaaacatcagtaagcatatctgatgtatctatgtcaaaaaggttcccagtagtaagatataaagtactcctacaggcaactgtgattagatggattttctaatccatgtaaggaacatggtatacatattctttctattgaaaaagcaaaactagcatcaatagacagaggaaaatcactaagcacttattagctattctagattagtatttgattttctttgtctttgttctcatgagtaaattagtaataatgtgtaaacattgtgttatatcacctcacaggagtattttgaattgaaaataaggttatgttaggaaatttggtaagctttaaaccactataaaaattatgagcacccaccaaatacattcttttttttctttctttttttttttttttgagatgcagtttagctcttactgcccaggctggagtgcaatggtgtgatctctgctcattgcaacctccgcctcccgggttcaagcaattctcctgcctcagcctcccaagtagctgggattacaggcatgtgccaccacgccaggctaattttgtatttttagtagagacagagtttctccattttggtcaaggtggtctcgaactcccaacctcaggtgatccacccaccctcaggctcccaaagtgctgggattacatgcatgagccactgcacccagcctatccaaatacattctttgggagaatatttcttgctaagctgattatattatttagtcatctgggcacatgataacataaaacaataagaaaaatgctaacttttgcttatgatgttacttgtgcttctctaggcagttttttatgtgctttgcatatactacattatttaatctttataatagccttacgaccaaatgagaactcatgacccacatttttctaaaggaagaaattgagtcgtagggaagtaatttccataacgccatagagttaatccagtgagaagaggatttggaccctatcactctgtagagctcatgtttttaatcattaaatattttcaatacaacctagttatctggtggggaaataaaaagaaaagaaagcatcatctgactttagtaaataacaacgttgttattcatcaaaatataattatttacaagcattttctttcacacagttaaaacaattctgcaaacatagcttcatgtaatattagatgagacaaaaataggttttcaattcaatttctacatgccaccacaagcttattttggggaaaagggatttctcttgaatttgatcactagcaaattcccattagttggatattagatggccaatgtttccaaagtacaagtaagaagttactaaagtgatatcattacacccagaatcttctcaaccatttctaccagggcctacaaggtttggcagtggccaggaatggtggctaatacttgtaatcctagcactttggaagactgagaggggtggatcccttgagctcaggagttcgaggccagcctgggcaacatgatgaaaccccttctctactgaaaatactaaaaaattaggtgggtatggtagtgcgcacctgtggtcctagctttcttggaggctgaggtgggaggatcgcttgagcctgggaggcagaggttgcagtgagctgagattgcaccactgcactccagcctgggtgagagagagagaccctgtctcaattaaaaaaaaatgaaaacaaatcaaaaacaagtttcggtagccagaaaagtaatttaaacatgaagtaggagagacacttccccttccctccccaccccactatgcctcatggtcaaaataattttataaagaaatgtttgtaataatttcttttgaattaatatagttatataatataaaaatgtaacaccatgccatcggtgagaatatccatttgggaactgttttctgtacttatttgtattctgagcacttaacacttgataatgcaatcaacgttcactgaattaatgacttcattaaatgaagtaagtgaattattttggtgatttctaatttgttggaattttgtccttttagcatgcaaaatgcaattgggagaaataagctgtatttaatatttgtggacaggtacagattatgctgatatctgtatcattattaaattccgttccatagcaagaatgaagtgtaaaagttgaagacactacgtagtaaatccactagagaagaaagaagcatcacagaaatcagtatgtataggaattttcaaacattttctctgaatacgacaagggactaaataagcacgctgaaggccagttaatgcagtgtgaatgagcacactacgttggccactactcacaccaccacactgtattttctaattagtgacctcctccaagagtctgaaaacgatctttgcagccagctgatgcaaaacagcagctagttggagtatacaaacaagagcatggggtgatgcttcagtggaagaggaagcacctgtagaacacagagggggcacaaataaaaccagtttcttcacctgaaccacagtgcccagttaaagaggaaagatagaacatgagtaagcttttaagtgttctataatcccaggtgtttgtaactcataatatggatcacaggataattaaatgaaatatttgcaaaaagcactttaacatattacctggtacatggaaggtattcataattatgcgcataccttagagataaatgggtgacactcatgataacaggtaataagggtttgataatatagttaggattttaggaaaatattcaagaaaaaaagagatagccctgtgtttggaaataacaatgacatgaaaactttagaatcatcagccagaagaaacccggaaagaattaaggcaaaataactgtacatttgggtaagaaagtgtggagtagtcaacctgtgaaaaatgtggttataaatgcatccagttggaattgtaaacaaaaaagacacatttctagaactattaatacaaataatgatattgctaacgctagggtgaacaaaacaaatagctcaccattctgaattcactgactgggggcgaggaaggaatacaaatcagagaacggttcaggaattgtgaagtttcagacttatatgtctgctttggagaaaatatgtccatttctgaacaaaattaaaaaacagaaagtactctttatttttttaaagcagatgataattatactgggcttttaccatgtggtatacactgctggaaaatgttttcataaactgactaatgtaatgtcacattgatcatataaatatgaattattaggtgttttcatatagagtggaggaaaattatgtaaggaaatggtggaaccaaggtttcattgcagacaattggctctactactctaaaccctcaactatactgtatgaccgaaataaatcatttatgaaattagtctacagatataacctagaaaaaaatggctaaaacatgcaattaatgaccaaaaaaagtggaattgccaagtaaaagagacagaaatccttccaaataataaaggaaatagatatttttaaatagttcattacacatataaatgccaatgataggataagatgtgatactacctttcagtgattttaaatgtagttattgggtgatggttaatatcttcccgtagttcaaaattacattattatcttgtctttaatttttataaattaattttaggatttttaacagacttcataagtctttcaataaagttttaagtatttttttttgtggaatatagtaaagcttcttgaccaagcctgtaacttgaaaatcgcttcagaatttgccaactgtttggttaagtgaccttgccaaagataccttaatagaaagattaagaaataaaaatatatttcttaaacgtaggacttaagtaaatacattgctacagtttaatacatgatcaaagaaaaaattgacaaatcgagagtcagcttgattctcaaatgccaaaacaagggatcaaaatggaaaagcattatgtttcacttatattgtgccactgcttccattttaactgagaatatgtaaaaatttgcatttgttacatcttctcaattattcatatgcgtgaaatatttcaggcttatgatcgacttgtactcaaatgtggtgctctctctttagttaattccctttagaattatctctgaaagggaaatagcacagaggaagatgcctaaactcctgcttggtgagatcatgcaataactttgataaatggtgcttgagtcagtgaaaagacatttataggttctctggaaccctaagattgaagagcattaaaataagcagtgaaaggtgctaaatcaacaaaagtgatacaatttctggttttattttaagagaaaaacagtctctatataactaaatcaatgcctcatttagcccttcttccttagccattatttgccatgttaattccctttctagttcaggtcttgctctataatcctgtcgggttcttcccctgttttctaatagagctcattcttcaaattttaaataactctttgcaaatttccaaatacatctaggggacccgttcattctattcagtctgcattatgttactttctttaatgcagcctttgctttacttactttataggctgccttaggtgcctacttctattacttcctgctagatccccctactaagaaataagatagaaaaatattgaatgactagtgagtgggcgaagcaaggccttggcctgagaattagatagtagccacttccaaactctagtatcatggaccacctgacaaaatacaagccttcttagcagcaaaaccaaaacaacacacacacacacacacaccccaatggatccttgctaaacccattattccatttgtaacttcaggaaatgttgaaatattaagaatacaaagctaccatagcaaatgttttatatatcagatattagttcacataggatatagattaacaaaggaagggccacattgataactaatgaatgagtagccaagggggataaggatggatatcttaaatcaataactgaataaaaaatttaaaaaatctacatcctggccaggcacagtggctcacacctgtattcccagcactttgggaggccgaggctggtggatcacctgaggtgaggagttcaagaccaggctggctaacatggagaaaccctgtctctactaaaaattaaaaaaacaaattagccggtcatggtgaagggcacctgtaatcccagctacttgggaggctgaggcaggagaattgcttgaacccgggaggtggaggttgcagtgagccaagatcgcactgttgcactccagcctgtacgatggagtgagactctgtttcaaaaaaataaataaataaataaaaataaaaaatctatgtcctcctactcttttaaattaattttcttctacaaatttttttcttcacttttgtgatatgttgtctatttttctaattatatgtaaatgatccctatatagtgtgaaaagtctttcaaatttggttgaaaaaaatttatatagtcaacctcttattgtgctatctgattaaatttgaagtataccttgataacctaaaggagtaattcagctaatttgttcaaccaatagacatatttatataaacagacaaagtaatatatgcagtcgaaatatccagtctttgattgttttatattcattaagattagatagattgacttttatctcacttgcctctttaaaaagataactcttgcagcctgattggtaattttttagtatatgattcagggaatgaagattcaagagggagcaatttagaccattaactgtaataagtggccctttcttcattatgttgggcaagaatgagttcattttcatcttttttgttcatagttatcattattgtcttgactcaccagcccagacctttctgtagagtgtcaggtgttcaactttccatcagactttcacatagatacctctcttaagcacatgaaagtcaaaatatcccaaattaacactctcttcactgatctttacctgatacttctcatcttgtagaggtttccccactgactcagatacttaagccaaatacctgagtgtcattagaatcactcccttttcctcatcctctacttccaaccagtcttcttatgcttaaaaattcacttaacgtaacattttcttcatttcatatccactattaaatttagggcagactgccacagttctcattatgatgtctctgactccattcctcacactgctcaggccatatcatactttacttagcaacagcatttatcgcaagggaacaatttctatcccttgaaatactggttggtttctagaatgccacaccctcttagttttttttttttctttctgaatgatcagtgggcatcttttgcttttaccttttctctcaatcttatgtgtcagtatccagtatttgagcctctttctatacatactcatttctatgctaatttcataaggttaagggctttaagtagtatctttatgctggtcatatttatattactattttagcttgctcctctaaaaaccagtgtatgttatgccagctgaatatgtctgcttgagtctctgagacataatctcagagtagatccaaaattgaactcctgatttccaaccacctccccacaaacagttcatctcacagttttctgtattctaggtcaaacactttggatcatccttcattcctgttttcctttcacaccacatgactatgacatcaggaaaccctaccgtcaacatatatccaggacttcaccacatctcctcacttctattttaactaactttatttcatttctcttttaacctatctccttaattctatcattgttccacacaatttattcccaaagcaactttcaaaacaatcatgttaaaatatataaaatcatgtcacttgtattagtctgttttcacactgctggcaaagacatacccaagactgtgcaatttataaagaataagagacttaatggactcacagtttcacgtggctgaggagcccccacaatcatggtggcaggcaaaaggcatgtcttacctggcaacagacaagagagaatgagaatcaagcgaaagaggaaaccccttataaaactatcagatctcgtgagacttagtcactacataagaacagtatgggagaaaccaccaccatgattcaagtatctcccaccaggtccctcccacaacacgtgggaattatgggagctacagttcaaaatgagatttgggtggagacagcaccaaaccatatcatcactcctctgctcaaaacttgccaatggcttcccatcttacttacaaacaaagctaacagcatgatagtgatgtgcctgctcttaattacctggcccatcatcatcattctgatatcatcactggttctttctgttacttttaccttagatattctggtcccatgaatgtacctgaaatagcctagaaagcacccacattagggcatttgtgcatatgattcttttttgcctagacctctctatcacttcttttaagtaagcctgtttattgctagcagtcagtggcatgccagtaaatatttaacaaccagaaatatgtatgcatgtatataagtgtatgtttatataaattttacagatataaaagatatgtagcacacaatttacaagcaattatagaatatatattactcttgattggaaattccacatagtcaattgatttttacagaatatttacattgatttttactgaactcttgcatccataaccaatcagttgttgcaatctgttgaatactgataatattttattgcaaataaatgcttgattactatctgattcagcaaagaagttgctcagttcattggcaagtaagttttgttctggcttaggtattggctaatatttttacttacgtaaatgtgtagataaatgatgttcgtctcaatttcacttgttcatcaatatgagctgcattttgctaagctaaaaatcatttttattatttaggatactatttcttcaatgttttgtgttccttgcaatgtaatggttactttggggtttaaactgctttagttgttttctcctttactttctcaagtctagacaatcaccagatcaatacatccactgccactgattttcaagttaccaaggtgacacgattgaacatggagttgagaaaagatgaacacattgttctataatatttacaccatacagataaagtagacataaataacatcaaaattatagataatggtaaaatatagtaacacaatttgaaagtagtgagttttcaatatttattactttttaaagtgaaagggaacttttaagtttatataatttaatgtttaattataattatatctatgagccagctctcgaaatttttgaaagcataataatcagcacttgtgacccagaactagctaattccagcatatcactattatagtcctagttaaaaccataagcccaaactaaatgtttaattttcctcagcaattaacaacaactaatctgctatatatggtattattaggtatgatttaattatctttttttttttcactaatctgcctttcctagaatgtcagtgttgtgagggcagcaattttctccacctagaatagtgcctggattcaagagggcactctatagctaccaactgaaggaattaataactgtttatagttctcagaataaaggaatccaaggccactcttcatgatctcacacttgcttaacctctatcccaattgaaggaatgaataactgtttatagtgctcaggataaaggaatccaaggccactcttcatgatctcacacttggttaacctctatccttagggaacccacacaaaagtctttctccatctccatgttttctctggcgttgtgttctttcgcacatctgtttttcacatcttgtgtgctcttcttgagtgacttcaggccctttttggtcaagtcaacacttgtgattttgcttaactaatatctttaatatgggctcaaagaacaaatttacacagtcaatatgtttttatttttttcttggtgctatttgttattttgctttagtgttgtcgcttgagtggtgtcctctccccatgaaaaagtcgtatattgaagccctagcccccagtaactcagaatgtgaccttctttggagttatgggttttacagaaatcatcaagttaaagtgacatgctgtggtgttacagggcttttccttagttcagctaaagacaggtccttgtcccacagccttgaaagtttaggctggcagatgcttttaagggtgagtaacacaaggctttattgagtgaaaaggaagaaaaggggggaaaagggactctcttcaaggcctgagtccttgctagagtgctttctgcctcgttgtttgaatcccaagttccacccaggaaaaggaggggccaggcttctcctccctgctgcaaatggggtgaacttctgtggctctaccccagtgcacaggccagttggagttttgccagggaccccctcccatctggctgtctcagtgggccataatccattatgattggtgccttatgaaaaaaggaaatttgaacatagagatacacacaaaggaaagatgatttgaacatatggggaaaagtccacgtgagtaggaaaacagccaatgataagccagggagagaggcttgggaccgagcaatcccatactgccccaagaagaaagcaaccctgccaacaccttgatttcagacttctagattccagaacagtgcaacaatacttttttgctttttttttgtaatcactcagtttgtggtatttgaggacaatatgatttgcagattgttttaggcaatgagggcacagcaatgaaaacacagtaaacaaagatccttggtcttgtagagcttttgttctagtggggaaaaaaaaaacaaataatttgtcaaaaacaagaattaaatttgcatgaaaataagaaattaatgtaatggcaatacaaaacaaggcagtagaattgagaaagacaaggaaataatctctcagaaggataggcataattgcctggggccagtattactgagggtggtatgaggacagcaattacctgttggatgtggcaacatgagaaccacagaaaataagagcattaaccacaactaatctgctatatatggtattattatgtatgatttaattatctttttttttttttcactaatctgcccttcctagaatgccaccgttacaagggcagcaattttctccacctagaacagtgcctggattcaagagggcattctatagctaccaattgaaggaatgaataactgtttacagctctcaggataaaggaatccaaggccactcttcatgatctcacacttgcttaacctctatccttagtattttcagtgtagcatgcaaccttaatcaacatcggaagggcttgtactagagattaaggggaacaaagcaggtttgctgtctggtagacatagagacgtgtggtcctgagcttcctttagggaaaaacttgctctccagcatggggagtgcattcagcagcacacttccagctgtcagctccttcagaactatctcaacctttcctgaagtggcaccatttccaggacagcactcatccagtgacagaatgaaggagggtgtataaagttctggctactttggcccaattctggactctacttaaaactatatgctaaaggaaaaaagcatatacatatctctgaaatcttaataattttaggaatcagatatatgtgtttacttcagtgctgcatatttgctacatgtgacataaataacatgtatatgatatgtaggcatgctttaataatattcatatattgtatatacatatagcatgcctaacatgacagccaacttgctggaaagtggccatgtctttttagattaatgagtatggcagccagggtggtggctcacacctgtaatcccagcactttgggaggctgaggcaggcagatcacctgagatcaggagttcaagaccagcctggccaacatggcaaagcccagtctctactaaaaatacaaaattagctgggcatggtggtgcacgcccgcaatcccaactactcgggagactgagacaggagaatcacttgcacccagcagacagagtttgcagtgagccaagatggcgccactgcactctagctgggggaacaagagtgaaactccatctcaataataataataataataataataataataataataataatggagtgtgacataatgcattataaattaaatcatgatataaaagagaaataaatcattttttataaattaggaaaccagatgtcacaataactaaattggtaatgcaggagaaatcatcaatgttcagttacttatggacctatgttgtcaattatatcattactaatggaactagatggtcattgatatatgtatatacttatatagtagtgttttaatatatttaaaattatatgactctaaatatagttgtctcaacaacacgtattccaagtgtttttgtgacattcatattaaataccctttctctaatagtaactgtgactaaaaaaatctacataaagcatctcatcttttgaactcatttaaaccatcaaagcaaaaaccaaaaaaaagcagaataagataaaaatatgccaatgaataaataagcatcatatgtctatatgataatatttctcatatgggtttgcaatttgagcacacaaattttttataagccacatgaataagctattttgggaaatcatacttaactaaatctagaaatgaaatataacttgtataggatatttaaatgtttttagttatctttctaattttcttgattaatagtatcccataaatagcatagataatctcaatactccccatagagtgtaagtttcctgatgctaaaattctttataactattcattaattacaggaagtcgtgttctatgtgttgactaaacagcaattatttggaggtcaggttcattttccttcacttgcttatcctctaaatacaacatatacctgaactcatgaaatatgcttacaatggaccatagctgaaatattccatttgtgagttatgtttgtttctctatatgtcatgcactccatttctggagagagacagtgagaggaagagaggcagaaagagaggaaggcaagaggacatggtaggtacacaatatatagtatgatttaatggtcttagcaattgatctagaaaaccaaacataactggttttcctttggggtaaatcaaactactatggagagctttcaaaacaagaattttggaagccaggaaatttagcagggattgtctaggcaatttcttaatccgtatgacgttggtttggaatactgggtaaagcatccatctgacatatcaacttgtgtggaggttcaaggatgggtccagggaagttcaaggatgggtgcagtgagatgcctagtgccttagtaggaacagctaggagactaggcccagctggatgcctcactttctccatgtgattgcagagcctctctacatggtgtcattaacaatctagctagatcacttaccagaaagctcacaggctaaagagatcaaggcagcagcttctaaacccctcaagaacagagcaaaaactgctaatgtcactttcattgtactgccttgattaaagcagtcacaggccagcacaaatttaaggagaaggcaaatagacccagatgactgatgggactattgtcaaagaatttataggaggcttcgttaatccctcaagccaagatcattttctctaaatggtagcgatagtagcattgatagttggttctctacagagagaagatcctaagggctaatggccacttgaaacaagatggaccttatttttccagttctcactcttttttctgttatacaaaagactgtatcctgagcagttggcatcagaactttcagtaacccgagtttacttaccatgtttctgccatctcttgaaggaaattccctacaatgcggacctttgattccaatgctgttagaatctaacctggccaggagaggctgcttctgaaatcacattgccaaggtacagacatcctttcaaagtctatttgagggtctgttggccaacagtagagaaatatttgaagcaggatcccatagctgtttctttcttattttttcatccagaaacaacaattattaagacaaatgtgtgaatgatttcatgaatgcacacatggcaacagaattctatatgctccatcaactctggaaagcagaaggatgtgactaagagcacaaaaaataatgtcccattcaatatatagttactggctgcattatttactgttttattttattttgttttttaattgtggtaatggcacttaatgagaactaccttttaaacaatttttaagtgtccgatacagtatcattaactgtaggcacagtgttgtacagcctttagaacttattcatcttgcacatctaaatctttatacacattaaacagcaacaactcatttccctctcactcagcccctggaaaaccaccatttattctattcttgacactgtgagtttgacattttcagattcctcatataagtaagatcatgcagtatttgttctgttactggcttattttacattacataatgtctttgaggttcatgcagcagtgaacataggagtgcaggtatctctatgagatcccgattataattctattggatgtggacaacaggtatataaaaagataatcaacaacactagtcatcagaagaatataaatccaaaccacaaggagatatcacctcatactagctaggatggctatcatcaaaaaacaagacaggtgttgatgaggttggagagccatactgttggtgggaatgaaacggcataggaattcaacacaatattaagaaatagaactgccttatgatccagaaacatcaatttctacatccaaaaaaaaaaaaaaaacctgggttcttgtttaggctaaaccacagggcttctgactatgtgcaatgagtttcatatcaagagggagtggcaaattacacctctttaagcagaaaagtgatactttcctgtgctatctaatgatatttactcacaggtaaacctattgtgaaagtctacagtttaattttcttttttgccatatttagatagtctcttacccatgatagttcatcttaccatttttcagctctgtaatgggtttattatgatgcaactccatcgtaagtcaaggagcatctgttatgctcttagtaaattatctaaatttgttagtaaattccattttgctgaatggagtagttgtgctgaaggtttggcaatctggagaagagtagccctttgcagaatccctgggcagccctatgattttatcagtatgattattaaatatatcagcaagaaagacagagcttttgaaaacacagatcacattgaatactaataacagaaataaaatgcaagcaaaaataaaaaaaagcattctaagtttgaaacatctttagtgatgtattaaaataactacatctgcctgatgtatattttcaaattcttagatagtgaccacttttatgatcatgtcccccctctctcattctgcttcttcatttcctccttattctcctcctctttatttctcttttctctctatctctccctctcaaaatacaccaactctgtcctataaactctgcaagttacaagggctaaattccttgagctaatgccactgtggcatgaagatttttgtgtcaggaaatcccgggtatgatttcaaattttccagattggtaatcttgtgatctgagaggagttattgacatttcgagcttttcttttcacattctaatagagtgtgtggaaataaatacacgacgtatataccctaaaggaattcccttaaggaattcttaattcacattctctacagaaaacatgtgaattatccttccttttctcctcagcagaaataaactacttcaccatcaattttcatggtaggaagagaaaaaacatatagagaagtattgaatcttcctactaaagcataaaaatgtctacctctatgaatttatgattgctaattccatgagtcatagcttgcagctaagtagcttgtgttttaggagaaattttaagatgccagtgtctcatataatttcttatatatttttctttataagtaaaataaaatctgaggttttaatccatcaagcttgcagctaagtagcttgtgttttagaagaaattttaagatgccagtgtctaatataatttcatatatatttttctttataagtaaaataaaatctgaggttttaatccatcacccactggaagcttggagtcacaaatgtgctaaatttaccagtagagatagagacaaccataccctggctaaaccgcagccgtaacagtgactgacaaatagggaagtttggtcaatcttgactttccacaagggcagcagtagaattatttaaactttcagccacttgagaaacaaaatattgaatgtttgtaaaaattaaaattaacctttaaatgtaaggtgtattttaatcactgagtacctaatctctgccattgtctcactaacactttccactgaagctaaatttgtgcactgtccaatattgccatgcatattccagaccccaagcctgggttcatgtcaagtgccctttccatgaataccctgctttctccatgcaattcacagcctacaaacatggccttcccccacaggtactcttcattcatatgcttccattgtgatcactatggtctctgaagtctgtgttttgtgtttattaaaatgttttctgtattactgtacagatttgcatatctgtttccatatcattgaacattctaatcatagcatttcaacttcgtaagttgtatcttatatgtgtttatatcccacattttatacagagtagaaacacattcagcacacttcgaattgccaatgatgaatgaagaaaacagatttctggattatgctgctgatggatatgcatccgttaaatgtctgattatttttgttttctatacagacaagaatttatggaagatgcattatcttcataaaatcgtttgggaaaattcagaatgtgtaatatatatagcatataatatactaaatattaaaatacttaaatataaattgtgtagataacataaagaattttataggtacctaaatcaccataatcaggcagttgaagagaagacttactgctgccaagatgtttagtgccttcatttagaaaatggttaatgaaacttttacatatatcgaaatctcttagtactcatattaatttgcataagcagatcctccaatgaaatatgagaaccttaaggccaggtaccatatgtgggtaaatagatagatatttcaaatttgtacattcacaagaatctctggggcaacttgtcacaaaacttatgcctgggacccactgccctggattctaattcagtaggtcgaagatgtgagtagatttgcacgataatgagcactttacatgatttagttattaagtggtccacatgtcccattggagaaacactgggagtcctacccattttctgtaaaataatagatgttaaatgaataaatgaaaaactgaacaaattaagaaaaagaaccaaaagtaggccaggcacggtggctcgtgcctgtaatcccagcacttcgggaggccaaagtgggtggatcatttgaggccaggtgttcaagaccagcctggccaacatggtgaaaccccaattctactaaaagtacaaaaaatagctgggcatggtggtgcatgcctgtagtcccagctactcaggaagcgaacgcaggggaatcacttgaacccgagaggcagaggttgcagtgagcagatatcgcacctctgcactccagtctgggtgacagagtgaggctctgtctcaaaaaaaaaaaagaaagaaaaataagcagaagtacacatgtgtagtttagacatagaaggaaccttaccactttctctcataaatatgtgtgtctaccttggaggtttttgtaagaatttaaatgtgcaggcttgtttatttgttctagcccgttaggcatttttattttgcagtcttctgtggtattatctaataaacaaaatgtgtacaacattttcatcttggattctttttagtgggtaaaaatgcaagaaaacattttggaggatctactgctatatgaatattattagtcaggaggcataaacatatggtaggctagtgactcaagctcaacaagtaatgtttataatcacagatgcattttcaatgttatgaacttgtgtacagcagagagtaattcccaattacaagcccctacatatcaaggtgattggaaaacagtagtcagaggtaatttgcaggcaatcgggcacctacaattgtttaccagggaagtaataagaaacaaaacaaaatgatacacaggtaatcacatcttgttgattcaacccagcatcacaagagaataagaggcaacaattcaagttaaaatttttgaagtaaacattgccagtgaagcctttccaacaaacatttagaatatgccgtaaccatttacctaggatgtattgaaaagagaagcattttatttttaaacaaatgcacaatgcagtaatttatggaaattaattttgctgctctgtatttttggctttaaaaatgtactaaatggaaaggctacacagtgttcccttagtaagattttatcaaagacaagggtaaattattttgcaaatactggatacatggatacatgacagaaatggccaaccaaacaaataaaacatactttcttacttggactatgtctatatagtttattctatctttatccattggcttaccttttacaattgagaaaaatgcacatcattttgtatattatgtgcctatttgatccctatacatatacatttgttggcatgacatgatgaagataaaatgtgaagaaatgcatggaaacataatggcaggactttgcctttttaattgttgcctattcagcaacatatggtcttgaaccacttgcacacaaatcaaactgaatatttgtgtccgacctccctagagttcataagttgaattcctaaccccaaatatgatggtatttggagatgaggcctttggaatgtagttaggcttagattaggtcatttcatgatgaaaatagtggctcaaaaaaatttaaaaaaggagattccccatcctcctctcagtgcttgcaaagaagaaagcccatgtgaggacatggtaagacggtggccatctgcaaaccaggaagagacacctcaccaggaataaaatcatctggtacctcgatcttggactttctagcttctggaagtgtgagaaataaatctctgtttttaaaaccacccagcctatggtattttgttctggcagcctgaagagattaacgcaatagtctgttggagatgtgtgtaagccagtcccacttcagattactaaatcaaaatttctggggactgaaatatgagcaatttgatcattgaggaaacttcaggataattgtaaacacaagtttgaaaaccaataacaatattctaaaagttagaatgacaaaataattgatcatccaaactgccacactgtttaaaatgaaaaggagcattgcaatagttaagctaggacaaggtaatctgaaaatttcctgagaaaatcattgcatatgatcattttgcctgtatagcttcacatttaaccaatttttttaattaaaacgatcattctgcttgatgttttcactatgttcaaatgtagcttcgtgcataaaatttgggtgggggggaatcaatgtatgtatctgtgtggtgaggatgtaggcgtgtgtttactcataatatatattttattcggttaaaaaaaagacagctattatgctaagcattgtgagaatggaacgtaggctgtgaattactcttgaatttaatttaaaaattttttatcacaatattggtaagatataaatgtttgccattttcccctaacttatttcaacactgttcacaatttcagataaattcattatacaatccagaaaccacacttatttgtgtttacccaaatgagttgaaaatttgtgtttatacaaaaacccatatgtagatgtttatgcagttttctttctaatcactgaaacttggaagcaagtagatgcccttcagtaagtgagtaaataaataaattgtggtccatgcagataatggaatattagtcagagttaaaaggaaatgagctaccacactgtgaaaagacatgaagaaatcttaaatgcatatgactaagtaaaagaaatcaatctgaaaggctaactgtatgattccaattgcataacatttgaaataggcaaaactatggagacagtaaaaagattcgtggttgccaggggttgagggaggggagggatagagaagagacaatttttagagcagtgaaactattctttttgatactatgaagtagtttaatgttgccatagttgtcaaaacccataccatatacaacaccaagtgtgaaccctgttgtaaaatctggacttcggagagtaatgatgtgtcaatgtaggctcatcaatagtatcaaatgtaccattctggtatggaatactgttagtggggaggctgtgctcatggaggaagtaaagggtatatgggaattctttgtactttctgctcaattttacagtgaaaggacctaaaattgctctaaatatagtctatttaaaaggagaaataagaagttactgtgtatcagttgtactttaagtgatcccagaaaatgcgtctgggttccaggttagaaagtgatcatcttttactgaaatcatgttgctatggcaatttggctgtaacactttctgattatctatatgtctctaggaggggtcatagctaagcacatgcagctgggccatcctgaagagagcgttatgattttttttttttttcttttttgagatggagtctccctctgtcaccgggctggagtgtagtggcgcaatcttggctcactgcaacctccacctcctaagttcaagcaattctcttgtctcagcctcctgagtagctgggactacaggctcgtgccaccacgcccagctaattttttgtatttttagtagagacggggtttcaccatgttagccaggatggtctgaatcttctgacctcgtgatctgcctgcctaggcctctcaaagtgctgggattataggcctgagccgccgcgcccagccaagagttgtgattttaaattaatcccgagacaatcctttcagagaagtatgtgtccgttttggatatggtcttttctatccatgagcaaatttggctggcaaatttcttcccatttcatcctggaagtggttgtagatatgtgtcattcacttcataatacttagttttacctttacatatctattttgcaaaactcactaatgattttattgtaaacctttatctttgataataatctcatatttctccccaccaaagacaagtcctatttataattaattctccttaggaaagacagctttacttttttcaagtggtagaaaatataaatttctttcataagttctttgcttgttcatttctgtatcaattcaattcctactaatgtaattatcgtaagataaaacattgtttttttaataagggtgcttgaggctttttcatatgcatgagttagatgaatcatttattataatattattataatttattttgataagaataattttcatttctatttagcttcaggaaaatttttctgaattccctcaattatatgttcacaatatgtgaaagttatgggatcttcttttctgatacctgaggctctcctctcaaagtcattattacttagccaatcaattcagaaaaaaaagaaaatagtgatttacttttttatattcaaaatatgacaaaacaagtcattgaatactcctttctgcttttaaaggctatttttaacataaatatataactccttctcataaattaagatattgtctgtaaaagtatttggtaaagcctataggtaacagttataattgacaacttcttaagaattgtactgtaactaatcaagtgcgagtttgattgaaagtcattggtgtatttattaaagatgacatgcttcaaatatttttaatgaaaatacatttatgaaaaaatgacttatgtttgaaggatcaaatatgtttatattttataattatatgcatatatagatggacatataaatacatatatacacatagatatacagatatttatacacatgtttataatctatctcatggacatgaggacaatattctatgttatggcatagttaatataccctgagtaaactttatcctccagaatatgcgtttttaactttaaaacgtaagactctattaacagagctattaaatttatgtatgtagaggtgggtgtttatgtatgcgtaatcacagatgggtatttaatatttttcatttctttattcaatccaagggttcatcatgcaaaaatgttaaacgtccctctttgcactactaagataaaaaatgtgattttttacagatgatttatagaataaaccttatcagtttctttattttgcctaaatacttagatctagttctccttaaagttgttttctaacaaaaatagtgagtttcttagtctttgatacgtgttaatatgcctcctgcctataatctctgtttaagtgtccaaactcctcaaatgttttccatcattaaacattgataactctgccaggaagctatgtaaattgttctataaagatgaaaattagcctctgcttaaatcaatatgaccaccttagttgaaacttctgaggagctcaaattgtaaaatgttcagcacactagcactaggaatagggtggcaggactacccttgagggaccatgtacttattattattattatttttttagttggagtctcactctgtcgcccaggctggagtgcagtggcgtgatctccgctcactgcaacctccgtcttctgggttcaagcgattctcctgcctagcctcatgagtagctgggattacaggcatgcgccaccacgcccagccaatttttttttttttaatttttagtagagacggggtttcaccatactggtcaagctggtctcaaactcctgaccttgtgatccacccgccttggcctcccaaagtgctgggattacaggcgtgagccaccgcatccggccgagggaccatctactttaaggaatgcagagagatagacatcttaatttacttaataggatgtttggggcatgggataagtaaatttttcaaagagacagtattcatgcattggtaagatattgtttttctcagacgtgtgactttatcccaaaaatatgctattttaaaagacatttcttaaaatatgtatgtgtatgtttgttgatacttgcttattatatagctcatactgtttattaaaatatatctattacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaagtacgtatttgttttccatgatttgaatttatcattatctctttatgtaaagtaaaatgaaatacttgaacagtgttatgttactgttttcttaagtggaattgttctgtttttgtactatatgatcacccttcttcatgtaagactcatgaaatcactccagctattgtcttctgaacctaggaaataattgggaatgtgttcagagttggagtttcatttggcatcaagttaaatattaaaaatgatgtggtggtactaaaaaatggcatcttgcctttggcgaagtatctgtatattcttaaagtattcatggagatgttgaaaaggtattttgatgtgaacattcttttcatgcaacattattccatacattctgtgactgaattttttaaaaaaattcttcatgttatgaataaatgctgtatacaaatgcatgcatgtatgcacacacacacacacacacacacacacacacacacacgcatcatccaaaagcaagttgaagttaatatgataagatgaggtctcagagtaaaatataagacttgaaaacagaaagcataattcagtaggcaattttggggggagaggagaaatatgaatcctgtgggtttggagggagatggtgtttatgacatgttctgaatgtaaaggatataattataatatatttgagtttttaaaaatggaagatactatagataacattttatacgacagtcactaataatcacaaatatcctacagaggagttgtctcttatgttcctcttacaaatgatgtctaaaaactgtcataaattagatcctttggtacgtcatacaggctcttctcaaatcagcgcgaaatgcctttctcaactttatctcttgtctcttaatagcatttgcagtacacctcaggcctagacactgtggaatactgcctcctcctaaaatataataacactttgtacgtccttacttcaactaaaatttttccttattcacggccctttgttaaaatccctgctacaagtttctctgaagttcctgttgcagaattagaacagttttgcaattaattcctgttgcagaattactcactcttttttccctcttgcacagcacttttgcatgcttgttcgtgttatactaattttccctcttgcacagcacttttgcatgcttgttcatgttatactaatttctgcaggtacatagatccccttgcacagcacttttgcgtgcttgttcatgttatactaatttctgcaggtacatagatccccttccacttatgagatcctctaggaagacgcttaattgttttgcgaacttaggtgttcagcccagtgagggcccagcatttgataaatgattcttagtgagtaaattagttgaatttaaatactctgtcaaaccatcattattaaaagattattattaaatacatgcaaatcatagtcatagttaaataaaaatcattttaaaatgttgatgccagagataagataatgttacctggtgcattcatgtggcgtttgctctatgaagaaagtatatatcataggtaagtccatattttattgagccataaaatataattaaattttaaaccattttgcagattaggatgaacttttgtatcaatgttatcacttagttcaacaatgtgcatatacatgaggtaaatgttattatttcatagattggtacaattgaagttgaagataaagataataagcgataattcagactcaacagaatatactctttattataatttaggataccaacttgcctatcttgttttcaaatagattctaccaccactattttaaagatgtacattcatattgtagccttaatagacagaaaactcaggttgtaaatcataggattcagtaaatgctagtttgtagtaaatatagcatctcccactctctctttttctccatttcttcctaaaataattattaaaattacaggtttattaagattgactttgcagatgtacagaaaattttaattgtgatggatataaggaatattattcatatagatgaatatagatatataataaagagatatttgttcctaattttattatgttgatcaataatagtgtcattgttgaagcatcagtgtacagtgaaaataatcactttacctgacaaaacagaataagtgtatactctctgagttaactcattgtgtctaatgaattctatgtttcttcagtcagtaacattctggcagaatgactgacagatgtaaatcctgctgcatttcaaggtgttcttagagttttgaaaaggaggcactacacaatcagaagtttacacttggggtttcttaaaagatactttatttcgcactccatttgaacaaaacaattctgcttttgcaacagtttggtgtcaccatgacaaaagtagcttgtagtaaagtgctctttaatttatccataaattgcagcttattaaacagctatgtacctagtggggaagtattgtaaactgcttggagaaaagaaataatataaggacttgtattcacaaaataccatgacatgcgcaagtctatacacagctcaaattctataaagttcatatcctgtcatcaaatggatccagtagttgaattgtttctcttaatgtgaggtttttacagttgccctttctacttctttctctcatcacctgtctgagacagttatatttcttacaattgacacttgaataaacatccctaactacaaattttgcaaaaatattctctcaaagtgttttttcctccatgcttaatctaccatgcttgagaaagtgagtaggctagttatattgcatggtaattagttatccctttatcttgaagtaaataggctttgagtaagtgttagagaggtagtaaattagagctagtaatttgctttacaatgtctctactctagagagttacaaactcagtagcttaggatacaagtcagataaatgtcttggaggaaacaggctgcttgtcagtatcaggaatgtgaaaaaggagcatagagactggataatgcatgcccaactacaagggtagctactatttaattcaaattgatgcctacctctgggctacatggtgttggaaaaggagccactcaaacaaaacaaagcaaaacaaaaggactcatagtgaaagaaaacaaatcagcccatctatggcttgaaattctactcaaagtacacaaacgatgtgtacttctccttctagagaaaatcatccatctaaagatataaaattccctagtgtgtgttctttcattaaaggtaatctattttattctgccatttcctattctagtttttaaaaactttattctgggttatggttgttgcataacttattcttggataggttaaaaagtcactgacatttatttattctgcacaaaccatatgcatataaaattcaataccttacatgaaagtttacaaaacaaaccttctatatcctaaatggaaggaattatattgttgtattgaggattgctcttgtaagataagtcatctagtaacagaaagaagcataacacatgccaaataatcacaatgaatcaacctttagggcttgatcctccaatattacattgcaccaactgcagccacaagtgagcttcagtttttggaaatttgctatcattatgttagcttaatctaacataactttctccagaacttaaatgatagtaaattgccaagaacgtaaactcacttgtgactgcagttggtttagtgccatgtaatattggaggatcaagctctaaaaattcaatagatggcagtatttcccataaagttagtaaacatcacaattgtttaactggtttgggtaatttctaaagttaatgagaaagaaaatattgctgaagatattggcattgattttttttggggggggagctgttgtttttattattttcattgttatgggtacaaatatgaatttatataatattttcatcattaaaattttgtttgaaacaaattaaaagaaaaagaaaacaaagcttctcccttgacccatcaaaatatgcaggattttttttaattatcaaagaattgaggtctttctagtgtcttttgaaaatgatatctgggtcattttattatagttgtaggcatatattttgaaacgttttgagcatttctttaaaatgacagtatatatttgattttgataactgttcctactcactttgaaataagataaattctgcagctgcatgtttagtattctacatatgtaaatttcattcaagtttattccttgtaccattccaattttctatatccttatagaatttttgctcgtctgttattgagagagatgttaaagtcttccaagatgatactagatgtttccatttctcttttttcctctgtttaatttttcttagatgcagttttaaaccatgctattggatgcacacagatcgaaggctttgatatctttctcttgattaaaattgttttattgtgaaatatatgtctatagttctaataatactccataccttaaagtctaatttgtctcctatagctattccagaggtttcttttttttcttcatttctttttggttatggtttgtgtggtataatgttttctataattgtactttcaaactttattgttcttaattttttattcttaatttataaatgtttcttgtgaccacttagctaatatttttgttgttgtttagtttaaaatgacattataatttctcttgcttttgttgatttactacacttataagtatcttaattactgatatagtttcatttaggtatatcatttgctatttggctaatcttttcttctccttttttcccctctctcatattctttgaattatttaatttcattcattttgtcctccattcactttttaaaaattttacatttttatacttttttctatttaaaaaatactgtagatattattatttatttcactctaccttaaattataatttcattgcttgaaaatagaatgactttaaaactgtttaatgtcattaaccctttgttgttgttttttctatttttgtcatcttatatattcagtcctatatgaaattgtcattgttgctgttgtgttaaatagcaaatcattattttttaagacagtaataatttacccttcctggtactatttatttctccttgaatttctgtgtttccttctagaattattgttttctaaagggaattgtaaatttcttaaaatattattttcccatttttagtgacagaaaactgccaatgaattttctcagcttttctatataaatttacaattttgcctttatttgcagaaggtatttccaatcagaatagaattttagtttgaaggattttctccatttcaataattattaatataatttgctgtttaccattttgttcattgaaaaatcaactgtagaattcctttactgtacaatagtttactgtagtttattggacctttcttctattaagatattctttgttatattttgttttcaaaaatttaacctacaatgcacctaggtatttactttttaaaaatctgactaatggttgtaaagattttttaagctatcttttattagttttgagaaactcttggttagaattttttcaagtatttcttcgacctcattttctcacttcttttctattagttctacaaagtatgtcagctaggtctttcagttatataacattcatctattactgtctttgctgtataataattattattctacagtcttctacagtcttctttaacctggatattttatattaacctatattctagtacaccaatcctttcttctgctgtttgttcagcaattaaacccatctattaaatatattaagtacacacttcagcattgacatttttgttctaaaatttttatttggtttagtagataaagattattggtatctgttgaaattccccacccttttctttatttaaacatattaaccataaacatattaaccatacttatttcaaaactttttgtagaattctaatatcataatcatgcctgggtcattttttacattttttccttcttagttttagccaatgctcatttttaatcatgactttgaattactgattgaacattacataaaggagttgcagaggttcatgattgtgcaatctttcaaagaggggcaagttatttcttgcagacatatacagtgtggattacttaaatcagttggattctgttagcactagcttattttattgctctccttacttccgggaagtagctcttattcctggaatccggatctttctttacttactctccactggtctcaagtgtttaccaatttctgactctccagtaactcatggctgctgaaatctctgcctagcgcctttgccttccagatgcactttctgttggtttctcagagcctctacaagtgtcaaagtagtggatgtgtctacaattaccacaagaaaaattgcatttgtttttttcctcacttacctgaggtttcttcttctctgtgcttttgtcctcaatttctcagcccctgtgccagctctgaactccaacctgtctccaaaagctacacaatttttgcttggactctttcaaccagcactacatatttttaaataccctcagtatatgtgcatataaaatttgttttgttatggtttctttctctcaagaatcatactccatcctgagttccctacattaattgccttcaatgccttaaaacagtcattttctatatactatgcatcttttagagttgttttatatgacagagttagatatacccctccatcatatccagatttgaaagatcattccacttaagtttaaatagaaagattatggaagataattagatgtattctctatcaatttgtattctatgtggctaaattgaaaggatgaactctaaaataaagatgaaattattaaattaactttaaatgagtaatattattattttattttcatttagccttcatagaaacacaatatttttatcttacatcatgatatttagtttataaagataattgaaaattattatgtatttattataataagacacatacacctgtagatcatattctttctaacaaagtaacagctataaataaataatagtattacattcttctgattttagaattgaatattttgaaattatatggagctctctgtttagaaacgtactagtcatgacatttcaattgtattacggtttgtttttaatctatgtggttgtgtactataataaagttacagaataattccttttcctttacataatattttgtttaggtaggtatgtttatggtaataagcatatatttcttggaaataatttgattcttatagttaggcattacaaatcaatttgcacaccttcaaagaatacttaaaaagtggactgaatttcaattaaaatttctaatagtctttcttcaagcatttatgtgttatttatgattaagagtgagagaaaacaaagaaagtgttccactataatacttgagagaaaaaaaaaactttctatagaataatcagctttcctatagtgcatgttgacacatagaaacagaatgtattgggttaaacgattttaaagatatttcttagaacagtaaagattctgatagaggaaaattgccctttttatttatggcattcaaatggcagtagtacttaaatttactttatttatgttttaaaaaacattgcacgtagagccaaccacaatgcttaataatcaatattcagcttaagtctcttaaatgcaggaaaatctcagaatactttgtgtgtgtgtgtgtgtgtgtgtgtgtgtgtgtgtgtgtgtgtgtgttttaatttgaaattagcattctcagcataaactgtatttgcataaacatttaaagtggagattataaaaactgtctggttaattttatcaggaaagacaggcaaactctgtaagtcagacatcatagtttctaacctctcacatgtcagtcagttttccctgagaagcatctcactttctcaagtaaatactataaaatagtaaatagttctaacaaatgtaatgattaaatttattacagcttttgtaagatagggccttggggtaatcatagggaatgacttattcaagtaaatgacaaaattactgtagtaaagacacaaggtcttttaaaaagcaactagaatcagtgctgtcctggaggaaaagaaagtatattaaaagggacaagcctcagtgagacaaatgcccttttattattcccaccatgtcttccttccttaagtgtattttccataatcagtagtatattatgatgcagtctaagaaattatgtgaaaagatcacatgtggcatacaaaactatggtgcatccagatacaaagctgttacacagtgagatctgtattcctaagctgtgaaaaattatgtagtcttaaaaccagaataaattattctagtactacttgaagaaattaaaaagtaaaaaaaattctaatgagttagaacataatttatatatattttatttatgtatttataatttatatatttatatatattttattgatactataaacaatttggtgcctaaaattgaaaaatgcacattgccctacctcatatctcagaaaatctaagcctcacacactgaaaatccaagcaaaactagcattttgaagataattatatattttggtagtaatatcactttttgtgattttggtcagattttcatcataaattcccagcatttgttgtgtctcttcttcatttttctattctgaaaaacagctcaattactagttgttctcattttgattttattttttgtagttaaaaaatatatacaataatatttatccttttaacaactctaatgtgtgcatttaaataacactacgtatattcatattgttgtgcaaccaatggtactattgaaatacagaagtcttttcgtcttgcaaaagtaaaactttgtacccattgtttaatgggtactttcccattttccctctcctgagtctctggttattcaactttctatctctatgaattttactgttctaggtactttatataagtggaatcatgcaatatttgtctttctgtgcctggctaactttggtaaacataatgtttcaaggttcatccaggctgtaagatgtatcaaattttaacttattttgtaatgataattaatattttatttaatgtgtatactgcattttatcagttcctctgttgctgcatgtttggagtgattctaccttttggctatcatgagtaaggtggctgtgaatatgggtgtaacaccccactttcagtgcttttaagtatatatccagaagcggaattgctagatcatatggtaattttatgtttatttatttatttttttttttgagatggagtttcgctcttcttcaccaggctggagtgcaatggtgcgatcttggctcactgcaccctccgcctcctggattcaagggattcttctgcctcagcctcctgattagctgggattacaggtgccctccaccatgcccagctaattttttgtacttttagtagagatagggttttatcatgttggccaggctgatcttgaactcctgactgcaggtgatccacctgccttggccacccaaaatgctaggattacaggcatgagccaccacgccctgccatgtttaatttttttagaggcctccatactgttctccacaatggctataccatttcactgctccactaacagggcacaagagttctaatttctccacatcctcaccaacactagtcattgtcttctttttttttaattttaattttttatcttttttggagagatgtctattccagttctttgcctatttaaaagattggattgtgtgtgtgtgtgtgtgttttgcagtgttaacttataatagtttgcatttatttatgtctttaatttatttccacaatattttgtcattgtcagtgcacacattttttgttagatttattcctaaatattttatcatttttatggtattaagaacggaattgctttattttcttttgcaattattcattatcttgtaactttgctgaattactttattagttctaaaagtttgtgtgtgtttgtatgtgggggtgtgtctgtatttgtgtactccctatggctttctatgtataagatcatgtcatctgtgaacagagataattgtattacttccttcccaatttggatgcttttaatttctttttcttgccttattactctggctaggatttccagtattatgttgaataaaagttcaaaagtaggcatcctcttttgttcctggtcttacagtaaatgcatttagtctttcaccattttagtgatattagttgtggggttttaacatatggcttctattatgttgaggaagtttcttttatttatagttctattttatgtttttttaaatcataaaatggaattgaattttgtcaattgctttttctgtagaattgacatgaccttgtgatttttttctttattctgttaatggaaatgaaaattaattgattttcatatgttgaactaagcttgtattccaggaaaaaaaatcccaattgctcatggtgtacattcctttgatattatgctgaaatcagtttactagtattttgttaataatttttgtattaatattcataaggaatattggtttttaattttctattattttagtgtctgtctatttttggtttcaggagaatgctggtcttataaaataaattaggtaatttccctctttttttactttttgcaagattttgagaatttgtgttaattctcctttaaatggttagtagaattaaaccagtacagccatctgttgcagggcttttctttcttgggaagtttttgatggcttattgactctccttatcagtagtatgtctattcagaattttcatttcttcctaattttgtcatggtaagtcatatttaaaagaatatattcattatttatacattctccagttagttggtatttgtttgcaggacttccttgtaaaatccttttatttctgtaaaatcagggtagtgtttctactttatttctgattgtaattatttgagagtcctctttctctttcttagccaatcaattttgttgatctttttctagagagaacagatcttggaactggcttgtaacctcctgcagaccaagatctccttgccctgggaagggaatggggcaagagcaagttgaaacaccacagatgcttaatgcttgaatttattttttccttagttgaggattttcttgctttctgtacacgtttgaatatttccaagagcttttataagtttatttcacctagttttaagtcacttgttccctcatggaaacatcgaaaagcaacttaaaactagctgagctaaacttataaaaactctgggaaatattcaaatgtgtacaggcttggagctttgtaatctgccatttttctaatgtaagtcccatctttgtttttttaggcatttaaatcataagtgctaccaatacatttaatttttccagataagaaaaggattccaccttaaaaataatgtaaggcattaaaatactacatatcctatagtacatattagtgtggtagatatttcattcaaggaaaaaatttctccccatgtactttctatttttttcatgaaagtatctaataattgccaagaatggacagaccttcatgaaaactatatttctttttttcaagaaaaaggacagaaaaataaattcaagtgtataaattattgatattttactgttaaaataattaggtatctagtatgaaaaaataatttaatttagaggagtgaggagagacaacccttagtgaccctaagcatcgactttagtgttatagagaacagctggctcagtagatataagttaatttaagacattaaaagctggtaccagctgaaaaactctagaggcttatttatttttatttttatttttaattattatacttttaagttctagggtagatgtgcacaacgtgcaggtttgttacatatgtatacatgtgcatgttggtttgctgcacccattaactcgtcatttacattaggtatatctcctagtgctatccctcccccctcccccacccacgacaggccccggtgtgtgatgtttcccttcctgtgtccaagtgttctcatagtttaattcccacctatgagtgagaacatgcactgtttggttttctgtccttgcaatagtttgctgagaatgatggtttccagcttcatccatagcaaagtgacctttacagttaaagagctcccctgttgcatggctaaataggtgctccagtgctcactgtctctcccaccctgaaaacatggagaacattatgggaattggatttctttctattgaggttctgttttggttttgtttttgtttttgtcttgtttttattgagacacagtctcgctctgtcgcccaggctggagtgcagtggtgcgatctcggctcactgcaagctctgcctcccgggttcacgccattctcctgcctcagctacaggcatcttccaccaccatgcccggctaattttttgtatttttagtagagatggggtttcaccgtgttagccaggatggtctcgatctcttgatctcgtgatctgcccgcctcggcctcccaaagtgctgggattataggcgtgagccaccacgcctggccggctctgtgtttttttagtcactctttactgctacacaaatcagatgaaatatcgtcacagagctgatgactattaataactgggggtgttcttttctcacttatgtatatgatgaccaaaatatatactgtaagtgtactgggccagcataataaatatgaatatttttatattcataaaagcagagctacgtgtaaagcagcataacatctgttttacttagtaaatacttgaaaaataaattcttgcattttgaaaatacatgttaaatgacttgaatttttataaaaagacacataatccattatataacagatattgtttacatcaatttcttcattatatcaactagattcatgatccatgtcttttagattatataatcttaggacatctatgaatatgttgcgtctattatataacactgtgtgtacatatatttgtgtatgtaaatatatatacacacacatatatggaaattatatttgaaagtttaaagttattatcttttatggtagaatactaaatatgatatcactacaatcacaaagcaataaacattatcaattgagtcatatgatttttaaaaaaattattttagtgataaaacaacaaattgccttttttctattttgtctattccaatttttcattaatagtcacatattagtgcatagttataaataaccctttgttataaatacaaatttgacattttatttgcaaattttagtaattctgtgaagttggacaaccagattctaaaagttatattaccattactgtttctatgtggcttaaatagctggaatttactaaagataacacatctcttcattgtgggatgtcctttgctacagccaacttgagtaatttttaatactaaacataattatttaacagttgtaagtttcatggacataaacaattttagggaagtgaggagataatttaattttgttatcaaattgatattttaaaaatacaattatcatttagttttttcatttcttattttttatttgttttgttttcaatatagtttgtatcagcaaatggggagtgttacatgaagtttaaccttcatatttggttcattcagtttcctatgtccttcttttgttgtaaactttaaacaatttattcttttttcattgttctacattttaaattttccaaatagtttcaatttccttttttaaaaaaagatgcaagattgtaaatgcccagcgtaaagttggagatgaccatcctttgaatattttaacagaaactcaggatatagtagaagtgactattcatttgggagccataagtttatatgttgatgttgaaaccacagggacaaatgtacctttctagagtgtgtatataaggaatagaaatgaggtactaagttacggacaatactctcttttaagaaaaaagtgaaagataagtctgtaatgaaactgagatattagcaaagtagtgatacaaccagggaaggtctgtgttctaaaactctagagagggccttttttatagctgtagcctaagtaaattttcctgcatgtgaataaggagatatgtaaagtaaaattcatttgactatttctaaattagaaaaatataaggttagataacttgtagcatattattaaaataaacactacattctaattaacaaactagaactatatgcgacatcttagttacatctcaaattatgattttgaataaaaaatacaaaaaaagatgaatataaacataaaatctaaataaccatactatttgaatatgtatttgtggaaacacattacattaatatttttaagttatataaggggatgatcatggttctgggaagatgagctgagaatttgattatagcaaatggctcacttagaagcatcacctatgccttcaatagtatgttactttatcaaatgagaactgaagcaaatacaccaaaacattaagatttgacagcatacgtgtgtgtttcatgacattttttatttgtttttttttctgttagaaatatatcaaagtataaaatcataggaggagaaataatcagcaataagggtgcaatagaatcatgttttgtttgtttgtttattttggttttcagttttcctcaacataactcacagtgccccaggatgacaagaacaataaaagaatgcatttgaattagcaaatcactggcaactactgcaaaagtgtgtatagcttatctatgcctgtgttgcaaagcattccaattggcatattaaaacaactaatatttattatttcacaatttctgtaggtcaggaatctagctatggtttagatgagtgcctttggttcatgcttatgagattccagtgtagaagtcagcaggggctgaggtcttgcccaaaggcttacctcagtggaggtggagctggtttctgcttccagcttactcacatggcttttggcaggcatcactcacttgctctatgggctgcaacgaaacataacagatagcttgccccagagagtgatacaagagggagtgagaaagtgttcccatgatagaagccacagtctttttgtaacctagtcttgtaagagatgtccgattacttttgctgaactccatcataagtgagccactatatctagccaacattcaagaggaaatgattactcaaggacatgatcagcaggatgcatgggtaaaatgtggccgccttgaaggctgtctactaaaagttgactcttaatttacaaattataattctcaactcaatggagagtgtacaaaatattaatcttaatgcactcctttgtttaatgggacatagtgaatggggaagttactattcttgcaattcttaaaatgtgtcaagaattatcaggttttttttctataaacataatctgcctgtaccaggaatctgtttcatattttaagacccagcctaaatgttttctgggccgtgagtcttttgtgacccatttgaacagttttttgcaatccgctttgtgaaaacaaccttctttataacgctatcatcatagtaattctataatgtatttatttatctctgttaactaagacatctttggttttctagtgttaccatcctagtattaactacttgacaggtttttgaaggcttatgtaatagtggttaattctggtttagttggaccttggagaccacagcatccaaaaaaattgactccttctagtctctgtctcaaaatattttagagaatttgtaccaatttattttgtaatatgtctatacattttgttgagcaaaacagtgtcccattatagatgtgacttttcaggaacatcatgatattttcaaggccagtgcaaatcacatggcttctctttgatgctgattttatgccctcaaatttggcctttcaacatcaattttggaaacacgaccattgacaaaagcctcttcttagtatttcatagctgtgccaccaaagagagatgaaagttattttctagttccagttcaacatttttgagaaatatactctttttggagatgtttgaaaaactgcctacccttcaccaatcaactgtgagaacgaaggagggatcctataacatttgggtctcatgcttttcccatgccaattcacagaatcaaggaagatagatcttttagtaatggtagatcttgataaaaccatatggttaaggtcaagggattgtttgtttaaaagaagagggtgttttacacaggaaaagatatgttggttgaacatacaatttattcggacatttagtttagttagactaaaagctaatgtctttcttactttgctgtgagtttattccaggtgtattctccaatgcttatgaaagagagctgagaaaaatatttgttgaacattgactaaacacaaacacatacatgaacacgtgtgtcaacccttagtatctatacatgcacatttaaaattatacatttttgtctttagaagtttatcaaatgatttttttatttttgagatggagtctcgctctgtcgcccaggctgagtgcagtggcacaacgtcggctcactgcaacctctgcctcccaggttcaagcgattctcctgcctcagtctcccaagtagctgggattacaggcgtgtgccaccacacccagctaatttttgtatttttggtagggatgggatttcaccatgttggtcaggctagtctcgaacaggtctcgagccaccgtaccaggttcaaataaatattttaaaccatgaacactgaatgtctttccatttatttgtctttttacatttttcatccatgttttctagtttacggtgtataagtccttcacttccttttgtctttttacatttttcatccatgttttataattttcagtgcatgagactttcacttccttagtttatttatacagattttattcatttcaatgctattataaatgggattatttttctaactttttcaaataatttttattagtgtgtatagatgcaactaatttttttgttgattttatgtctgcaactttaccgaatttgtttattagttataacaatttttgttttttgtggagcctgtttttttatatatgtaatattatgttatctacaaacaaggacagttttacttatttcattctgatttagttcccttttattttttttaaatgcctaattgctctggctatgtcttccagtactattttgaaaagaagtggtaagagtgggcatccttgctttgttcctgatcttattggaaaagcattaagcttttatgtatataatgttatcagttgcactctcataaaatgtctatactacattttaactctacaagtacagtaaaatccctatcaaaatccaaatgacatttttttacagggagagcaaagaacaattctaaaatatatgtggaaagacaaaggccctgaagaagcaaaacaatgttgaaaaagaagaacaaagctggaggcaacacacttgctgatttcaaaatattttaaaatgctgcagtaattaaaatagtatggtaatggcatacagacagatatgtaggccagtggaacagagtagagcctctaaataaatccagacacaggtagtaaaatcatcttcaacaaggttgctaagaatacacaatgagaaaaggatagtctctttaaaaacaggccgggcgaagtggctcatgcctgtaatcccagcactttggaaggcagagacaggtggatcacgaggtcaggagttcaagaccagtctggccaacatagtgaaaccctgtctctactaaaaatacaaaaaattagctgtgtgtggtggtgcgggcctgtaatcacagctactcaggaggttgaggcagaagaatcctgtgaagccaggaggcagagcttgcagtgagccaagatgcaccattccactccagccagagtgagattccgtgtcaaaaaacaaaacaaaacaaaacaaacaaacaaaaaaatgcattgaaaactcattatctatatacagaagaatgaaaatggcttctttttgtatatcatacacaaacactaattcaaactggattaacaagttaaacataaaatctgaaactgcacaactcttaaaagaaaaaaataggggtaaagctttatgacgttagtcttgataatgattaatctgatatgacctgcaaatcccaggcaataataacaaaaacagacaaatgggactatatcaagttgtaaatttttaacacaacaaaggaaacaatctacagagtgaaaagcagcctgtgaagtggaatgaaatatttgcaagccctgtctgctaaaaggcttatttccaaaataaaactcctacaactcaataataaaaggaaagaagaagaagaagaagaagaagaagaagaagaagaagaagaagaagaagaaggaggaggaggaagaggaagagaaggaggaggaagaaggaggtagaaggggagggggagtgggtgaaggaggagaaggaggaggaagaacgggagggggagtgggtgaagtagaaggggagggggagacagaagtgggaaagaaagggaggaggagagggagaaggagaagaaggaaggaaaaaaatgatcaataacctgattaaaaaatgggcctaggacctgaatagctgtttctctaaagaacacatacaaatggacaataggtacgtataaagatgctcaatgtcaccagtcatcatggaaatgcaaatcaaaactacagtatgataacacctcatacctctcaggatggctatttatgaaaaaagccaatgacagaaaagtattgttgaggatgtgaagacatttgaacccttgcaaactgttggtagaaatgtgaacttgtgtagcgtctacagaatatagtataaagattcctcaaaaattaaaagtaaaattactatatgacctaatgaccacacttctgagtatttatttaaaaaatcgaaatcaggattacaaataaatattagcattcctatgtttattgcagcattattcacaatagctaagacatggaaacaatctaaatgtccatagacagagaatgtagagaaaaatgtggtttatcaaacaatggaatagtatttagccttaaaaaaagagatcttgcaatacgcaacaacatggatgactactgaggacagtagactgaattaaatcaaccagtcactgaagggcaaatatagtactgcatatttcaagcagatgaggtatctaaaatagtaaaattcatacaatcaaagaatggagtggttgttaccagggactagggaaggtgagtgaggagttgctaatcaacaaatataaaattgtcattatgcaaaatgaataagtcctagagatctgctgaaaaatactgtgtctatgaatagcaaggctgtgttgtgtagaaatttgtttatcggatggatctcatattaagtgttcttatcacaataataaaaaatgatattttcaacattcactagattagacttttgttttcagtatcatatcactaatgacaaatgattgtctcactgaaattatttttctagagattgtgcattcacttatctatatagtctatgtccttgtatagcattgaatcactattaatttaatcttggtagaaattattttatcaaattacattttaattcaagattcctgggcttctgttatttataatgttttgaattttctataataaattgctctaataagcttttttaacttgtcaataaaataattattaaaaacatgttcattatgcttcttaatataagcactatagaaacggttccattcgacatttaatatcaggacaaactttggaaaaatgatctttgtacctattagacaatgagagtataaaattaacagtgctttaaaattgttagctatctatctaatctatctatctgtctatctatccatctgtctaatgagctacttgtgtacatatacttttctatttggattgtgtgaaatctcattaattcttcttctagtaattacaattgtatattgatttaaaattgaatattaacttgtctgttgaatactatcataggggagttctaagaataaattggttttaacacttagagaacaataatcaccacttgtgtatataaaatatcactgtcttcacccaaaatattaggtgtcaaaattaatgctaattcacaaatgctgtttaattttctatagctatttactttctcatgcttcaactctgtaatcgatttttaaaaattttaataactttgttatttaaaactttattatgaagccacctcaaatcctttttagaagctgatagggaatttatgctaaagaaatatgtaactacattcacgttctcggacatgactgtatatctcactattcttgataaaaataattatctatattcacaaacaggctatggcattttatcttgtttttctgttgaattccatatttccatactttttgtttccacatttttatatttgaacttcacatttacgatgggtggaagaataaattgggattacactaatacttgactaattcagttttggttcaaaatcagaatgaaaactttacctctcttctaattgtctgtagcttaagggtttagagctaataaaatatttcatattcaaatatagaaattattttcatgcaaagtattttacgtaccttttaaagtttatataaatctagtatttaattacaaaatagtctacttttaaaatctaaaaaagtccatttgatgcattacctaatatagtcttcatttgaatatgtgctctaaatatttattttttcttgtaagattatttcatgaacattgtatttaaatatgtttaatatgaaatgtcttccagaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaaggtaaaaagaacatactttttgtgattcaggcaactcactcatcttttcctgaatggaaatttggcagaggcatgaataatccacgctgtcaggccattaaaatgataaaatattgtcactttgcgatataattacattttaattgttgtttgtcaactgtttagatcttttcttcagaaaatatgttttgctgcggtgggaagatctgatgtagactacactaacaatgtttctctccatctttgttcattttgtctctgctctaatcttcctgaaatgtcccaatgttaatagtcaagaattaaataaaagtaatttcagtgaagtgcaaagaatcaaagcatcatcctaataaagctgtggtgattctgttatagccagagaggatgacgaagggggctgagatatttgccattttaaaatgtactccaggtgattctacagtagaactatttagataacaggctgagatattttattctaatgtgcctactgtagatgttgatgtgagcctgttgtctatctatctatctatctgtctgtctgtctatctatctatctatctatctatccatctgtctagctacttgtatacatatacttttctatttggattgtatgaaatctcattaattcttcttctagtaattataattttatattgatttaaaattgaaaattaacttgtctgttgaatactaccatggggaagttctaagaataacttggttttaaacacttagagaacaataatcaccactggtacatataaaatatcaatgtcttcacctaaagtattttctcattgtaaattttttttctcaaattgtcaaacctaggtcaaggggataatgaaaagagacaatttgcatatttatttaacaaatgtatttattttgagttccttcaatgtgtcagttgctatgttccacatgagctatgcaaagaataagaaggataagtctggagcaaaggcagactcagcccctacatgcacacagcttctaatctatggacgtggacagacattaatcaaatatcacataaattcctagatcaataatatgtttactatgaagaagagttatatagtgctacaggggaaaaatctagaatatttaatcctttctggtattcagcaatagttaaagagagaattgaaagaagcctaggagtaaattagatatagactgtaaggatgactatttcaggaagacagaaaatgtaccaagtgcctgaggtgagtgaaacatggcacatttaagggatcaaaataatgtggctgaatccagagtagagggaatgaggaatgcagtcagtgggcacaagagcacacaaggccttgctgaattttgccaaatggaaagccattgaagagatgtaagaaaaaagtgactaggtctaatttgatgtcaagatttctgattgctgaattaagcaacatgatgccaaggctgtgtgttaacttatcactgcattcccaacatctagcatttttttctgacacagagttggcattcaataaatattagagtaattaatggatgaggatgtggatacaaaggtgagaagaggattgcctgcttttcattttatgggtgacttctttactcaaaataattcaggtaaactggattaattttttctaaaagattaatctgacaactgattgtttaagaaacaagcatgaaaacggaggaaatataatcttggaggaaatcttcaaataataggagagaatgttggcattgaatattcccaagggacgctgttcaggaggtagctagtcatcaaaaagtgaactgttctagaaatttaaaacaattttggattataaacattgattggattcggctaaaggaagtacaggattgactgggtgattatcattagcaggttgtatttgatcaactttagagtaagtgtcatgtggcaacgaggagaatgtatattctgttgttttggggtggagagttctatagataactatcagaatctactaaatagatatcttctagagccagagctgagttcaggtcctaaatatctttattacttttctgtcttgatgatctgtctcataatgtcagtgaggttttaaagtctcccactattattgtgtgggagtctaagtctctttgaaggtttctaagagcttgctgtatgaatctgggtactcctgtattgagtccatatacatttagtgtagttacttcttgttgaattgaaccctttaccattatgtaatgctctttttttgtctttttcgatcttttttggcttaaagtctgttctgtcagaaactaggattgcaacccctgctttttcctgttttccatttgcttggtaaatttttcttcatccctttatgagcccataagtgtctttgcacgtgagatgggtcttttgaaaacagcataccaatggctcttggctctttctccagcttgccactctgtgtctttttattggggggtttagcctatttacatttaatgttagtattgttatgagtggatttgatccagtcattatgatgctagctggttattttgcacagttgtttatatggttgcttcatagagtcactggtctgtgtatttcagtgtgttttttaggccgataacaagtttttctttccatatttaatacttccttcagaagctcttgtaaggcagatatggtggtaatgaattccctcagcatttatttgtctggaaaggattttatttctccttcgcttataaagcttctggccagggcaatcaggcaagagaaaaaaaataaagggtattcagataggaagagaggaaatcaaattttctttgcagatgacataaccctatatctcggaaacttcctcatctgagcccaaaagctacttaagctgataagcaacttcagcaaagtctcaggatacaacatcaatatgcaaaaatcaccagcattcctatacaccaacaataggcaagcctaaaacaaatcatgaatgaactctcattcacaatcaccacaaaaagagtaaaatacctagcgatatggttaacaagggaagcaaaggacctattcaagaagaactacaaaccactgctcaaagaaatcagagatgacagaaacaaacgaaaaaaattccatgctcatggataggaagaatcaatatcgtgaaattggccatactgcccaaagcaatcaatagattcagtgctatttccatgaaactatcattaacattcttcagagaattagaaaaaaatgatttaaaatttatatgaaaccaaaaaacctgaagagccaaggcaatcctaagcaaaaagaaatctggaggcattatgctatctgacttcaaactatactacagtgctacagtaaccaaaacaacatggtactggtacaaaaaaaaaagacacacagaccaatggaaaacaatacaaaacccacacataagactgcatacttaccactatctgatctttgacaaacctgacaaaaacaagcaatggagaaaggattccctatttaataaattgtgctgggacaactggctaaccatatgcagaaaattgaaactgacacccttccttatactacatacaaaaatcaattcaacatgcattaaagacttaaatgtaaaacccaaaactataaaaatcctagaagaaaaacctacgtattacctttcaggacataggcacaggcaaagatatcatgacgaagagccctaaagcaattgcaacaaaagctaaaactgacaaagaagttctgttaggttgatgcaaaagtaattgcaggttttggcatttattttagttgcaaaatcacaattacttttgtaccaatctaataattaaactaaatagcttcttcacagtaaaagaaactatcaacaggttaaacagacaacatacagaatgggagaagatttttgtaatctatgcatctgacaaagctctaatatccagcatctataagtatcttaaatgtatttgcaagaaaaaaaaaacctcattaaaaagtgggcaaaggacatgaacagacagacacttcccaaaagaagacatttatgcagtcaacaaacatatgaaaaaaagctcaacatcactgatcattagagaaatgcaaatctaaaccacaatgtgataccatctcacaccagtcagaatggcttttattaaaaagtcaaatacaacagatgctaacgaggttgtggagaaaaaggaacacttttacactgctggtagaagtgtaaattagttcaaccgttctggaagacagtgtggcaattcctcaaagacctagaggcagaactaccatttgatccagcaatcccattactgggtatatacccaaaggaatatcattcattctgttataaagacacatgcatgtctatgtttattgcaggactattcacaatagtaaagacatggaatcaacctaaatgttcatcaatgatagactaggtaaagataatgtggtgcatatacaccacgcaatactatgcagcaataaaaaggaactacattcgtgtcctttgtagggacatagacagagttgaaggccattatttaggcaaactaatgcgggaacagaaaaccaaatacgacgtgctctgacttataagtgggagctaaatgatgagaatacatggacacatagggttaacaacacacacgggcctataggagtagggggtgggagaagggagagggtcaggaagtatagctaagggatgctgggcttaatacctaggtgatgggttaatctgtgcggcagaccaccatggcacatgtttacctatgtaacaaacctgcatatcctgcacatgtgccactgaacttaaaataaaagttgaaaataaaaaaataaaataaaatgcctttaagaagaaaaaaatagtagcagcaactaatatttgttagagtatttcctctgtatcaagacagattttaagcacattgcaatgtctttattgaattaatatacccataattgtccttttaattcttactgtgacattttgggaaagagagtgttattatccccgctttatagctaaagaaactgaatcacaacgcgataaaaatagtgcccaagcagaaagttgacagaaaactgaattggggtgtctgtcatcagagtctgaacacttactcatgttatatattcagatggaagatatgtgattattctttgctacaatggagagagaaactaattgtgatgaggtggagagagaatgggaagcaaaaatatgggaggaaaaaaatagaaaaacactgtcttcttggagaaggttagtacctacgtggtggagaaagattataaagcaaataaaccaagaacacaatgaaataaatgttttaattttaagttgggagacaagagtgtttctatgcacagggacaaaaagctcaatacagacaagacatcaaggatactgatgtagtctagggatactgaagagaggataagtaatttaaaaagattcattatgggtggagatgaacctcaaaagaatcctgaatcacaagtgcaaggaaacaacctaagatagtatgcctccatctctgaggttaccataggacagaagatagaagcaaatgactgcgggtaagtttgcaatgatgtagtgaggatgtgtatgggtgcagtggtggcgttcctgtgtattaagtcctattgtttttataaaatggaaaacaacttcatattgacaaaaagtgaaagtggcagtggatggtttgattacacacgtaatctgaagtatgactatcagttgtagaattaaggacggtgcacatatctcaccaccttacatggctacaattaattagaggtctgaaaaacaaaggtaaaattatatatgttaatgtgtgtgcacatatttaattaatttaatattaatggttcattctatttggtgcatatacacacaatgcatattttcaagatcagaatcgtttcaattctgtaaatggtaagtgatgatgtactaaaaatattcttgacatttaataagttcaaattgtctttcacttttttccttgaattttttttttttggagatagagtcttgctctgtcacccaggctggagtgcagtggtgcgatcttgactcactgccgcctcggtccctagtgcccaagtgatttttccacttcagtctccctggtagctgggaccacaggtgagcaccaccaagcctggctattttttcttttttctttttctttttctttttttctttttttttttttttttttgtatttttagtagaaacggggcctcaccatgttgccctggctggtctctaactcctgagcccaaacgatctgccagcttccgcctcccaaactgctgggattacaggtgtgagccactgcatctggcctcccttgaacatattttttaatgtagtctagatttcctctgaggtatgtacatgttgcattcacgtaattttttgatacttctgattaggattatcaatctcagagttatttaattgctgtatgctttagggcataaataattgcaatttcaaaaacctgtatacctgagtggattttaaccttcaagagatactcattgagatggcagaaaaaagataaaacagttcttaaaaacctattccttatttaatctctaaggcagttcactttagccagctgggcagaacagctaatctcctcacagatagaaatcagcactgctctataaatccgccagcaggactgtctgcaacgttcctgtctgtatcattccttcatcagaaaattgccaagttgaattcactggtgcatggtgtggtacattgtaaatacactttgataactttcattcattgtttaatgaagcctggctgggtggaaaggggaaaaaagataaggatgaatgcaattggatgtactctctttcctctgacataaacctcttgtagctagagatgtgcttctccttagcagcctttctcaaagtctcttcttatatggctcctatttgcacactttacagaagtggatccaaatattatgttttctttaggtttctgattctatttggccttctgattttcagcaaatactgttgtgttgtcattcccttctaactaattcaactgtaaatacaatgcaaattaacttaagccaaaaaattttaaacttgtccttcgagtcaacaaaggatgcttgaagatataaccttactgtaaaatgaaatataaatcttgatcttgtcatttaggagatctatgacattatctcaactctttgaagtgtcagttttcttgtttaagcactttacagggtgattatggaaaacatgaaacgaggtgaaaattgtgctctaagctatgtctgtctaataattactactacctcaataataactactatctaatactacctcaatacttctttttccttgccttcttttcttcctatttttgcaccagtttttaattatacctccagaccaatccatgtgatgattttgattttgctgccatctttatttcacgttatttgatttaactggaagcaaactaagaatgaaataccgtgtgtatattacaacacaatgtatatactgtcttcatgtttcttggcaatcaacttcctcttcctgcttcttcaagagaagactttttttaagtttacgttaaatatcgtatttgtagtacaacatgttcaggtacatttcagtcataaatatcttttggattatctttttggtttcacttatcaaaatatgcatttctataacttctgaatgtggaaaacctatcagttttattttcctcttaaagttgtagcttctgataggataagacttttcaaaaattaatttactgtgaatgtactgataattttcctgagtgtgtatctatgtgtactacaagtgtatccctgcctataggagacataaaacactttcataaccaagtactgtgtatttttaagatttccataccccaccatgggtaaaatattatcaaacccttttatttaacacatgatttgagatgggtcttaagagtaaacactgaaagttataaatttgttttttaaagtttaagtaaattataagataaaaacatgaaatatgttccgctacaaccatactagatttattctacatactatatttctggtcttttagtggattgtgtttattgaggattacattgtcattcctttgacttgcatttagtaacacaataaggatcgaatgttgtttactaacagattttaacatttttagactttgaaccacaaagagtaataaataagtcatcccaacccattgtgaataatcacacacaggcaaacacatgatcacaaactataaataagaaacagtagatttctaattctaatggactgcttacaaaatatgaacattccttaggaatttcattatcaaaaaaaactcaactaagtttctgttttatattcttataaggttctaaagtctgaaaagttattcttttcagccacagctgatagaggaattccaagtttcaattcagtaatatctattactatattttggatgactttgacacggaaacgctattgggtaaattatttttcatgctgttcatctataggcataatgatgagcctggagtaataaatcgtttgaaacttcattgaaagctaattgattgttttgacacatatattcctaaaatacagtttatgcagtatttggaaactaatgatctgacgaaacatcttgatgaattaagctatatatatgcatgggctgttggtaagtttgtgtatgtattgggtatttttaattattttatttatgtcatatatacacatacacgtgcacacatatgcacaaaacacatagatatacatatacacacatatgagcttgtgtataattatatataaataataataagcatactttctgtataatataatgtatacttaagctatttgaaatgaaagatctttgcacttatttgtccagtgttcaaatgacagaaagcaaacatgtaatatttatttgtatcagtgtccttagaattatacacaatgaataagaattactttcttctgtatagagaaatatatgatgagaaagcttatgcatatactccggtttccacagactgtccatcatccaggccagacctctgacaagggccacaaagcatattataatacaaaagcctagctggagaaacgctgcttaaattcatacaattttcctgtgttttgacaaaataccataatataagttaaatacttttccagaaaacaaaaaattaataatgatgtcagtcactattcctggtctaggccattttatttaatgattaagatgacaattttatgtatgaaaatgttgatatcgaccctatctacccaatcttggaactaaaatctggatgctggtgaagcataggaatcagacaaagaagaggtcatgaagagtctcttctcttattagttaggagaatagaattttagaacctctctaaactctaagaataattgactcatacggcaacttggctaaacagcattttcaatatccttgtatttataatggttatatagttccagagaagaatataatagggtgatttaaggaataatagaagtgattaatgagaaacaattaaaaagtcctgaatatgtaaatctggctgggaaacgattgatgggaaaatgataactaactatagtaatatgaaatggattaatattagaggagaaagtactactttacaagttagaaagagcaatgatatgtaaaagtaattaggagttataggatgaaattaagaaactaaaatttaaaatgaaaatcagtgtcaactcattgacagtaagctgttaaattaggatatagagcagtagctaaagaaaagtaagagaagcccaattgcctggggaagtaaaaaattatgccagaataaacacttctagcaagggctgagaagataaacaattttatcaatagcattttagtttcttagcttatgcatctgagaattaaagaaattacaaaagtactcagagttctagtagttaagcttagtgaatgtatcagctcatttttaacttaataataaatacttgaaaagatgatgatgaaggtatcttttaatggtgaatttattatattccactaaaaaaattgtttatctttatcatcaaaatgaaatattatattacactacttatttgctatttagatttccaccaggataacatagtgcttaaggacacagcttatacacttcctctgcctgagtttaaatcccaagtacatcacttacagactgttgtccataaggagtttcttaactgtcctatgccttagtttcctcatttgtagatgggaacaattatatctcacacaggtgttgtgaaggttaaataaattaatatatgttaattgtttagggcataggtcggtgttaagtattatatttcaaaaataatattaaattttttatccatcaaatctaaaccatgtaatagcacctttctgtactctgaaaacagctgtatttgagatggagaaagagctattaatcaaattccatgtgctaggaattattttagatacatgactatgaaatgaattagataatattttttctcttagggaaaactgggtagacatgatatattgttataatacaagatgtcagcccataccaactgttaatgatataggtttgccttaattgttatgagtttagaaattaaaaagaaccaacttttcaaagatgggaaggggtcagtgaaatatttgcatgggaaattatttttaaacatgtgtggactttggatactcaagaaaataaattcagccaaaggatttatatccacccatattgtccttcaagtatggaaattataaccaaaaaactttgaacattacaatatgctaattaccttagtttgattattacacgttgtatgcatatgtcaatagtttacattttatcccataccccgtaaatatgtataattattgtgtcattaaaaataaaatgaaactaaaaaaacttctgaccagttggaataatctacctaaatattagttagcacctttaattgggatcaatgtaaaattctgtatttagaaacaataaataattatatttctttggggggggtggattgaaggatattttattgggaagtaatgtatcttaccaagaaatacttgtgggtactaatgggtaatgacaggcaggaacactgactgtgattaacatcaggatcagagtagtttatcagaatgtaaacatgtgccttaaaaactgtagaaacaatacctcttttcctaagaacataggattgtaagtttaaaaaaaatttattagtaataactaagaatgaaaaaatataagtccgagctaataagtcaaatattagatctataagcattactaagagtacaaaagtaaacaaaaattaaaagttacaaatatttaagtgaaatgggagaagatggaaacagtctattttattttaattgctgtttattgtatggtgataacacaatattatctaaacttataagaatggaggtggtcactagaaaaaaaataaacaaaaatagaacttcactcaaggaaaccagatgtatctaaaacaaaaaaaaataagatcataataaaaatccacatacataaaaaggaaagtaagagatatgatttcagcacccacagtgatgggatccaaactgaaatcataaaaagaaggaacagaaaaacactttacaatcctaaagtgagccattcactgtgagtatgtatctctgttgcatgttattgaccaacattcacaaagaagaaatcacaatatatacaaagaaatatgtctataaacagaattgtagagggttatagctcacaaatttcagtctgtgatagataaagtattttaaaatatgaataatcaaataatgtaattaataaggaggttgatagatttaataaatcattctctgcattctggggctatatcatttaattcaagcgcctatagaatatttagtaaaactgactaaatattacgtattagtcttcaagactatctcattaaaggactcaaagttaaaatagtacaaataaaatgctcctttccaaatacaactaaaagttagtgaaaaacatcagaaaacaaataatgaccttaaactgaaaatgtattaactgcaacaaccacaaccttcttcttcaggaattctcaaatcacagaaaaaaaaaggcaaacaaattgcagaatttctaggaaaaaaactataatgagaaagaacatatatggaaattatgggatacaaattaagtgcttctgaaagtatacttgtaattctaaacatatcaaagacatcgactaaaaagaataatattagatgaattaaatatgtaactaataatggagaataaaataagaaaaggaataaagaatagtaaacaaaaatatatattcaaacctgattttttggaaggaaagtttaaaaaaaaaacctaaactaatcttattaagatacatgaaagacatagaaaataagcagcttgaaaacattataacaatattttcttaactctacacaaataaatttaatatgaaggatttcgagggaaggttgctaaaagcaacttcaaagaaacagaaaacacacataaactgatttctgaataagaaaatgagaagcttgtgaattttccctaaatatatcagacccaataattcactaaggaattctgtcaaacctggaagagcacataactgcaatactatttaaagctttcaacacactgaaaagaaagaaaatttctactatgtttctacataaagcagacaaatttacattcgtttcctaggaatgctcttacaaatgaccataaactgaggaactcgagaaaccagtgtgctgtctcacagtcctggaggccagaagtctggaatcaggagttggtgggactgcacttcctctttccttggtaaactctaaggacctgtccattcctcaccaattccagcttctgaaggctccagttgttcctcagctcatggctacatcactcctctctctgcctctgtggtcatatgaccgcatcacattttctctgccaaatctcccttggccactcttataaggacccttgtcattaaatttaacacctacctaaataatcgaggattatcacctcttcttatagtttactacataagttaattgcatgatttgccatattcatatttgttgcagggttgccgtcaggcctctatagcctgtctccacgaaagccatgtccttcccatgtgtacagtagtgtttaccccatcccaacatccctaaaatatcaatctattacaaaatcaattctaagtccaaaatcttatctgtttatcatcaggtcaacatttctaaactcatcatctcaatctaaatctcattatcttaatcaggtgtgggtgaaactctagatagtttgaatcctagcatgaaaatcttcatctgtggacctgtgaaattagaaaacaaattatccttatctaaaatacaatggtaggagaggcataagataacagttataaacactgacattccaacagggggaaaatggaagaaataaaaaagtcacaagttccaaatatgtttaaaacccagcatggaaaattccattaggtttcttttttcctaagttttatttaatatttaattgacagaaaataattatatatatttatgatgtacaatgtgattggtacatgtctgttacttcaaatatttatcatttacatgtggtgagaacatttaaaattctctcttttagatattttgaatggtacaatgcattattattaagtgtagtcactgtgctgtatatggaacaccagaactgattcctcctacctaactgtaacattgtacccattaaccaatgtctccccttttcctactcacctctctattcccagcctctggtaacaaccattctactttctacttaaatgagtttgactttagattccatatgtaactaagatcatatggtatttgtctgtctgtgcctggcttatttcactaaacataatgttctctacgttcacacatgttgttacaaatgacagaatctttttttaagtaacagactaaatagtattccactgtgtatctacaccacaattttttaaaatccttttattcgtggatgaatactttgtttttttccatatcttgtctaatgtgagtaatgctgcaattaatataagggtgcagccatgtctttgggatactgatgtcagttcctttggctatatacccagtcaggggattgctggatcctatgggaattctactttcagttttttgaggaaccttcatacttttttccaaaatggctgtactaatttacaaaaccacagtcctgtgtttccttttctccacatccttgccaatacttgttatcgttcatgtttttgatgatagccactgtaaaaggcatgagatgatatttcactgtggttttaatttggcacttttctgatatttagagatattgaggaatttttcatatatatgttgctcagttgtatgtcattttttgagaaatatctattaagtgatttgcccattttttgaatagagtgatttgtattttttttttgagtagtttgagttccttcattattttggatattggcccttatccgatgtacaattttcaaatattttcttcaaatcatgtattatctcttcattctattacttgatttctttgctatgaagaagctctttagtttgatcattcccacttgtctatttttgcttactttgcctattttttttagttatagacaagtaatctcagcctagaacaatgtcatgaaggtttcccctcaatttcttcttctagtagatttatcgttttaggtcttacattgtctttaatccattttgagctgattcttgtaaggctcaatactttcctctctgagtctgtagctctgcttgccactgcccctacgggtactttgcataaagtacccaaagtcttctatgtttcccctggaagaaatcttcatcacctataactgcaaaattatgatttctggacattaaacctagagtttcatcctgcaagtggttgaattacaatataaattgagtgtccaatcatgtaggggtatctttcttctggggcaggctagggcagccacaaaaactgaaaaaagtgaggaatggattgtctagagttcccagagagggtgtggttctgccacatttctgacttagtgacttcagaacttcaaggtaatttctgttgttacaacccaacctgtttgtggcaatttgttatgtcatccctaggaaacgaatatagtaggattaacagaaaataataagccaatacaaatattaagcaacattaagcagcttcatttctcagcacccacaggacaattctaagcaccattccagtaaaacaaaacacattgcaaatgggatgattccaggaatgctcagatagttgagggatagacaaataattatgctagactgaaccatatgaaatgatcttttgtatatgtcatcatacatttttgatatcagcaatttcatatgagttaaactaacttttgaaaaaggacaggagttgtgaatacatacccatgttatacttgctggtagtttctctcttccctaccaagtgagtttgataccaaccaccatcatcaccatggtgaatgttggaatatgaatgcatgctaattagcattgtcaaataaagtacaggacatctaattacattctaattttaaataaccaataaatttttctacaactatgtttcttgtgataaatgacaattaatatactaaaaaccctacagtttatcctaaatttaaatgtaactgggcatccagtagtttaaatgattgaatttggcaacactgaaaatagcactcattaagtatgagcatcagtgatatggtttgttttttgttttgttttgttttgttttttgtctgactctgtcacccaggctggagtgcggtggcatgatctcggctcactgcaacctccacctcctgggttcaagcgattctcctgcctcagcctcccgagtagctgggactacaggcgtgcacaaccacacccggctaatttttgtatttttagtaaagacagggtgtcaccgtgttagccacgatggtcgacctcctgacctcgtgatccgcccacctcggcctcccaaagtgctgggattacaagcatgaggcaccgtgcctcacctgggatttttttttttaactaagaaagcgtggaagacaactttaatagtttactcaactatttaaaaggtgtggaagatgggtacttgagtagttttcccagagttacagtaatagaaaaataatcactataatactaatactataaataccattttttttgggtaaaaccaaataatacaataatttctattatatatataactctaaaatatccaggcataaataaatgagtataattttctcacagtttccctgtaccggcaattcagcctcaccagcttttcttcacaaatgaggttgttaaaatatttccagttgcgttaattcaactgcttctaaattcctgtcccaacctaaaataatctactcatttttttcatggctccacatggtttccatccatccgtcagttctggcaaagaagtccctcaaaatgtttacccccaccctggagtagtaaaatatatattagatgatcgtcaacctgaaaccatatgtccacagaaacagcctgcaccgtagcagtaggtaggttagtattgaggcaaatggcatctaacttgccaggggacctgctaagaaatggaacaagagatgtgtgtcatcttggatgcagagcttgataataatatcagataggacgggaggtggcccaaatccctccacaaatttcattgaaaagtccaaaagatgtgaaagccaaaaataataaataagtggaggtgattgttttaaaatccagtgttattgtgagaaagaaatgttaagcattcctagaaaagtatgtaactctgatttttagttctaaggtcttaaatacccatattcagtgagaagaaccttagacatcatcaagccttccacatgcagcaagttaactccaaaaattatagacattgatctaaaactaacagtaaactttccaggtattcgtatttccatgagcaggatgcacgattctgactgtccagctcttataagccaagagggaccatttttgtccacccagttgctgataggcagcaagtatgtaccatttctaggacgagttatttaaattttgatggggcttattgataaattagtcataggcaaattctcacttgttaatgtaaaggaggaaggattcaaggaaagaaaaagtttaatgtgtggatccaattaagagtatgcaactcctcggccgggcatggtggcttacgcctgcaatcccagcactttgggaggcctaggtgggtggatcacgaggtcaggagatcgagaccatcctggctaacacggtgaaaccgcgtctctactaaaaatacaaaaaattagccgggcgtggcggcaggcgcctgtagttccagctactcgggaggctgaggcaggagaatggcttgaacccgggagacggagcttgcagtgagccgagatctcaccactgcactccagcctgggtgacagagagagactccgtctcaaaaaaaaaaaagagtatgcaactcctcaaacaagataggtattagttattttggcaatttatttctagtgtgataggtcataaacttcagaagcaactccttgaaaaatatataatctgaaattcataatgtttgtgtcatatataaatgcatgtgtattgtatatatgatcaacttctgataatttgaattttttaagatataaagatacatatttttttggaaactggtaaaatattgtagtggcttatcctcatcaatgtccctgtgaccctagttttctaggttcttaatatatggtttggaaatgaaatgatattttgccttttgtgtaatctccaacccctgggaaggccaattttccaaggcaattcagaaaaattggggaacttattataagtattatagtactgatcattctgtttacaggatcctgataaggatcctctttctagttagcttttgcttggttgctatgaactgaagggatgtttcttccctcaaaattcatatgttgaaatctaatccccagtgtgatatgatggtatttggaggtgaggtctttggtacataattaggtaattagagcgaaaccttcatgaatgggatttgtgtctttataagaagagacaagggagagatggtttctctgttgtgtgaggatacagcaagtaagaggccgtctgtaaaccagaaagaggatgcctaccagacaccagctctgaaaggaacgttgatgttggcttaagccacccagtgtatggtattctgttatagcaacctgaattgactatgatattgacccttaatgtaaaggacaatgcctcaatttctctgcagggaatgaccattctgttcctgccaaaaaaagacactttgagattgaagcaggcttgtacaaaatcagtggcataaatagaaatgaaaattctctattctgctgtttctcacagatctttaacaggaagaccagcatcagtggatacttcatccagtttaaaatggaagactggtctccgaatcaccttcactcacctcaccatgggagcttttaacttttaaaactacatccgttcatcttagtttcacacagccttttatatcaatcatgctaaacactttccaaatgtttagttcttatctgaaaaagcacttcctcttgaaaacattacctagcagtcctcacacattcctgaatcggagtttgtattcctcctattgatgtccataacaccaaatacatattattgcactaaatacaaaatgctgaggttccatttatgccttagatgttattattaaaataatcttcatagttcgttttagaacaaagctagaatgacttatctctctctcaattattttattctaaaaaggaaaaaataatgcatatttgaaaagtaatgaaagtcataatatgactttttttataaaagtcataatcttattttttttccccacagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaaggtatggcatgcttcaatcgtttagacatagaaagatttttattgcctctcacattaattaaacttgaataaaattacacttaaaatgttttatttctacgttgttttctacgaatataattaaattataatattaattgattttaactgtgtagcttagcagttggatttttgtcacattaagaacatattttgctatctccatgaatgtcttattgaccacatgttaattttttcatttgacttaatggatgtgagcgtaattgattgagaaaattgttgtagagctatttaatcacaaactagagaatctattgctcccttaatgataggaagtatagatatagtacaaagcgtgatgatttggggataacactcatctctaactgactctggttcctttggtcagcctagctgtgtggctttctctttatatgtaaaagtggaaaaataatgtctgtgtctcagagctatcgtgaggatgcatgaagcaatgtgcgtaaagcactcagcaaagtggcctgcacctagtagtcactcaataaatgctaacttgtgaaagacagtatagggtgcaaaaaactctgaatacaggaaaatcagcgtgggaactctattgtgtctgcttactagcagagtgatcttttacagtcattcagtcatgtggaatctcaaattccaaatatgtgaacaaagaataataatgctacataaatatgttgataggatttagttagattaaaggacttaacacattgcccagcatataataagtgctcgctaaataatacttgtattagtttagtacatcatgctggagagataatcaaagcttttttgcattatcaaaggagtttttttgtgtccctcatttataacaaaatcagaaaggctgcatacatgtgtaaaacttcttggatatcctgtatttatactcatggaaatcctgtctctagaaaggttaaaatccttaataatctttctaatttttaccatgaaatccttggttttcattcacttaacaaaagctaatatactaaatagtctcctcagtatctgtgggatatttgtaaaagctctgaattttctttttcataagcatgactgtttcagttaaaaataattcccctagcacccatgcatgtagtgaagcaattttctgtgcacaaatgtagatattcaacaatcctactccatctgcaagtatagaaactgtatcctgtcacactaacagcaagagctagataatgcttgaagaaggaggatcggtaaactatgcaaaataatatgcataaaccaagttacagaaatcagtctctaactaaggaatagaaatcaaagttaacatgtttcattgcttaaccaaaggaaagcccgttttgcttcaacattccatagaatgccatgtttttaattatacttttgaccccaaacagtaagtatgatttgttcaggtttaaaaaaaaatgtagcaccataaaagatctgtacaaatgaggctttctttaccaaaagcacccaatatcttttgggaatagagataggtcatgatataagtttgctgtgaaaatattaaataaacattgacaatatttttttaaaggtgatactaatgataatttctgtaattatttaaaaaaacaggaagtgcaaccattagtttaatttattttttattaatacaaaaaagttgtacatttggtgggatacacgtgataatttgacatattcatatgatcaaatcagggtagttgtgaaattcatcaccttaaatatgtatcgtttctttacactgagaacattcaaatcattatcttctagctgttttaaaatgtacaatccagtgggtaccaatatgtacatttaggtggaagaaatagaacctagtgtttgatagatcagtagggtgactatagcaatcactcttagactatgttttaatcacttgtaacgtgcgatattatagtagtcctcatgataaagaattatacatgtgcacacacacatagacacacatacacacagcatcttgaactccagggaagaaatagacttggaaaaaatatgcattgtgtatcatgcataattctccacagaaagagaatgaaatacctgggccctgtggcccagccaagttgacatgtacaattaaccatcacactgtgtttagtgtaataatggtctgagggaggtgtgcatggagaatgtattccaaaactttctggaggcaatgagctgaagaaaattgaattgaggctcataaaccaattagaaattagagaaatgaagaatgaaggaaagaattgtagtttgctgtacatgaggagcttgggttacctgtgggaatagcaagtaatgagattggagagatagattagatacagatcatgaagaggctttctgcaatggtaaggtctttgaaattaatcctggcagcaatgccaatagggagagaaatgagaggaactttgataattataaccaaaacaatgataggaaaatttgcatttcaaaataaacaatatttaaaatcaagtgaaaggtaggccaagggggagaaattgaggtcaaggacaaagatgttttagcattattctatatgttccaacatatatgaaaacaccccttcccacataggactgtgattctcacatgggggcaaaatccacccccctgcaagggacagttgaaaatgtctggagagatatctagttattacatcttgggatagtgtcttagtcactttacgctgctataacaaattaccttcgactgtgtggtataaacaaaaaacatttatttctcacagttctagaggctgggaagtccaagatcaaagggccagcctatctggtatctggtgtgtgtctgattcctggtttgcagagagccctcttctccctatattttcacatagtgaagagcagaaagaaagaaagcaaactcttccatttctttttacgagagcacacatcacacaatgaatgtcccaccaattttctcctttagtcagtttggctgctaagaagaattatcatagtcttggtggcttataaaaaactgcaatttatttatcacagttcttgagtctgagagtctgagattaggttgccagaattgtcgggttgtgctaagtgctctcttctggattgcagactaccaacgtctcgtattctcacatcttggaaaaaggtagctagctccaagctcctcttgtaaaggcactaatccattcatgacagttccattttcatgacctcataatcacctccagaagtttgtacctccacatgccattacatcgtggattactgtttactatacgaatttgggggagggggataaaagcattcagcttgtagcaggtagggtgttactggcatctaggggtggaagtcatggatggtgctaaacattctgaaactcacaggacaactcccacagaaattatctggccccaagtcaatagtgctaatgttgagaaaacctgacatagactaaaacaaactgactggcaaattggtagaactggagtactaattgtattcatgggaagaaattttgaaaagatatttcagagataggtgtctatatatacaaatcatatacatgaatagtcatgtgaatgtttcaatgtgtactttcaatcaattaaaatatgtcactaattgtctcagtaattgtcctatatcactgagagcacttaaatgaacactcatatgaaacatgcactctcctggttgttgggatgcaaagatgattggtacatagtttccaaatgctaagaagggaagcagaaatctattagcatatgaaatattctttctgctttgttttggttagagaactaaaatgaatcctgctaaagctgccttaaaataattagactccatagctgctgtttggggacataatttacataatatttattcttgattttaataaaaatgtgtcattcacatgggcctctgggtgcaaatagtgaataaaaaaacagaaaacattaacaaaaacaaaagcaagcctatacttccacctttctcagggaccaaatgtttgtactaattaaggaaaagcacattgaaaagatgtactttgcaatgtgccctgaaatgcaatcaactccaagtttgtagaattggtaatgaaagggagtttgagctttgcaagcatttgtgaaaagcttcctgacttcggtcttttgtattttactattgtacttttgtacttcagtctttgtattttaccattgtccttttataaattattagtaagactcttcagatttcatagagaatataatgtctaggttttgtctgtttcaactctaaacaagatgtgtaatttgcagcaatataaagtatatataaaatgtaaaataaattattatctagtgtagtcaccatgtcaggctatcaaatactagctgttgttccttctaactacattttttacccagtaatcatccccaattacctgccccaccaccactacccttcctagcctctgacaaccattattctaccccctatctccttgggttcaattgttctaattttagctcctacatatgagtaacaacatgtgaagtttgtctttctgtgcctggcttatttcacttaacataatgtcctgcagttctatctatgttgcaaatgatagaatcttattctattttatggctgaattactgtattgtgcatatgtaccacattttctttatccattcatctattgatggacacttaggttgctttcaaatcttggctgttgtgattagtgctgcagtgaatatggagtgcagatatctcttcagtgtactggtttcctttctgatatggtttggctgtgtcctcacccaagtctcatcttgaattgtatctcccataattcccacgtgttgtgatagggacctggtgggagataattgaatcgtgggggcggtttcctccatagtgttctcgtggtagtgaataagtctcacaagatatgatggttttataaggggtttcacctttcacttggctctcattctttcttgtctgcccccacgcaagacgtgccttttgccttccaccatgattgtgaggcctccccagccacgtgtgaatccattaaacctctttttctttataaattacccagtttcaagtatgtctttatcagcagcataaaaacggactaatacattttctttttcatataaacatagcagcaggattgctgcatcatagggagctctatgtttagcttttaagaaactgtcaaactgttctccatagtggttgtactaatttacgttcccaccaacaggatatgggggttcccttttctccacatcctttgccatcatttgttattgcctgtaattttgatataagccattttaactggggtgagatgatttctcattgtagttttgataggcatttctatgatgatcagtgatgttaagcacctttttatatgtctgtttgctatttgtatgtcatcttttgagaaatgtctattcagatattttgcccattttttattcagattattagattttttttttctatagatttgtttgagcttcaattatattccggttattaatccctggtcatatggataatctgaaaatattttctttcattttgtgggttgtcgctttccattgttgattgttttctttgatgtgcagaagctttttaactcgatgtgatcccatttatctattttttatttggttgactgtgcttgcagcatattactcaagaaatctttgttcagatgaatgtccagcagagttttcccaacgtactctcttcagtttcacagtgtgagttcatagacttaagttttaatacattttgaattgatttttgcatatagctagagatgggggtctggtttcaattatgtgtatatggatatgcagttttcccagcaccactgaagagtcatttattgtagttattgcagactgggcttatttgtgcctgtcattcttggggactcttccaagtactcaaaggggattaattgggtgttattatctaagtctttggtcattgcagctatatctgcattagggggtaccccaagcccagtaatgctgtgactctgaagacttgtggaggtactgctgtagtggtcttgggtaaaatctaagataattccctggattactaggcaaagactcttgttctcttcccttacattcccctaaacaaatggagtttctctgtccatgttgatctgcctggagctcagcagaggagtgacataagcatcactgtagccaccaataccaagactgcactgggtcataactgaaatgaacatatcactggatctcacccaagaccattgattactaatgcctggctactactgatattcccttaaggcccagggctcttcagttagcaaggagtgaatccagccaggattgtgtccttcccctcgatgttgcctctcatgttccacagcccagggcaggtctagaaatgctgtccaggagccacagcctggattcgagaaccttaggaatctacttggtgctctattctactgtggctgagctgacaccccagccacaagacaaagttcttcccgctcttccctcttcttttctcaagcaggagtttctccccatgtggtatgtactgcctggataccacccatcttcactcaaggcccatgggctcttctgtcagcttgtgctgaacactgcctggactgagtctcttccttcagggcagttagctccactctagcccagggcaggtttagaacttctctcctctgagccaacgcctggaatcagggaccccaggagcctgcttgatgctccacccctctgtggtcaagctggtatccaagctgcaagacaaactcccctttatacttccctttcccgtccttgagcaggaagagtctctccccatagccaccatatctgttaataccctgggttacacctgagtctcattctcatcaaaagcccacgatgagtaatgtctggctacagttgatgcttactcaaggtccaagggatctttagtaaggaggtcatgaattccaccaggactgggttcttcccttcaaggcagcaggttcccttctggcccaggtgtatctaaaaatgttgtctgagagctagggcctcaggattctgtctgctgccctattctactgtggctgaacttgtatccaagttgcaagatgaagtcctttttactccttcctcacttctactcaagtggaaggaagggatctctcccagagctgcaagctgcactgcctgcggttgggggaggagtggcagaagcactcccttgaccacgccagctggcttctcactatgtcacctgcactccagatccactggctccaagcccagcacatcaccaaggcttactcaggaattacagtccttctggcccagactgcctttcaagttcattaaggaccctggagtgctttagcccacagtggtggggctagccagaactcaggttttgaccactgggttgagttatttctctctagcctgtgctggtctaaaggcttactccataggttgcaggatgtgttctgtcactttttgctttctgccataacaaggaagtagtgacttccaatgcaaagtctcataatcattgtgttctccctccccaaagtgcacagattctctctttgtgctctgctgccactaccagggtatgagggaggggttgtgtaagccattcaaggctgtctttcctgtgctcttcagtgccccattcattaatatagtgttaataccaagtactgtgatcagtcacctgatttttagtccttatgaaggtgtttcatggaaagttcttcaattcagtgttcctgcagggttgacaatctttgtagggttctatactgctatcttgctccaccttcttctccaatcatcacctttttgaaaaaataaaattagagcctggctgtttaccagcagtgaagcctttcatttaaacaggctacaccatttgctcacaaattacaaatagaattcaggaatttcacagattagctactgagagatgagcaatcccatgttgaaaacaagaagctagagagcttttgggaatgtagctttatgacacatgactgttaaattgttaccattcattgtcttctgtctgttggccatggaccttatatatcattccataaactgtttcacaacactgaaactgtctgtattattgattccattctatagatgaagaaactaaagttcaaaaaattaactaacttgattctgttttcagtgataacatgacattttaatgcaaatccaattttgctttactctgaaaactttctttttgtagcccaatatgctccctattatactataactaataaaaaataaaaacaaacaaacaaaatgactacatttacaaaagtcaagtatcaaaaattagaaacaaatgtatattataaatgctcagagagccattaagcaaatgccattacctggggccttcccttttatgggtttactccacacattagaaaaggggatgctaactggcaagtctttttttaactttagcatcttagtaataaacttgctcttaattttatagtttctccgtattgtagttaaagatgtacattacttgatttagtataaaaaaagttggagtccctgaatcaacatttcttatatgatgaaaagctttagcagctgaattatgtgaatgagtatatgccccatctttccttcttttgcatcttgatttataacctgaatttatctatgcatttacttcttgttgagaatttgaatgttttctttgaatgataactttaaggaaataaatgattaaatatttcgcataattgtttcaaatgcttatgatggcactacctataaaataaactatagcccaaatgtattgtgaacatattggaaacttagccagattttaaaatatttttgcaacataagggataattttaaagaaatggatgcaaagtattaaaagtattttctcagcctatccagagatttattgtgaccttggtgaggtgaatttattggtaaataatggtacagtgaatacactggaagcattcacttctttttgttttttgtttgctttcttctctacttttgaaattttcacataattgatgatgagttggattagaaataccaaattattttggatgttataacagcaaaaaaaagagagagattttaaaataatgataaggccttttggcaaagttcaagagggaaagtgaaaagaaattattaagagtttgaatgcaggatttaaacttttgaaaacaaagatgaaaaataaccagtaaatatgttttaaactgtgttcatgttaaaggtatctaatatacaagaacctttttcatagaccaaatttagttgtaaaagttttccttattgataacataaaattatttcagtgttctcttcatggcaatcctcagtgtatcatcaaaaacactcagccattgtgttctgatccaaaggaaacagtccattatggacatttaatgcaaatccagtagagacagacagaaagcaaattcttgcttaaaatcaaaagtctttgtctacaacctgtattttgaaattgtatcacattatatattgctgatattagaacactgagattgattaatggtttattgttcaatgtcataaacacatgatacttgagaactcagggggacataaagatgactaagacaactctattctttcatagatgaacatatctttagactttgaaggctgaatggtccaaaagcacatagctaaagatattatctgatataaaatgattttttcccctaggccaaacataattataacacatttagtcatacaactacttgttttctgttttggcctatttaaaaaaaattcaataggtttttggggaacaagtgatgtttggttacatgaatatgttatttagtggtgatttttaatattttggtgcacccatcacctgatcagtatacactgaacccaatgtgtagtgtttattcctcaccctcacaccctttcccccaagtccccaaagtccattgtatcattcttgtgcctttgcatcctcatagcttagctcccacttatgagtgagaaaatacaatgtttggttttccattcccgagttattgaacttagaataatggtttccaattccatccatgctgttgcaaatgccattatttcattcatttttgtggctgactagtattccatggtttatgtataccacattttctttatccctacattgacggatgggcatttgggctggttccctatttttgcaattatgaattgtgctgctataaacataccttcgcaggtatcttttttgtataatgccttcttttcctatgggtagatacccaggagtgggattgctgtttcaaatgatagatgtacttttagttctgtaaggaatctccacactgttttccgtagtggttgtactagtttgcactcccaccaacaatgtaaaagtgctcccttttcaccacatccatgccaacatctattatttattgattttttgattatggccattcttgtagaagtgaggtggtatcacattgtgattttgatttgcagttccctgataattcgtgatgttgaatttttttcatctgtttattggccatttggaatatcttcttttgagaattatctattactgtccttagcccactttttgatgggatttttttttcttgctgatttgtttaagttccttgtagattctggatattagtcctttatcagatgtatagattgtgaagattttcccccactcagtgggttgtctgtttactctactgattatttcttttactgtgcagaacctttttactttaattaagttccatctatttatctttgtttttgttgtgtttgctttttgattcttggtcatgaagtctttgtctaagccattttctagaaggacttttccaatgttatcttctagaaattttatggtttcaggttttagatttaagtctttgatccatcttgaggtgagttttgtataagggtgagaaatgaggatccagtttcattcttctacctgtggcttgccagttatcccagtacaatttgttgaactgggtatctttttcccactttacatttctgtttgctttgtcaaagatcagttggctgtatttggctttatttctgggttatctattttgttcctttggtctatgtgcctattttttataccagtaccatgctgttttggtgactatggccttataatataatttgaagtcaggtaatgtgatgcctccagaatttgttctttttgcttagtcttgctttggctatgcaggctctcttttggttccatatgaattttaggattttttttctagttttgtgaagaatgatggtggtattttgttaagaactgcattgaatttgtagattgcttttggcagtatggccatttttacaatattgattgactccatctatgagcatgggatatgtttccatttgtttatgttgtctatgatgtatttcagcagtgttttgtagttttccttgtagaggtttttcttcttcttggttaaatatattcctgagttttttttttgtttgtttttgcaactattataaaggggttgagttcctgatttgattttcagcttggtcactattagtgtatagcagagctactgatttgtgcacattatttttgtatcctgaaacttttcttaattcatttaccagttctaggagctttttgcatgagtctttaggattttctaggtataggatcatgtcatcaccaaacagcaacaatctgacttcatcattatcaattggatgtcctttatttctttctctcgtttgactgctctggctaggacttctgctacttgaagagaagtgttaagagtaaacatccttgacttgttccaattctcagggggaatgcttttaactttaccctgttggctgtgggtttgtcatagatggcttttattaccttaaggtatgccccttctttggtgtttttgatgagtgttttaaccataaaaggatgctggattttgttcaaaagcttttactgcatctattgagataatcatgtgatttttatttttaattctgtttatgtggtgtaccacatttattgactcgtggatattaaaccatacctgcatccctgctatgaaacctactcgatcatggtggattatctttttgatatgctgtcaaattctgttagacagtattttgttgaagattttttcatatatgttcatcagggtctgtaacacagctgaagaaaagaaataacaaagatctgagcagaactaaattaaattgaaacaaaaaacacacagtacaatagataaatgaaacaaaaagctagttctttaaaaagataaataaaaatgatagaacattagtgagattaaccaagaagagaagcaagaagatccaaacaagctcaattagaaatgcaacaggagatattacaactgataccacagacatacaaaagagaactctaggctactgtgaacaactttgttcatagtaaactagaaaaccaagaggagatggatacattcctggaaatatacaactgtcctagatcgtgttcataagggtctgatgcatatatgttcatccgggtctgtgtattggtctgtagtattctttttttgttatgtccccttttggttttagtattagaatgatactggcttcatggaatcacttagggaagattttctccttctctgtcttgtggaatagtgtcaataggattggtaccaatttttgcttgaatgtctaatataattcagccatgaatctgtctggtcctggacttttttttgttgttggtaactttttaattaccctgtcaatctcactgcttgttatttgtctgttcagagtttatatttttttccttgtttaatctaggagggttgtatatttccaggaatttatccatctactcttggttttctattttatgtgcataaagttgttcataatagcctagaatgctcttttgtatgtctgtggtatcagttctactatctcctgttttatttctaattgagcttttttggatcttgcttctctttttagttaatctcactaatgatctatcatttttatttatctttttaaagaattaactttttgtttcatttatctattgtattgtatgttttttgtttcaatttcacttagttctgctctgatttcgttatttattttcttctcctgtgtttgggtgtggtttgttcttgtttctctacttccttgacatgttaccttagattgtctatttgtaccctttcagactttttgatgtaggcatttaatgctgtgaactttccacttggcaccacttttgctgtatcccagaggttttgataggtcatgtcactattgtcattcagttcaaaaaattttttaatttccattttcatttcattgttgtctcaatgatcattcagaagcaggttgtttaatttccatgtatttgcatggttttgagggttcattttagagttgattttcaattttattccaatatggtttgagagagtacttgatataattttgattttcttaaatttgttgagaattgtactgtggcctatcatattgtctctcttggagaatgttccatgtgctgatgaatagaatgaatattctgcagttgatgggtagaatgttctttaaagatctgttaagtccatttgttctaggatataatttaagtctattgtttctttgttgactttctgtcttcatgacctgtctagtgctgtcagtggaatattgaagtcctccactattgctgtgttgctgtctatctcatttctttggtttagtagtaactgttttatatttaacaaatttgggatctgcagtgttaggtgcatgtatatgtagaattgtgaatttttttttctgttggactagttcttttatcattacataaagtccctctgtcttttttaactgctgttgctttaaagttcatcttctctgatataagaatagctactcctgcttgcctttggtgtccattttcatgaaatatctgtttccacccctttattttaagtatattagtcctgtgtcaggtgagtctcttgaagacagcagatacttggttggtgagtttttatgcactctgccattctgtatcttttaagtgcagcatttcggccatttacattcaatgttagtattgagatgtaaggtactattatattcattatactatcttttgcctgaataccttggtttatttcattgtgttgttgttttataggtcatttgaaatttatgctttaaggagattctattttgttgtattttgagaatttgtttcaatatttagatctccttttagcagttcttgtagtgctggcttggtagtggtaaattctctcagcatttgtttgtctgaaaaagactgtattttcccttcatttatgaaacttagttttgctggataaaaaattcttgactgagaagtgttttgttcaagcaggttaatgataggacctcaatttcttctagcttgtaggatttctcctgagaaatctgttaatctgatacgttttcctttatagattacctggtgtttttgtttgtttgtttttccacacatttcttaagatcctttccttcatcttgacattagataacctgatgactatgtgcctaggagattatctttttgtgattaatttcccaggtgttctttgagcttcttgtatttgaatgtctagatctctaagaaagctggggaagttttctgcaattattccctcaaatgtgttttccaaactcctatatttctcttcttccttgggagcaccaattgtttttatgtttgttcatttaatataattccaaacttcttggaggctttgctcgttttttaaattttttttttctttttcttagttggattggattaatttgaaagccttgtcttcaagttctaaagttttttcttctatttgttcaattccattgctgagactttccagtgcattttgcatttccctaagtatgtcattgatttccagaagttgtgattgttttttatttatgccgtctattcactggagatttttccattcatatcctgtatcattattttggatttctttaagttgaacttcacctttctctagtgcttccttgattgccttaataatcaatcttctgaaatctttttctggcaattcagagatttagtcttggtttggatccattgctgataatctagtgtgatctttttgggatgttaaagaaccttattttgccatgttatcagaattatttttctggtctcttctcatttgggtagactatgtcagagggaagatgtgtgactcaggctgttgttcagattcttttctcccacaggatgtttccttgatgtggtgttcttccctttcctctagggatggggctgcctgagagtcaaacttcaattattgttatttctcctctagctctagccacccagtggagctaccaggctctgggctgatactggggagtgtcttcaaaaagtcctgtcatgtaacccatcttcaggtctctcagctgtggataccagcacctactccattataggtagcaggggagtgaagtagactctgtgagggtccttggttgcatttttgttaagtgtgctggttttgtgttggttggcctccagccaggaggtggtgctttcaagagcacatcagttgcgattgtatagggaggatcaggcagtcaacagagccatacggctcccaagagattatgtactttgtcctgggctaccagggtaggtacagaaagaccatcagatgggggcactgttaggcttttctgagctcagactttggcaggtcttgctgtggctgctgtggaggatggggatgtggttcccaggccaatggagttatattcccagggggattatggctttctctgctgcatcacatagctcaccagggaagtgggggaagagccggcagccccaggccttaccttgttcccatgcagcccacagcccaaacagctggtctcactcccctcatgtcccacccaacatcaccaagtttatttccaggaagctggtaacagctaagaacttgccccagactacaagcctcccagctgagaaagcaagccaactcacaattcctcagctatcccatggagcctgcagctgcagtccacctctttcaaagggtctgtggattctcttggctttcctggtatgttcctgtggtagttcttggagcaaaagttcacagtgtgggtctccacatgctgctctgttggtccatgtgggagctgcaagttagtcctgcctcctctccgccattttccctggctctagtcatacaacgtctgaagtaccatttggtataagtacaattttgatgcttatttcacacaggataaagtgaatatacaataagggtgttataatgttgtgtcacagttatattagagtagattttggatctatttgaacatttcctccattatagtaactctttggacacatgtgcttgttgattgttccaaagtgttaacttgacataccacaaagttgctttttttcccccttagattcaacctgaagtctaaaataattaaattattaattaataattgacactggacaagaatgtggtcactttttcatgtttcattaaagatatagaagacctctaaaaatcttccatttctggttaaagtttatctaacagcctaatgtcaccatcttgtgaccaaaccaggcttagccccaggaagggaacctgtgttctgggaaggtgtgcataattagaataagtaccttagccctagcttagtgatactctatagatctactaacaggggaataacatccaaatagcttatgtatttcatgcgaattttacaaaaaaaaaaattgtttttttttttgagatgaagttatgctcttcttgcccagcctggactgcagtggtgtgatcttggctcactgcaaccacctcctccagagttcaagggattctcctgcctcagtcttccaagtatctgggactacaggcatgtgccaccatgcttggctaatttttggatttttagtagagacagagtttggccatgttggtcaggctggttctgaataaaaaaattctaataaggttttgtagcatttctagaactcaagattaatgcaatttctgatatctcacttacttagagtcataaataccaggaagaaacattataattgcatgtgcagaggtttagcttaattttgcttcattggatggaagttttgattcaggaggttaaaaagtatccgcaaatatctatgtgccatgtgtgctgtccatcctattaagcacataagcacaatactcactttatgtgagaaattataccttcttttttttagaaagattattttctcaatgcatggcttgtgtattaaattgcattcccaatgttaacaaagggaatcataattcgtaaagtgaatctaagctatacttcaggtgcgtgactttttgttaagctaaaggtgagtccagggtcaggcgttttggctcacacctgtaattttagcactttggaaggtcgaggcgagaggatcatttgagctcaggagttcaataccagcctgggcaacatgacaaaacactgtctctacaagcaaatacaaaaattagggtggcatacacctatggtcccagcttcttcagaggctgagttgggaggatcacttgagcccaggaggcaaaggctgcaatgagtcgtgttcctgctgctgcagtccagactgggtgacagagcaataccctgtgtctcaaaaaaaaaaaaaaaaaaaaaaagtatgagaccaagttgtggtaatatctcacagggtatgtattgattaaactttatcccaactattgattattctcaacaaaacttacaaaacaactgcttgggtgacaaaatcttaaatacatttgctttaccattcatgtcttgtacctgcaaatatttacaaagtgacaactgaaagaggtcttctatactttatttatttatttatttttttaattttattattattatactttaagttttagggtacatgttcacaacgtgcaggtcagatgatatttctctaagtaggtcactgtaaaaatggatttctgttacataagttttaaattaatttcttgtggtgaaatggacagaatataatgaaaataagtgccactgaggactgaagagctgttattgaaatgaaaaataacatttctaatacactttaatatgagtattgattatcacgaatgtatacctaatcaaagggaagctgagttccaaatgatgacctgcatggtttgtttaaagtagtttctgtggaagaaaatatttgagtaaaggtaatcattattgagattgaatttttactatggtcataaattttctgtctgttttttggtccctgaagtactaatttcaataataaattttcatctcacttcaatataatgcattttctttttactttcatcattgctttaaaacatttactagagatatgaaatggtacagaagttgaatgatagaacaaagagtggtgtagaaataaaaaattatagccagtatttataagttatattgggaacttggcaagatctcctgtactgggtgaggcatgaatggatccatttatctgtcagtgtgaaattagttaaggtttgcctatgggacttgtccagttagagggctaataaagaccactgagcaaatttgagctgtcagtaacttaattgtactttctctaatctataactaggagacatcttattgatcattgatcatacaactttcacagtagtgtttagtgaagataccattttgatgcttatttcacacataatatagtgaacatgtagtggtgatagggtttgaattatatgtcacaattataagagtagccgttgagtctatttcaacgttttctccctcatattaacacttttgaccacatatgcttgtagattagtacaggatattaacaagatacaccacaaagtagttgctttgctttttttcttagatttaaactgaagtctaaaagatgagctttcacagtcaataattgtattacatcttaaaattatttccagaactatgattctatgaattttgggtgaggcgcaaatttatttgttctttgtgcaatgtttaaatattactcaatgaaagagggaataagccaactacacaccataaagagaaaacaattatttcccgaataaatctaaccaattttaagcatagtattagaaatccatatgaaggatgacattaagaatctataaatatcttatctagatatgaaaacatactggcctggataggtaagacacgatttcttggcatgattagtgctaccaacatatttacaaaagaagtgaaagactactatcagttgcatgaaatattatcagtctccattataactgttgattgattggttggcttattcattcacttgtgaggccaagcaatacatctgtgttattattggtagaagttaaagagctttagtctcatacaccttccaaataaaaattgctctatgtgaattaagcagtaaattaaaaattaattttctgacaaaattttcagaaacaggctgaagttctggctatttatatagagactcttgtttattcagtagtaaccctattcataacccactctgtttatagtgcagtcgtaggagaaagaaacaaccagtacttacaatctatgaactgtcttatcaaaatagactgaagcttcccaagaaagaaagggagaaaaacgtcttcctgagaagccttaaaacaagtgatagctgttttctatgaaggcctatcatttaaccctcaagcataagtgattttcacatatcacttcacttaatcatcacaagaaaattattatgtaaatggttctccatttcactcatggagacagctcagagagactaaatctcttaaggtcacaatgctaagtgatacagctgtgattaacaggtttgcttggtttcaaacctggagtgattatcttactatggcttgatataatattcacatatatgctgtgtctattttagaaataattttcctggaattgatctttacattctaaataaacaaggctaagaatctgtgacttattgtacacagagagaaagaatgtaggtgtttttcagtgtcttcaaagaggttactacctctgatatctgaaaactgggaaatttgtccttggtaagtggcccatccctcaccctaattcttcttgcttcttcatttatctttaaaagtctgtgctcttacaatccaaacatccttgacatttttcccaatctatgcattctcatcttcaaaattttacagagattatctttctctacaaagtatctgtactcctttcatctagaaaggtaataattatattctttcatttgctatactaggtcttacagtttagtcaatcctcatctcacaccagttagaatggcaatcattaaaaagtcaggaaacaacaggtgctggagagcatgtggagaaacaggaacacttttacactgttggtgggaatgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgtggcactattcacaacagcaaagacttggaaccaacccaaatgtccaagaatgatagactggattaagaaaatgtggcacatatactccatggaatactatgcagccataaaaaatgatgaattcatgtcctttgtagggacatggatgaagctggaaaccatcattctcagcaaactatcgcaaggacaaaaaaccaaacaccgcatgttcttactcataggttggaattgaacaatgagaacacatggacacaggaaggggaacatcacataccggggactgttgtggggtggggggagtggggagggatagcattgggagatatacctaatgctaaatgacgagttaatgggtgcagcacaccgacatggcacatgtatacgtatgtaacaaacctgcacattgtgcacatgtacactaaaacttaaagtataataataataataataaaaagagtttactactaaagtctaacatggtgaataagggcagccatgtttactggaatgctgatgtgtggtttctttcctacctactacatgaagcttttttctttctttttttttctctctttttctagtctagcagccaataccagaaagcactagtctccaaaatgctatgtcacctctgaaggaattccaaaccagatttaagatctttctttctctctgtttttctctaatatgtcatatgaaatcatcaaattccatactctctggatgatctctggtgcacatatctctatttaactgtttttcctctttcaggactgatcaaataccatgtccttcatgaagcttttatgccttggaattttatactctgatctcttcattaaactctctggcatccatcattataatcagttacctgtccctccctccctccctttctttttctttctttttctttcttcctttctttcttcctttctttctttctttttctttctttctttttcttttctctctttctctttcttccttcctttcttcctttctttctttcttctttctttcgcttttcttctttccctccctccctcccttccttccctctctccctccctccatttttcttccttccttctttctttattttcttcttttcccgaagtaaactatttgacatattctctcttttttaatatatatctttcattctttttctgtattctttcaaatgagagtatttttgaatgaatggataaagattgtattagtttgtgcttgtgttgctataaaaatacctgaagctgggtcatttataaagaaaagaggttaattggctcatgattctgcagagtgtgcaggaagcatggtgccagcatctgcttctggcctcagagaacttacagtcatggcagaaggtgaaggggagccagcatgtcacatggtgagagtgggaacaggagtgagaagaagtcccaggcttttaagcaattagattttgcatgaactactgagagtgagaattcacttaacaccaagtggatggggccaaaccattcatgagggatccacccccataatccagtcacctcccacctggcctcacctccaatattgggaattagcttttaatatgagattcagaaaggaaaaacattcaaacagtattatcccccctttaaaattttctccttttaaaaacaaagaagctggccaggcacagtagttcaggcctatcccagcactttgggaggccgaggcaggcggatcacctgagggcaggagttagagaccagcctggccaacatggtgaaaccccgtctctaccaaaactacaaaaattagccaggcatgatggcaaacgcctgtaatccagctactcgggaggctgaggcaagagaattgtttgaacccgggaggcagaggttgcagtcagctgagattgtgccattgcactccagcctgggcaacaagagcgacacttcataaaaaaaaaaaaaaaaaagctgataaatattactcagtagacctagattgtattttaatctgttgcactgtctccttaatgttggacaaattctctattactctgtcccttcgtttcttcatttgcaaaagggagctagtaatagtacttacctcatgcagctgttatgagtgtttaatgaactaatatttataaagcacttagaaccccatctagtatactgcaagtgctccataaatgttagattttcttacctcttactagatagctttgttaaataactcatatacgcatttaagtatttcctctctgcctcacacatatggcaatactcaaaggtttatattaatggccaacttagaatttgaagaaattgtttaaaatgtcttatctggctataaatcttctagcctcaatttattctggttcatttttggtagctgtaacctagaatttttttttttttaatttaaaatcccaattccacgggttttatgattagtcctcttttaggacctatgtcacctaggcaaatcgttacttgattttgtattttctaaatatttctgataatgtcaaattaattatttgtaaaaaaatctaaatattgatatatacattcataaagtattgatttttttacttagggcttatgaaacagattttattataaaaattatttgaaaagtaatttactgagaatagcctcatctctttttaatggtttgattaatagttttatggtcccatgtcacttcttaattctaaataattagcattgaatgattctacatttaatcttcaaaatagtcttgaatagtttctcttttctcacatttccactttacttacttctgagtttttatttccatgtctgggcagaaagccaaaagtggttaggcagaactatttagttctacttgagtcaaaattcaattgcaacttcgtgaataagactctttggatccaagcatcgcccacaatctaacccttaggatgttgatttccctagagagctagatagcttaggaaactcggaagcaaataacatgagtctaaagatgcatgcctagcagtatgcttaccatttttctaatatataaacataatttaaaactatataaattaaaatgtttaactctaaaaatattaagccactgatattagcacttatgttagaaagcccagtgtgaagtggctaaaaaagaggagattgctctggcaaaaagactacatattttcagaaaacaaaacaaaacaaaacctattttcttccagactgacagttgtaaggtgatctaacttctaaaatgagacatgctctgccatatttcatagggatctatagcactacaatctgagcttttctgatagttgctgcaggcaactttgaagctgaataataagttccaaatttgaatcctccaaatttcagatacagaagctgattttcttacagtaaccaaaaatggacaatttcttaaagacaggttaacattagataataaaatagccagaaagcctactgactacatgttaaaggatgctgtcctttccacatgataagacatctgtcatttcctaaccagttcaaccctcatcctcagcatttttcctctgggaaagggatgttataagaagggttttgttttttttctagtatagactcaatctgaattaagtacaatggttttactgtagcatggctttatgctttgggaaccccagtgacatacagatttcccactattctgtagcatctggtttttgtgtctcagaataagatttactttagagttgtaccttttcttgtttaaatttcttttttatgttaaacttttttcaattaacatatacttattattagaaaatttaatgtacaatggtcagttccttgttttgatcacaccgttccaagtgatacaatctgtctctttttatgtgttttttactgataagttagatttcttggcatgctccttgctctgtagtttcattctccatgctgctattaatatcttctgccatgtgtgttcatgcctctccacaggaggttagaagatttcacaccttagcaatatgctctgcatacccttctaacaccttatgcctatgagaggcatggggttggttgtattgcaattccacttacactctgttctagaaagtatgatgaattttgtaatatttacatcaccacacctaccctatatttctacccagcttttcatcttttcctcatactaaaatggaagaagcatccctgttactttcaatgggaaatttctatatctgttccccggaatccaattattttcaccttctcatgagttttacaatttttgatagtcccctttttcaaaagcatcatttctttcagcaaagacaatgcttcttatttcccatataaaagaaaataatttgttgaacccacttttctgatgacacaaaatgcttttgtttctgctgttcattcattaaaagatatcaatcaattgtcttaactcatggtctttgtatcttcacattcaatatactgttgaagccactgtaataaatctccagtcctttgatatattttctgatgttattcttgacaagttaactattaataatactgtccatcttgccaaatccaattaaccctcactaacctcaatcaacctcctaacagaattcaccccagttgttagctccttccttcctggtaagccatttcttggctgcatgccactccccttcccagttttccctctctcctttggctgtcaccatctccgaacagatactgacctgctctatactcaataggttgtgtacttcagtgctcaatcttttatttcttttctcttataattctgttccagatgagattataccattcccattaccttagctttatgctgatatatcatctcaaagttatatttcctatttagaaaggacaattgaattccatacccatatttgacttttgctttttattccacatgggtatctaatgggcatttaaggcataatcattaatttttcccaaactacctttccccagctctttttatccacctcagtaaaggggcctatcaattaaatagtaggtcaaacacgtgtggaaatggagtcacctgtgatttaattgctttactaatgccactgcaacaagaagtctatgaatttcatttcatatataacagtatgttgtacacttttttccatcatcttctatctttccatctttgtccaagttgacaaataattttttttataaattgttttcaactttctacagtatatgataaaaagtagccactgttatttttcagagcattaataaatctgtttttattttcttgaatttgaaattcttgccattgctttcacaaaagataccttgtcctaccttgtcctaactcttggagattcatgtcattcagtctccatagccacattgacatagatttgttttctaaccaattgaaactgtttctttaatttcgatctttgcatcttggttttctctgtttcatatattcttccctagcacttttcacataattaatcagtccatttcatctttcaggtctagataaaatattacttaagctgagatttaaaaagagaaaaaagcattagaggctttaggagagaatatttatctccttaaatagttgaagaaatagtctgaagcttttctagaacatatgataattgtttaatagtatatattcagagacatgttaatcagctgttgctaaataacacataactccaaaactcaggggtcttaaaaaaaagctgtgtctaactacactgcatgtgtcggtgggttagctgagggctagctgaattaggctagcttttgatgccagctctgtttatctctggggcactccatcgtgcatctgcacatttactagattgatctacgctaggttgggaaccttaattgggacaactttgccccgtgtgtttcccttcctcctgctaggacaagttaattagcccaatcatgcttttcctgtggcagtggcataggacacaaggaaacatacaaagtctcatgaaacctaggcccagaaagaagacagacaccatcactttcagctcatttgattacaaaagtaagctgaaatctaacgcaatataagagaactctacaaaattacatgaattgaagagggaaaaataatttgtggcctataattcaacctatctttatttatttttttatctcattctttgactaaacaagggtttagttgaactgtgatggaggtacaatgttaataaatataaatgttttgtttttcattttatattatttttaaaccttagctacaatgaaatttcaagataaattcatctctgacttcaaggattctaattttttttgaataataacaacaagaagtcttattataggtttaatattttttttcattaaacatattataggcttccaagaggtgagttcttttggtctctccactattaatcgctgtttctgctatctacttttattcatggaatttggtaagaccttataaaattattctttgaattagtaattgaacttagaattaaagactgatggataagaataattgatataagttctataaaaatataaagttgccatgtaatcaaatatagaatttaaaagtatatttgaatattttaatgtatttagatataatactttccttggttcagttgtattttcttcattataacatcaagtaaaaacttctctttttttctctagatacttcatcaactacaatgttgaagacgacagatttttcaacattgatgccaatactgggaccattaggactacaaaggttctcgacagagaagaaactccatggtacaacatcacagtcactgcttcagaaattggtaaactactttatgtatcacagtaaaagatgtcacttgtacaagaagacatactgaaatttccttaagagcagggctctcataatctttatttttgatatcaggatctaggagagtaagcggagtgtattagatataatttctcattatcagatagcatgaataagtcttatgccttcctccttactgtaattctggcatggtgatggaaaagtggcatcacagaacacttatgcctcatccttgagtcaagggcatttggttctccttctaattgggagacttgctttttcatttgcttttgccttacttacactatcaagtcattggaatgacttgatatgtgtgatagtttaggaaaaaagaaagaaagaaaaatgtataattgcacattgattattttgtcaatataatacctctgctcaagtttcaaaaacacttatagaacttacagtaaaagaataattcttggaatttcaacagccaggtttaggctctcttcaagtaacatacgtgatctacagttgaggatgactcttgttctacctccacccagaatattccattgtgataaacacctaagctcaggaaacaacataaaaaaatatatatccgtaatacttctggaatcataaaggtagatatgactgtgttaaatgaaattagaatataactctaagaaaatgaatccatcttcataacaataaagtttttttaacatattcgtaagtagaccaaaagtaccaattatcctcactttaaaagtgtacgaagaggttatacatacatttaggaaatgttttgatgtattcatgaaaaaaaccatgaatatattagagattaagaatacttcacatttgaaaatagtgccatgtaaagtaaaatcacgttctgtttttctttcagagggtctaaaacattaaaaattttaacagcttcattgatatacaattcacacagcataaaatgaacccttttaacgtgtataactcaatggtttctagaatattcacagagttacacatccattaccataaccaatttcaaaacatttttattactacaaaaaaaaaaattctgcattacttagtcataatcccccacactctttcaccttaattcaggaagccattaattgactttctgtctctataaatttgcctgctattgctttgctatataaaataatcatataataggtagtcttttgtgacaggtttgtatcattgagcatgatgtgttcaatgtgtatgcatattatagtatgtgtcattggtacttcatttttttattgccaaaattattctattgtattgatataccacatatttatccattctttacttgacaaacattaatctggtttccatttttttcctaataggaataatattgctgtaggcattggtgtaaaagtagttgtggaaatgtttccatttctcttgagtatatgcctaggagtgaaattgctggtaactcttatgtgtagccacttgatgaactagcagattgttttccaatgtggatgcactgttttacatttctgacagcaatagggtttcctatttcttcatatttccaccaacatttgttactatatgtctttttattatagccattctagtgggtgtgaggtggtattgcactgtagtttatgcatgcttctattgcccttagttatgtagcagtcatgaggctacttcagtgtttttgattctacttggattttggtgtctgcaaaattagctcaagtggcttccatttgaattagtttttcaccataatatctctgtaaaagtaacctttcactaattacttttaaaggggttctctaaagaatccatgagtgagttcaattgtaatcatttctggttattttcatcttcaaaataaccagacgttagcaattgtgaatccttagtaatgtaagaacaaattaaatggcggttaaataataaggactcattaaaacttagttaagaaataaagggatgaatggaaaaatatatccaagaaaaaaattatgagggttaatatggtttggttgtcctcacccatatctcatcttgaattgtagctcgcataattcccacctgtcatcggagggacccaatgggaggtaattgaatcatgaggccgggtctttcccatgctgttctcatgatagtgaataagtctcaggagatctgatggttttataaaggggagttcccctgcacacgctctctcttgcctgccgccatgtaatatgtgactttgcttttcctttgccttctttcatgattgtgaggccttcccagccatgtgaaactaagtccattaaacctttttcctttataaattacccagtctcgggtatgtctttatcagcagtgtgagaacagactaacacagtaaattgataccagtagagcggggtagtgctgtaaagatacttaaaaatgtggaagtgactttggaatcgggtaacagtcagaagttgaaacagtttggagggctcagaagaagataaaaaaaatgtgggaaagtttggaacatcctggagacttggagtgctcggaagacaggaagatgtgggaaagtttggaacctcctagaaacttgttgaatggctttgaccaaaatgcttatagtgatataaacaataaagtccaggctgatgtgatctcagatggagatcaggaactttttgggaactggagcaaaggtgactcttattgtaccttagcagagactagcagctttttgcccctgccctagagatctgtggaactttgaactggagagagatgatttggggtatctggtggaagaaatctctaagcgacaaagagttcaagaggaagcagagcataaaagtttggaaaatttacagcttgttgatgagatagaaaaagaaaaacccattaactgggaagaaattcgagcctgctgcagaaatttggataagtaacaaggagccaaatgttaaacaccaagacaatggggaaaatgtctccagggcatgtcagagaccttcacagctgaccctcccatcacagacccagagacctaggagggaaaaattgttgtgtgggctgggcccagggccccctgctgtgtgcagcctaggtacttggtgccctgcatcccagtcgcaccagctgtggcaaaaaagggccaaggtatagcttgggcagtggcttcctagggtgcaagcactaagccttggcaacttccacatggtgttgagcctgagggtagatagaagtcaagaattgaggtttgggaacctcctcctagatttcagagaatgtatggaaacccctggacacccagacagaagtttgctcctggggtgagtcctcatggaggacctgtaaggcagtacagaagggaaacgtgaggtgcaagcccccacacagagtttccactggggcgctgcctagtggagctgtgagaagagggccaacatcctccagaccccagaatggtagatccattgacaggttgcactgcacaccttaaaaagccacagacactcaatgccagccctgaaagcaactgggaggggtcttgtaccctgcaaagccacaggggtggaccagcccaagcccatgggcttgtatcagcatgacctggacgtgagacatggagtcaagggagatcattttggaactttaagatttgactgccctgctggatttcagacttgcatgggacctgtagcccctttgtttcggccaatttttcccatttggaatggctatatttacttaattcctagacccccattgtgtctaggaagtaactaatttgcttttgattttccaggctcataagcagaagggacttgctttgtctcagataagactttggactgtgaacttttgagttaatgctgaaatgagttaagcctttggaggactgctgggaagacatgattggttttgaaatgtgatgacatgagttgtgggaggggccaggagtggaataatatggtttggctgtgtgtccccacacaaatctcatcttgaattgtagctcccataatttccacatgttgtgggagggagctggtgggaggtaattgaatcatggacctcgtcttttccaggctgttctggtcatagtgaataagtctcatgaaatctgatagttttataaaggggagttctgcacaggctttctcttgcctgctgccacgtaagatgtgactttgcttctcctttgccttctgccatgactgtgaggcctccccagcctcagatatgtcttattagcagtgtgagaacagactaatacaaaggcattgagctaattcttcagaaaagagaatcaactccagaagcatttcaatcagaagccatgctttagattaattttttttcactacctcactccaaataatatttgaattaagtagaatgtagtttatgaatatatatgagttcatgcattcatgaaaattatgttatttgcagtcatcaccaaaataaattcctgtttttactaagtaacatcctaattatatatttacttggtaaaatataggtatatttttattatgtgcagtactttatatggggtttgagttaatctatatctatgaagtaaagcagtacagtaaattgtaattttctgagtttttaggtggtaataaaacaaccttggagaacacctcaatgagcattactaaaatataatttaattctaatcataaacaggtgtatagaaagaaagagcactagtaaagattttatagccatgttgggagactgtatttagaaatgaaatgcatgcaccgattccgtggcttaattgcctgttaatgtcattgggaacattgccatgtacaattgtttgtcaaccttaacctcaacatcaccacgctacccaagtattttctaatatattctgttttggaagggtagctggtactttttcaaatgggatttttaaaaatcttcttaatgtaccgtttctgaagagccagttgttttgtgaagtgatatttagtagtgaatgtttgtaagtacttttataaggctacctagggatttatgccaacaagagaaaggtgcctcctctgggcaggtgaggcattgcagtaggatttaggaatgaatgagggcaagggaaaaacagtgctccttccttcttgtgagtaggccttgtttcagggtcatacaagatatcaatagaaatattccagtccctaaatctgtgcttattctaatatggccctgtagggaagctgatgtttggtgagcccaatcattggtcaggttattttagctcactaacgtttattttgttatttattttttaaatttatattgtgaagtaaattaactcttacaaatgtaaagatgacattatgagtgcgataaagatgacattatgagtatggtcagggacctagaaagtgttgtattctcatcatatatcacagtttttgggaaaaagtactttctaagtaaaggcctacagaacatttctgcagtgggtaacaccatcttccctctgtgcaatctataatacagctgtttggtaattcgaattagttttctgttgttgtgtaacatataataatatgatttctgtaggtcagaagtccaggtgggctcaactgggttctctacttaaggtctcaaaaggctgagatcatgtgccagctgggatgagctcttctccaatggctatgagattcttactggataataaactttccttcaaacttacatgctatcacgcaattttccctttatgtgtccctggtataatgcatattatgcatattttcattccaactctttgttaggaactacaaataaggcatcagtgactgcctaataaccaaaacctatcaatactttttaccttttatctttccgtcatttctttgtgacatttgactatgttcatcattcttttacctcttaaaattttctgtattttagctactattccagtatgttggtattgggtactttataatctttatcttaaagtatctttcaattaactcatgcagaatatattaataaatgatacttgctagtcagtgtggtattttagacaccagggatattgagaatattattttgcctttgaggcatttgagtgttattcataagacaaggtaagtagataattgcattatggaaaattactgcagaaagaggattttttagggataagagagattttttaggggctacaaaactggtagtttaatcactctaagaggatcagtgaaggtttcatagggaggataatgcatggattcagtcttgaggtgagggatgagtaaaggttgccctgcatattctcttctgattccaaatgtgtctgaatttgtgtattaggattctccagagaaacagagcgatagggaggatgcgtgggtgtgtgtgtgtgtgtaatgtgtatgtgcacatacacacacttacatatgtacatatattgagatctggaaatagattgataaatagagaaagagagagagaaagagagagggggaacaggtagatttattataaaaaattggctcacatgattatggaagctatcacatcccaaatctgcagactctgtatcccactttgagtctgaaggcaggcagactgctatagaaccagaaaaactcatgcaaaactgtgaagcaggagaattctctgtcactgggggggaattactttggttctagtcaggccttcaactgattgaatgaggcccactaacaatatgaaagactgtctgctttactcagtctcctgatgcaaatgctaatctcatccaaaaacacctagaataatgtgtaactatacatatctgagcactccatggctcaatcaagtccacacataaaattaaccatcacagtaccatagactgtatcatttgcaccgttatctgagtgatctttcacaatatctggatctcaaacctgactacacattatatttttgaatcacctcgagtgccatacccactgctcatctgagattctgagattcattttttcctggagaaggtcttcagcattttacattccaaaccagtagctctcaaagtgtgttccatgggaacaaataatgcagatcctcaggccttggcccagatctagtgaatcagacactctgtggttgaggcccagcgaccctggttgtaccaggccttccatctgtttctcattcatgctaaagtttaaggaccattgccctatatgaatccaatgtaaagttaaggttaagaaacattgtttctaaccacaatttgatttaaatcatagctccatttagttccaatcctatgacaaacatatgcacagagatacgtacacatttcctgattgtctaagaaataaactccacgtgtatcaatttccttaacaagactcagccctctctgttttcagcttaatcctctgaaaaatgtgtattacgcttttcatcatagtctccaaacaggccaggttttttcaataatttcataaccctttcatctttcagtgacctgttttcattttgctctgctttccaaagttatttactggtaagaactgtttcaaatgtcacaactgtaaaagtttttcaacaacttagacaaatgtacagtttcttttcttccacagttaaatgttctgcatgcattaagtataacacttattgcatttcattgtagtattttttcacctctatgggcttgtaaccatgtcaagtttagaaatctggtctaacttatctttgttcatcatagtattgtcaaatacttagtgaatgtcttggtgtatagaacgtggttagtaaattttgttaaatacataaatataatttgctcctagtttctccacccatcataccagctcaacaacttcatgattcactacacaatttattcttcatttaatgcaaatatcctatttaaccttgttctgtgcactaaatgtaaaaatttctttgacctggtcagttcaccaaaaggaaactctaatcattcattgcttgtataatagataaatttccaaaagagccaaagtttgggagatgatactttattgaaactttcaatgtgtctgaaagcttctgctatttccagaatttacaaatgaaacaacaaaaattgcatattgtatacattgcttcagctctctttttcacttgtggacataagagtccacaaaccaatgtttgtgttttctttattcattgagtctttttagttatttttttctcgactctcatgcaaacatatccaaagactagaatccacaaatttcaaatgtaatccaactgttaatgtcagataatagaaatgaaatttagtgtttgtgagtgtattccttgttgccctttaatatgaagttatttttggttagcagctgcatctaagaatataaaaacccgtcacctcggagtgagtatttttaagtccctgtagcttataaacattattttattattatcaatgtgcttattttgatgtatgcaatttgtcttccacaaatgtgtttgtattaccaatttcccttagcacacaaagagatcctaattagcacttttacttagctcgcgaagggaatagcacagaaagaaatcagtattgccttaaccaatgatcaaaagtaatcaaacaaaatgcttttcaggaatattgtgtatacatatatgtatcaatccattgccatataacagattacttcataatgtagtaacagaaaacatcaataaacaatagtgtgttacccagtttctttggctcagtaataagggaacagcttacgtgggttattcaggttcagaggtattcaagaggttgtcacccagattttgattagggctgtaattatttcaaaatgtgactgggccccagggagatgcttccaacatgtctcacttacataactagcaagttggtgctggtttttggcaaagaactcagtttttcacatcatggactccttcataggactgctgagtgtcttgattgtcatggcagctggccaactcagagtgagttatccaagaatgagtgacctgaaggcaaccatcttctttatgacctagcctcagaaattacacattgttacttctgcaatattgtatttaatattattaaatatggaaaaccttgttaaatatggaaagccattatacaaggatatgaataccaggctggaataattggtatcgtcttggaggtggctgccagaatttgttcgaatgtttttacttatatgtaaaaaagcacacaagtaaaaataattgaatttgttctcaaatttaaaagagatttattggctcatgtatctgtaaagtgtataggtaaattaagctatgagtttgctttgatcaggtatctgtctccaattctccctgatttttcatcttctgaattttttaacgtcacctttttccttcatgttgctatattatagtaacaagtaacaaattgtatgttaacttgtaacatggtaataagatgagtgacgctaaagttgggttcatgcattctcattcacaacctggggagataaattgtcattttacatagccattaaaaatgttgctgctttcagtttttttttaatgtattaatctcctttcactgccttaaaaatgtatttaatacatgaaatttgtccataagtggatgaattattgtaacaaaatgaaaggcatgtggacactgactcaggaccatcaggcctatatttttattattgctcatggttaactcctttcataccttttaggttctacacaataaggagcaatttgatgagacaatcacaatatccaccacatttacttaatgtgccaatacatttgatgatttattaattgcaatatcccagtgttagtatcatattgtaagacaattagaacaagtttctttattcaaaagaaacttcaaatcactcaaataattttacacagcattgctagatatttattttataggtttcctttcattaaatttctaatacctcttccaatttctttacatgtattgtatcagataacattgcttctccaaaaacttataaaataagagcaatcagaaaggggtttccatattcccgtgccatcctgtatatcaacctagctagtggatgttgatatctgtaaatatggcttttttcaggttcctgaaatgcactgtccatgccaagtctctggccactccttcacatgaccttatactgttcttatttgtttgctgtgagacaatgctctttctattttatcctgtttcctgaattcttactttttcactgtctaaagcatgcccctgtcctcaaaaacatgctttattttctatctgaaaataaaattaattcatgcaaagcaaacaaaacctgaaaacatctgttgatctaatattctcctccaaatacatctctgttatctcattcttttgactgaaaagctccttgaaataatttactctgttcacagtttgtactctcttttcttccatgctgttttaaatccattctaacaagactcttgactttgctacttcagcacaatcattctcaacctccatgttgcagaatccaaagcctaatcctattcctctactcaacaaagcatcaacatttgatacgattaacaactctttcaagaaaaagattctttctttggcttacggacataatatccttttgattaactccatccttcattggctcttctttctgcatgctgtttagttcctcctcgcttctctatgtattgaattgtgagacaccaagttttacactttaaatgtatcttgagttgttgccaaggtgatttcattcagtctcatggattggatagctctcaaattttaatctgcagctgcaatgttatttttcccctgaattccatattggccactttaatatctcctcctggaggtctcaaactcgacatgctgcaggtaaatctctgtaaaatctgatttctccctcaatcttcttcagatgtcttatctatctttggaatgatgactatagtccagattgctcatataaaccatgcagtcatttgtctcttctctctcatgttccacatccaatccattggaaacttttgtcagctatacctttaaaaactatttataagtcaactatttcctatcatttatctcacttccaccgcagttcgaacaactttcaccccttacctggggtattttaagagctttctttgggtcctaaccttagcttcctttgggctttgggtcttaatcttagacttcttgttattcacccagctgtcataatgttccttttaaaacataagtgatactacatactactaagtcaaatcaaatacttccaaataaatgaaaatatgacactcataatgaatgaaccaagatacaaacccaggcactcacacatatacaaatatcttgtcgaaagttaaagataaggaatgtcttctgttttcaccttagttctgggtaaaggaaatgaaaataaaaaaatgttaatcatcagaaattatgtataaggtacttcttaactattgcttcagatcatcttggtgtcaacaacccagtgacaagcataaatgcggaatattttcaataatttataatatttagtatttcaatagaagcaatacattgataaagtttatgttgttactaaaagttcattggaaagaactttgttagaatgatgcattagaaaaatgttgtcaaatggaagtctaacatttaaaaaaaaagacccaaaaaaatacattggctacaaatttaatgcctcagaatacatcactcttgttaacaagtcagctttcatggagagcaatttacatagtaaaattaccattttaatgtgtaaagtataatgaattttgcagaggcatctagtcactttccacaaccttcgtccacaaaagttaaagggatttctcttctctcacctccaagtcctggtaactacctatagttttgcctttttcaaatgtaatgagaatgacaagtagatactgtggacacctttgagtcattcttttcaggaagcttttgcgttaatgagtcaagtttatgagtcaagcttatgagtcattattttcaggaagccacacctggctaatttttgcatttgtttttaatagagacaggctttcaccatgttggccagactggtctcgaactcctgatctcagctgatccacccacgccagcctccctaagtgctgggattacaggtgtgagctaccgtgcccagcccaattttgtttgtgtgtgtgtgtgtgtgtgtgtgtgtgtgagaacacacattttaacttgtcttgggtaaatagccaggtgtgggattgtcaaacaaaataccatgttcgagtttatggaaacatgccaaattgctttccaaactggctatacaactttgcattaccatcagcagttgcttcacgtcttccgcatgtgttgccagggtatttttccccgtcattctaataagtatgtagtgacatcttattgtggtttttatttgcatttcaccacagagaaatgatgttgaaaatattttcatgtgccatctgcattttcttctttggtggattttctgttcaggattttgcaaaattttataaagttatttagatttttattgtttgaatttgagattttaatatatgcagatatatgagttaatcagatgttcatttttttgaatatattcacatatttgtgtcttatcttttcattttcttaatgaacgctgtatttagtgagtttttcaaagaacattttcttgaaaattacaatttattggaggtggagccaagatggccaaataggaacagctccggtctacagctcccagcgtgagcgatgcagaagacaggtgatttctgcatttccatctgaggtaccgggttcatctcactagggagtgccagacagtgggtgcaggacagtgggtgcagcacaccatgcgcgagccgaagcagggcgaggcattgcctcactcgagaagcgcaagggtatattgcggcactattcacaacagcaaagacttggaaccaagccaaatgtccaacaacgatagactggattaagaaaatatggtacatatacaccatggaatactatgcagccataaaaaatgatgagttcgtgtcctttgtagggacatggatgaaaccggaaaccatcattctcagcaaactatcccaaggacaaaaagccaaacaccgcatgttctcactcataggtgggaattgaacaatgagaacacatggacacaggaaggggaacatcacactctggggactgttgtggggtagggggaagggggagggatagcactgggagatatacctaatgctaaatgacgagttaatgggtgcagcacaccaacatggcacatgtatacatatgtaacaaacctgcacattgtgcacatgtacactaaaacttaaagtataataataataaaataaaaaaagaaaattacaatttattggcttttttatgttttttcttttgtgtttttttcgaataattctttgccaaacaaaaggtaacaaaaatttcctttattagttttatatatttaaactttgaggttttatatttatatctatggtttcctttgggccatgttttatatatgatgagtggtaagagtcaagtttaattttctttaatatgaatttacaatggatccaccatttgtcttaatgctatcattttctcaattaattgttatggctagtttgtccataaacccttgagcatttgtgtatttatcaatttctgggctctcattggtaccactgacaatgtatatactaatactacggtgctatgattgctatagttttataatgacacaaaatcagatagtgtgagttctcctacatttttcttcctcctttttgaaattgtttgggttattttagaacagtttttgttgcatataacttttagaatcagcttatcaaattattcaacaatatcggatttttggttggtattacactgaatctaagtttcaatttgggagcatggacacctcaatgaacaacattgagcattttatccatgagtaaacacagtatgttttcagttatctaggtcttttaaacatttctcaaagcaacatatgtagaattcagcatacaaacatttcacgtatttgttttcatgtttattcatgttatataagttagatgttaaaatcttcctttactttcattctgatagaaatatatgtaaataccgaacttgtatcctgtgatactgctagactgttttaataattctatttttttgtatattatatggtattttcttcataatcataataaatcttcatagataataaatcttcatagataataaatttgtttattttgcaatttacatcacttttatttcttttactatttactctaactataaccctaaagatagtgttcaggagaagttctgagagcatatatccttacatttctgtttatttctgatccttgggataaagcattcagtattcactgataagggtgatcatagttacagttttgttcaggttgagaaagttccttctatttgtaacttgctaagtgttctttatttcttgttaaaaatgtcatatttgttaacttttattatgtgtgtattgaatgtgtgcagtgaattatattcactgatttttaaatgttaaacaaccagtcttcttttcctaggatatccctcacttggtcataatgaatgtattatcaaagcctgagatagtcctggggctcagattatgtaagtctcttctcccagagagcattcttagcattatctattttcttttttatatattttattccattttacgatcctttgtgatggcaggccagttttaatcagttgctctttcctgactaaggtggattttttttttaagttctatttccaaaccagtcaaacttcttattgtaattatgtagtttatttaaatattaaacaaaataatgggatatacgcacagaatggattcagaatttgtgtaacgtactttaagttgaaagtttcccaagacttcataaaagagatttgctaaaattatgttccaattaaggagaacagttaggcaattataaaatctcaggtaattttatagaattagaagtgttgccacgcttagtgttttgaaagaatcttcaagttcttccctcacttagaatcaatcaattttgggcttcataaatagcttcataaataactcagtgtgttatctttacaagaatggtggtgttaaccccgaacagcaacaaatctgttctcagagttaggtccatactcctacattgagagattgcagtttgatgaataattatgcatttcaatatatttatacaaacatttaaaatatatatatcattatttttattaattattttacatagtagctgttttgctttaattaacattattatttttgatgttgattctatctgataaggaaatttttattataattagattgcacacccagaaaaagaaagaataaacttataatccattttgttagtaaagttctaagcagcattaaaaatatgattgtaattataaatgcaaaagacagcataaaagttcatcacaaggtaaatcctatatactctataaagataaaagatagaaaagttcacaggcgttatacacaaataggccaagatagaaaaaacatgttaaaactgaattattacaaaaagtagaaaataaatgttatatttggtagattttcttatataattgagtgggccaattgtgacattttcacaagaatagaatacatatttttcgtttactttataatcaatacaatttcttacattctctcaatgtaattactttcaactagaggtaaattactttgactttgtagttctggttaacggaacaaagtgttcattcctaacagcaaaggcacagctttaattttaaagcttctaactcctgttactctcaggtaataatattaatgatatatataaggaattattggaggatttataggcaactggaacaaaataatgtactgaaaagagtcaagattcattttaaataattcacttcaatctagaatttgtatgataactatgtaataaatgagagcacttactgtaaactgacaaaagttgaataaatatatgggataagttttatgtgatgtgtttctaaatgctttgtaatttttgaaatatttctacacgtgttatgctccttcctatgaaataacagaccttaaacacagagttggtttaatattctgttgcataaaattcacagaatgctttattttaaaactttttatatggatacagtaaagggatatttgaggagtaatttattatatatgatatacacctttcatataaattatagcaaattattttgaatacaatatttgattttttttactgatatttaaataatatatttaaaaaagagaaaaagaagcatattagtggcaccagcatgtaccagacattgtgagagttttacatataaattattgtttaagtagatttaatagtattataaagtagtttataatatgtattaattgatttagctcacttttttttaactaaaacttaatatgactttcatatacaagattttacaatggaaaaactactctcatttcaaatcaaacaaatacacttaagtggatagtttgttttcatttgagcacctgtttgcaaaacttattgttacatgtttattaaagaaaataatggaaacatatttgttaacaaacaaagcattaaccaagcacgttaaaatgtcccagcatcagcccacagtaagtattcaaaagaatgagagtaattttagttctaaattttcctataaggaaatcttttcatagaaatctaaatcagacagaccaaaaatacaatttataaaccatctttattctcatgggcatttatgaaacttagacagctataaatgtgattatttaagttcatattccctgtaaatttttattatagtagtagataagtcttttcattttgagtgaattttcataatgaaagcaataaaagcacattttaggaaaataatctgcaatattatattaacctatttatatatttgacaaatatttttaatactaattttcgaatatgaataatcagattagaaatctaccaaattccctagaaggcatacactcatagacatgatttagattgtttgggtggcacatatttaaataataatggctttgggctaaaagtaaattaaagatttaagtcatgatatttaagaaaaaattagtatttattttttccattcaatgtccataagtgggaaatctggaagaatggcatattttgttgttctgtgttctccagagcccatcatagtgttacgcacatatcagtctttccaaaagtaatcactggataaaatgtattgtttctcaagttataaaagatcttctacatattgtagcatacagcttccacttgcactgcaatagcactttctctgtatcactatctctagagggggcactctgatgacatgagtccctattgtattaatgttgcataaagcacagatgatttttatatagcatagttggtgctggaaaatacatgcatatattttggctttgtttctattttaatattcagaaattattaagatgtacattctgctttttcccaggctcagtattataaagttgacatagttaccgttaattgtttctcaaaaacacaacttggcaagttaaataactcttattataggcttacaaattaaataattaatgcacatcaataaattgcaaataatttattgaagttctgctcctgaagagtgctgagaatatgatttatatttatgtttgcatgatttcaatatattttatttactctgctgtcaaaagaatatgaaaattgttttctagaaatgaagcataaatataaaaattataataacaataatagaaatagtgctttaaggtcttaaggaattatccaattttagccttagcaaaatgcttgtaaatcccatgaataggtttacattttataggtagagtgattgacatttaaagggtaaaatactgacccaaggacacaagaaataatatatagagacccatgggtagttttcagttcacaactacagaaatatctcatatcataaaataccagaatgctgcaagaaggctgtgagtggctataaagtgacagtgagttttcactcgtaattgtctgaaatcacagccacatttttatacatcatcctacttttagtaacagacagcagttattgaatttgcaccagaaattactttaaatttactctaacattttgtttttcgtaattcctgtggttgcccctgacagggcaggcagtatcatgagtcacatgctcaataaggtaagattaaattctgtttcctacaggacactgaatgatagtaggtatatagacgaaactgatattaccctgatcccaaatgctatgcttttaatcattgttacagaatagtgattgtacattagggatgtaaagtaatattgggtcataatggacagagtctatgttgaagcagaaggatttagcttcctgtgcccaagtgtggaatgcatgaaaagacattccagtcccaggggaaagctgcaacaaggcagaggtaggacagtgagaggtgacagctgatagcagtcaactgcttgcttgttcttttattcaaattcctcctcaagatatggtttttccagaatcctttcatagaaaacacagtttcttacttcactggagttgcttttaaccctgccttttcagaaaaagagcagagatttggccaggcgcggtggctcacgcctgtaatcccagcactttgggagaccgaggccggcggatcacgaggtcaggagatggagaccatcttgtctaacatggtgaaaccccgtctctactaaaaacacaataaattagccgggcgtggtggcgggcgcctgtagtcccagctactcgggaggctgaggcaggagaatggcgtgaacccgggaggcggagcttgtagtgagcggagatcgcgccactgcactccagcctgggcgacagagcgagactccatctcagaaaaaaaagagcagagagttacttactcaggaacaagtaaggttgctgatacctatgactagagcttacaaaattattcttaccccagatttttaaaagagattgcttttgtctgcttaaaattgggagatacaggaatacataaaatcttttatgatatgtagaatagaaaatatatatgtatgtagtggtaatagtcaaaagaagtagaatataaccctttgctgagataaatcatttaaactgtgtcaatttcaattttttataatttataaaataagcattttgactaattattatgttagttttgaaataatgtaataacaaaataaagtgatatttaatgttagtttctaaaagaagttttagcattttcatgataagtaaacatatatttaaagcaagtaatttaatttaatgtatatattcatttatcaatataatatataattaatataataatatacaagcatcatattatcttttactataagtagataatcagttattaactatgccaatataaattatatatgaaggtattaatatattactttcaagatgtcataactttttaacatatatataatgtaattcttgatatctacaaagatgttgcaaaatacaataataaacagattttaacacatctctgtacttaagaattagagttacaaaagcattatcctaaacattatcttattagttttacagtataatatttacttttacgtgttgttttctatttttacaaaattttacaatacttgaatgcagtcttctgacacatttctgagaacaacaatttgtttctaagattgcttcacatggtggctgtgttgttatttattttctgtatgatataaatgcatcaaagttttgtatccattcaggagttgttgaatatttttattttcctattgtcgttgttgccattaattgtactgatagtatgtatattcaagagttttcctataggtataaatcagggaaattacatcatctagagcatgagaatatacaagttattccttatgagttaactttataggcctttctttgtctatattcaatccagcatttggagaaatcttgccaaacttcttagtattgtgttagtctggcttatgttaagtgataacttattttgattaacctactttttttcatactaatgagactgattttttttcatgtttattttttatttatattatctcctattaactgttggccattaatatttgcctatttttatattgtgttggcttttaaaattgtttcaatatgttaaattatatattacagatacaagtcctttgtcagttacgtgtgccacaaatgtgttcacccaaattgtaatttttttcctcttcatgatatatttggagaaaatgagtaagaaatcatgttttagtgcaatcaaatttatcaattcttccttcttgttttagtgaattttgtgttttgaaattgtgcatgtaacttaagtgcacatattaatgctaaccatttttcccaaaatatgtatgattttgccttatatacttgtctttaataatttaaaacatgtttttgtgtaagtgtaacataagatcaatgtcattattcttattgttactactactattattattatgtgaataacaagttgtactatttattgattaacccgtacgttcaccattgatctgtaatgccatcatcaccatatattaaatttctatgtatagtgggtctttggctgggttctgttttgtgtttctgttctgtttgtctatccctgtgacatagtcgtagggtgttaagtgtagtaagccttgataaatggtacagcaactctccttttttttttttttttttttttgagaaggagtctcactctgtcactcaggctgcagtgcagtggcgtgagctcagctcgctgcagcctccgcctcccaggttcaagtgattctcctgcctcagcctccccagtagttgggagtacaggcatgcacaaacacacctggctaatttttgtatttttactagagacgaggttgctccatgttggccaggctggtctcgatctcctgacctcaggtgttcctcctacctcagcctcccaaaatactgggattacaggcgtgagccaccatgcccggcgtgcaattctgctttattcctcttcttcatacaagtctgaattatcttagtgtttataaatattagaagcagttttcaattgctatgaacaactttcattggatttgtattagattacattggaaataccatcaatctggatggtatgtccttatttgtgacattttgtctctttaaccgcagacgtaatacagctcttaatatctttatatcttttttaatgaaattcagtaaagtattctgcatatgggtctttcatatactttgttagatttattcataggttcctttaattcttagatttttcaccattaagaatgatgtatgatgcaatttttcttgtcatttgttgttttattggatggtttttagaatatatgaatattgcattttattttttgtatttcttaatatgttcttgagtgattatgtatatgctttatcatctttcatttaattcactaacttgtgaataacttttattgtatctttatgaaaatttacttcttttctgtacctcttccgtctttttttgttgagctaaacaaacattcctgggacaaaactgatcaagaattatcaagaacaactcagtggagtgtgtttactattattttgtttaggcagttgacacttaatatgtgtcgtgagtggtagtgtctagtattggttccaaagtttcacaagcaaaataaataaataaataaataaaaattttgaaatatttcctctttcttatattttctagggaaaaaatgtgtagactgtaattacctgttactttaagtaaaaaatctgggacaaatttttttctctctttgcaaaaattaactttttactgaaaaatttattttctctagttactttaatacagcactacttagattttctatttattttagagctacttgacactttttaacccatctattttcttactatcatgaataacttctctataagtatttattccctttttcccaatattgttgtatcttttttactagtcttattattaatgtattgtatgttgttacaatttaaatttgaattgcttcagagaatgacagatacattagcaaagagaaagccagacagagagatttaatttgttcattatgtattctgaatctctagcttggacttgtaaaatataccagacatttatgtttttgttacatctcagaattaataaacccactgaaaagataaaaagtcttagtttaagatgtttttgaaactattgaatatattttgatatctacgagagttacatgtaaattgcatgtatgaatctcatgctaaattttgatttcaattattatttatttttccccgagcgtgacttaacatcacactctgcatatattctgccataagaaaatgattctttgtgtaaagaaatttattttttgttttctttgagtttagttagatttgaacattaaacttttttaaagattaggtaattattttttaccaactgctgtgtttttcttagattaatgatgaaaccaattgttcatcctgtagactctgacagcatacaatgaattctgacaactttctcccactcaagttcctgataacatgtaatttccttgatatgacaaaatatcattttggcattcatgtcatgccatggtgttcatttttcattttcctgtaagttaatgagttctagcaaagagcgccttcataaagttgtcgtttgccaaaagtccagctatggcatatggaaccagtgacaagctacagtattaaagagatttgttttaaaccgagcctctaaagtgtgcatggaaatactaaatacattcctgtgtattttgcagataatcctgatttgctgagccatgtcacagtgggtattagagttctggatgtcaatgacaatccacccgaacttgccagggaatatgatattattgtatgtgaaaattctaagcctggccaggtaagttaattgtttccttcctcctcatttgaatggaataaatgcaagcgcctttatttttattattcttaggtataatcccccaaagcccacagtgtaattttgtactcagtggaaataatttcataaagctttattttaagtaccaaataatttttggagaatcaaagcaattgaattttctttggatccgaaatgtaactcagaaaaatgaattcattcatgaatgctgcacaaattataccaataaaatgatattgaatgctttatgtccaaccctactttaagtgaggaggaaatagcaaacgtttctctcttaatgaggttgatggacttgattgtgtcagagggactagctctattttggaggatctgcaggagtgacacaggaatgatgattgagtgatgctgatgctaaacgatgattcaattttagaaacatgaagagtatatatgtattaatagggtggtgagagtgaagatggatctggatcatggggcaagaggctggatgtcatgtgcatctagtcaaagaagcatggcaatttggaaggctggttgcctatagcaaatagagcaagtaggagactgaaaggggttgtgcatttgtttttctgctgtataagaaattatacaaaatccgcaacttaaaacaacatgtatttattatctcacagtttctataggtcagaaatttgtgcatggcttagctgggtctttgcaagagtctcgcaagactataatcaaggtgtctgctagggctgttttctcgcccgaggctcagggatctcttccaagttcatagggctgttgggaacattcagtttctttctgatacagacccgagaaagtcaagactttcctttactcctcaaggctgcccatatctctgagataccacaagcagttgcttgccatttggacctccccaatatgtccagttatttcatcaagcaaataagaggagcaagcctgcaggcaaaacagcctcatataatgtaatgtaatcaagtgagtcatgcatcaacacatttgccatattctgttttcagaaccaagacacaggtcatacccacactgaaggcagagggattacaggaaggcgtgcattccaggagcagcaccttaaaatctatctgctgtggatgaatccagaagtggaaagggtataggtcaaaatatgccctttctgagtcaaaagtactctattattgtctttagtgaacccaaatgagtataccttcccaaatcatgccaagtcattttgaaacttgtgctgaaattatactcctgagaagcatccttttttgtgtttatgtatgagggacaattgtgaggcttgctaaagtaatcattacctatttgtttttagtcccgtcagggaaaaatatatgtctatctcaatgtctggctttgtaacataaagcttttttcatgttcactgttgttaaaataaaaaactctagacataatacatttaaaagggcttatttaagcaaaaaatgagtaacaaattgggctacactcacaatcagaagaagtttaaagagctccatccagcagtgtgagcaacaggctttcaaaggctgaacacagaagccaagtagagaaattacctgaccgggtacagctaggcgtttgctttatttgggcattagtgaccagttggctgtcttgtaattgcctgaaacccagctatttgttactaaaattatattcctaaattaggtttcttttagttggcataatgtattagtcagagttctctagagagacagaactaataggatagaagtatatatgaaagggagtttattaaggagtattgactcacacaccatcacaaggtgaagtcccacagtaggccctgtgcaagctgaggagcaaggaagccagtctgagtccctaaacctcaatattagggaagccaacagtgcagctttcagcctgtggccaaaggactgagatcccctggtaaaccactggtgtaagtccaagaatccaaatctgaagagcatggagtctgatgttcaaggtcaggaaggatccagcacaggaaaaagacgagggccggaagactcagcaagtctgctcttccatcttctgcctgttttattctagcctgtctggcagctgattagatggtgcccacccagattgagggtgggtctgcctctcctagtccactgactcaaatgttaatctcctttggtaacaccctcacagacacaccaggaacaatgctttgcatccttcagtccaatcaagttgacactcaatattaaccatcaaacatatttaggtagcattttgttacacagaaactaaaaatgcaatgatagcctcaggctgatatggcctcctacttaattaatttaacatttcccatgagaaaattagaaatatgaatgaggacacagtaaagttatacttgaaagcattgtgcagtttatataatttattcacttaaaatattaagattattattttatatgcttaaatatttttctatgcactgatttcaaaaccagtaaatacttttatagtataaatatattattaaatattcagcaaattttatttcaattctattaaaaatggatgcatacatcctaacataatgttcttgaaatacattataaaagcacagttgatgaaaaaatattaaacattctaatggaaaatttaaatttaagaaaatacagtatctcaattactggtaataacagcagcttagacatagtgcaagaaaaataagggaactggaaagtaagtcagaataaaaaaatccatgttgaagcatggaaagaaaaagaaaatataaataagagtatgagagacatatgggacatgcaagtgtaatataaaagtttttcaattctgagaggcatatgagagagaatgggactgaaataatatttaagatgattatagctgaaagttattccaaattgatggaaatatcaagccaaacactcaagaaacaagagaaacaaaaccaccaagcatactgcctacaaaggtaaatttgcctcagtgcactaaagtaaaatattagcaaaagtaaaagcagcaagagaaaaaagataggtgataccacaatcaaaatcacaggacctaagataaagcaaagcattctttgacttgaccccaaaaagcatgatccataaaaggaaacagtgataaattgaatttcatcaaactttaacagttttgctctttgaaaaagatgctctttgaaaaagtctgttaagatgataaaaaaaagacaaactacagactttctacttatagtactatagtttcaaaactcaacaataaaaacagaagataaaatccaatttgaaaatgggcaaaatacaagagcagacatttactgacaaggacatagaaagagccaaccagcatataaaaagatattccacatattttttaaaaattatttctattcacattaggtaaatagaaattaaaactacaatgtgatatcgctacaggcctagcataagagctaaactttttggtaaattgtggagaaattaggtcatttctacatcattggtgaaagtgtaaaatggtactgctactgggaaacatattttgacagtttcataaaaaattaaatatgcagctaccataaaattcagaactgcatttttgggcatttcccacagagatatgaaattttatgtttatacaacaaaatgtgcacaattatttatagcagttttatttataaaaaacccagactggaaccaacaaagacatccttcaataggtgaatggttaagcaaattgtggtgaattcatagatagagacacaaaaaaccttcaaaaaatcaatgaatccaggagcttgttttttttgaaaagatcaacaaaattgagagaccactagcaagactaataaggaagaaaagagagaagaatcaaatagacacaataaaaaatgataaaggggatatcactaccgatcccacagaaatacaaactaccatcagagaatactataaacacctctttgcaaataaactagaaaatctagaagaaatggatacagtcctggacaatataccctaccaagactaaaccaggaagatgttgaatcgctgaatagaccaataacagcctctgaaattgaggcaataattaatagcctaccaaccaaaaaaagtctaggaccagacttattcacagccaaattctaccagaggtacaaagaggagctggtaccattccttctgaaactattccaatcaatagaaaaagagggaatcctcccaaactcattttatgaggccagcatcatcctgataccaaagcctggcagagacacaacaaaaatagagaattttagaccaatatccctgatgaatatcaatgtgaaaatcctcaataaaatactggcaaaccaaatccagcagcatatcaaaaagcttatccaccaagatcaagttagcttcatccctgggatgcaaggctggttcaacctacgcaaatcaataaatgtaatccatcacataaacatatccaaagacaaaaaccacataattatctcgatagatgcagaaaggcctttgacaaaattcaacagcccttcatgctaaaaaactctcaataaactaggtattgatggaatgtatctcaaaataataagagctttgtatgacaaacccacagccaatatcatactgaatgggcaaaaactagaagtattccctttgaaaactggcacaagacagggatgccctctctcaccactcctattcaacatagtgttggaagttctggccagggcaatcaggcaagagaaagaaatagagtatttaattaggaagagaggaagtgaaattgtccctgtttgcagatgacatgattgtatatttagaaaaccccattgtctcagcccaaaatcttcttaagctgataagaaacttcagccaagtctcaggatacaaaatcaatgtgcaaaaatgacaagcattcctatacaccagtaacagacaaacaaaaggccaaatcatgagtgaactcccattcacaattgctacaaagagaataaaatacctaggaatacaacttaaaagggatgtgaaggacctcttcaaggagaactgcaaaccaaccactgcttaatgaaacaaagaggatacaaacaaatagaagaacattccatgctcatggataggaagaatcaatatcatgaaaatggccatactgcccaaggtaatttatagattcaatgccatccccatcaagctaccaatgactttcttcacagaattggaaaaaaactactttaaatttcatatggaaccaaaaaagaacccacattgccaagacaatcctaagcaaaaagaacaaagctggaggcatcacgctacctgacttcaaactatactacaaggctacagtaaccaaaacagcatggtactggtaccaaaacagagatatagaccaatggaacagaacagagccctcagaaataacaccaaacatctacaaccaactgatttttgacaaacttgacaaaacaataaatggggaaatgattccctgtttaataaatggtgctgggaaaactggctagccatatgtagaaagctgaaactggatcccttccttacaccttatacagatattaattcgagatggattaaagacttaaatgttagacctaaaaccataaaaaccctagaagaaaacctaggcaattccattcaggacataggcatgggcaaggacttcatgactaaaacaccaaaagcaatggcaacaaaagccaaaatagacaaatgagatctaattaaactaaaaaccttcagcacagcaaaagaaactaccatcagagtgaacaggcaacctacagaatgggtgaaaatttttgcaatctactcatctgacaaagggctaatatccagaatctacaaataacttaaacaaatgtacaagaaaaaatcaaacaaccccatcaaaaagtgggcaaaggataagaacaaacacttttcaaaagaagacatttatgcagccaacagacgcatgaaaaaatgctcatcatcactggtcatcagagaaatgcaaatcaaaacagcaatgagataccatctcacaccagttagaatggcgatcactaaaaagtcaggaaacaacaggtgctggagaggatgtggagaaataggaacacttttacactgttgatgggaatgtaaactagttcaaccattgtggaagacggtgtggagattcctcaaggatctagaaatagaaataccatttgacccagtggtcccattactgggtatatacccaaaggattatacaccatgctactataaagacacatgcaaatgtatgttcattgcagcactattcacaatagcaaagacttggaaccaacccaaatgtccatcaatgatagactggattaagaaaatgtggcacatatacaccatggaatactatgcagccataaaaacgatgagttcccgtcctttgtagggacgtggataaagctggaaaccatcattctgagcaaactatcacaaggacagaaaaccaaatactgcatgttctcactcataggtgggaattggacaatgaaaacacttggacacagggtggggaacatcacacgctggggcctgtcatggggtgggagaatgggggagggatagcattaagagaaatatctaatgtaaatgacgaattaatgggtgcagcaagccaacatggcacaggtatacatatgtaacaaacctgcatgttgtgcacatgtaccctagaacttaaagtataaaaaaaaaatcatattgcaaataaaggaatgcacttctaagtaacttaatattccatgaagaagaacaaacttaaatgaaaaaacaagttccatgaaatgataatgtaaataagtccatataaaaatttctaggaaacagttcagccataactaacaggaaatttataattttaaatgcatataataaagaagataaaataatgcaaattaaaagcctaagcattattcttaagaagttagaaaaataaatcaatttaatccaaataaaatagaataacaatttatgagatgaatttaatgacatggaaatgaaccaaaagaaaacattgaagagttcacagcttagttatttgaaaagacagataagtccctggtaaattgttaaaaacaaaagagagaaatagaacaaatgaagaatattaggaaaaaatcaagaggcttaccgcctcttgtaactatagactttacagatatcagaagccaattgtatattacaatgtcgtcttttactaaaatttgaaagtttagacataatgcatatatttttagaaaagtaaagtttgtcaaagctgacacaagaatagatttagctgggcttggtggctcatgcctataatcccagctacttgggagtcttaagtgggaggatcccttgagccctggaggtcaagtctgtagtgagctgtgatcctgccactgcactccagcctgggtaacaaagtgagaccttgtctcagaaaataaataaatataaataaataaataaggactgattaaagttgtatttattaaattcattaaatatataaataaaaacctttccacaaataaattctcttctcatggctttaatggtgaattctactaaaaatttaagaaaaatcatgacagtaattgtaaaaggtattcaagagttcagaaaaagggtggcaggatcatttttgtacacattttatgatgccagcataactttaacatcaaaaggtataagtggaattatagctattctctgcacgatcatagatataataaatgtcataattaaaatatttgtaaaccatataaagcaaaaaaggatagtattttaaaaagagacgatgaaaaataaaaacctacctaatcaggagaatccaaagcatttgtgaaaattcaacacccattaataatagcaacaaccgtgacaatgctgctatacgcaggtagaatttttgaatgacattaacaaatttgctaaatatcaggtcaatataaacatgttatttagagttctcataccacaaacaattagaaaattaagttgaaacactagaccatttgccattacattgaaaataagacacctaagagtaaatgttacccttgttagcactcaactactgtctctctagagggcaactcttaaaacttaggtcctttgcctcagtggatctttatttccatgatttttagattactcagagatctaaaaattggtaaattaaaaatatcatttgaaatatgatttaaagaaccaagcatgggcttatgtttgcatcagacattgttttcggactaattataattttaaaaattcatttaaataagcatatagattgtatttttaaatttcaagatcatttcaaagctttaaggttaaagtatattctcataatatggcacaacaatggttgctagtcccatgctacctatgtagtctgctgcaaatctaggccaataacacccagcccttgctcttggcttaattgatacttattttctctgaagcaatgggctgagctgtgtattggccccttttagctatgacttggatgcagggcaccaagtcctgcacaaagcagcatggtcctgggctggcccacaaaaacagtttttcctcctaggcctctaggttggtgatgggaggggctgccgaggacacctctgacataccctggagacattttctccattgtcttggtgattaacatttggctcctcgatacttacacaacttgaatttctcctcagaaaatggttttgtcttttttatttcattgtcaggcttcaaattttccaaacttttatgctctgcttccctttaaaacctaagttccaaattcaaaccatccctttgaaatgcataaaactgaatgattttaagagcaccagggtgctctttgctattaaaaatttcttccactagataccctaaatcatctctctcaagttcaaagtttcacagatccctagagcaggggcaaaatgccaccagtctctttgctaaagcatagcaagagtcacttttattctggtttgcaacaggttcctcatctccgtcctcagcctggacttcattttagatatcactatctgcattttcgtcaaagccattcaacgagtctctagaaagttccaaaccttcccacgtcttcctgtcttctaagccctccaaactgttccaacctctgcctcttacccagttccaaagtcaatttcacattttttggtatctttgtatcagtgtcccactctccgtggtaccaatttactgtattagtctgttttcatactattaagaactgcttgagacatggtaatgtataaaggaaagaggtttaattgactcacagttcagcatggctagggaagcctcaggaaacttacaatcacgggggaaagccaaggggaagcaaggcaccttcttcagaagcctgcatgaaagagaagtgctgagagatgggggatgagctgcttataaaaccatcagatcggctgggtgcattggctcatgcctgtaatcccagtactttgggaggctaaggcaggcagatcatctgaggtcaggagttcaagaccagcctgcccaacatggcaaaaccccatctctttcaaaatacaaaaaattagctaggcatggtggcaggtgcttgtaatcccagctactcgggaggctgaggcaggagaatcgcttgaacccaggaggcgtaagttgtagtgagctgaaattgcaccactgcactccagcctaggcaacaagagcaaaacttggtctcagaaaaaaaaaaaaaatcagatctcctgagaactcactaacaggagaacagcataggggaaagccaccctcatgatccaattacctccacctggtctctccaggtaggggttatgtgggattataatgtggggattatggggattataattcaatatgattttagtggggacacaaaacctaaccatatcaaaaaggtaattactacacttagcatttgacattactacccttctaatattttgattaagttttgtaagttgattatgtggttactcctttttgcactttaaaacactatacatttagctaccattgttgcctttaacattgaatagttttagatgtgattataagataattgaacttattatgctgttgcttgtgtatttgttttcacctcttccaccaaaataactttaagctttaattgatgggagaaaagattgtttgtaagtgtagcttgtggcatccacatttagacaaatcattaccagtgtatgtgctctgcttgtgagattaacccattacagagtgaaatggcccgaatctgtattctttagtttcatagtgtttgactcttttaaccatatcttgaaaacacttttgaagaaatccgatgcatcctgatgcagagttggaataagaaactctatttaaacaacaattggcgaaatcagttttctgaagtgtatttgtattgccaggctgtgtgactgttcctctttcaatgacaattgcttttcaaattacggatatttctattatgaatgctgcacatctaaacgtatcagcatgtagctatgtcaaagagattggctttttatgaaagtttaagccccgtataacagcagagttcaggtaaatagagatactaatgtaaactgcaacaatatagttctctaagttaatatattttcctgttctgaaaaaaaaaatcttttagtatgttgcctgagaaaaatattaaaaagaaaggcatgcatgcatgaaatttgaagacagttcccaaagtagaatgatttaagaaaaatttagatatgcctaaagtggaaacattgaaaaaataaagagagtctattctattttatgcatattaaacttcctctgtattctttctttcattagaaataaatgtacaaaaataacacataaaagaaattttattacataacattctctgcttccaccacatacaattattaaccatatagctttgcatgaaaaaattaactaggtcaatagagattctttactgtcaaaaatcaagctcatttaaataacaaaagttgatgttatcaaataaatgtatgcagatactattaacgattatattatgaagcagatgcattgactaaacaggacactatgtattttagaaaaaattattttagatcgagaggttacatgggcatttttttacatgggtatgttgtatactggtggggattgggcctgtagtgtatgcattactcaaatagtgaacattgtgcccaacaggttatttttcaacccttgccccttcccactctctgcccttttggagtccctgttgtctattattttcatctttatgttcctttgtccccattgtttagcttccatttataagtgagaacgcgtggtatttggttttctatttctgagttaagaacattcttggccaggcgcagtgattcacacctgtaatcccagtattttgggaggccaaggagggcagatcacttgaggccaggggttctagaccagcctggccaacatagcaaaaacccatttctaccaaaaatacaaaaattaggcatggtggcttacacctgtaatcccaactactcggtggctgagacacgagaatcacttgaacccaggaggtgaaggttacagtgagctgagattgagagatcgtgcctctggcactccagccttggttacagagtgagtctctgccacaaaaaaaaaaaaaaaaagaaaagaaagaaagaacttcctttttaaaatgcttaagccaagcaagttcatttgccaaaactaacattatggtattagattagacaaattttatatatttgtgatactgacttttccctaataaagtactctaattaacagtaacagtaacagtaactctaattaacagtaacagtctgtctcaattaacagacaattgaaagtatatttttaaaagtggatacatctatttgtagatatcaaaaatactccctggtaattatttataaatagcaactgtctattttttttcaccctttgcttttgtaatgtagactaaatttgtaatatcatttatttgatatctttaaaaataaataaccattctatgtattaattagatcatgtatatgtgataaataacatttgggttcaattagaagacacatgaatcaaaaaagatattcttagggattttatattactaaagcaattggacaaagaaatagcaaggtaacacagtggatataaatcagaattctgacaaagggatagaaaatttgatgatggaaacctggcaattatctagatatctgccagaagtttataacttctaaaaaccataaacatgttaagttcccaggtatattttctaaagaaagtctaaggtaacaatgaatgcaaattctattacatgatgaaagagacaaggtgatttgtaaaacagaaatattgaatatgccaatacagagcagagaccaagcaaatattacagcattttggacaaagtcagactgacattctcgtttttggaagcttttttttttttcagaaatacgattaataaaaattgaagcttacatacattatcaacaactctgtaagagttcaagatgattgggacattgttaaacaagacatgataatcaaatcctcattttttatgtagagactaggagtttctctcttcttttttttaaattatactttaagttctagggtacatgtgcacaacgtgcaggttggttacatatgtatacatgtgccatgttggtgggctgcacctattaactcgtcatttaacattagatatatctcctaatgttatccctcgcccctcctcccaacccacaacaggccccagtgtgtgaagttccccttcctgtgtccatgtgttctcattgttcaattccaacctatgagtgagaacatgtggtgtttggttttttgtccttgcgatagtttgctcagaatgacggtttccagcttcatccatgtccctacaaaggacatgaactcatcattttttatggctgcatagtatttcatggtgtatacatgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggcatttctagttctggatccctgaggaattgccacactgacttccacaagggttgaactagtttacattcccatcaacagtgtaaaagtgttcctatttctccacatcctctccagcacctgttgtttcctgactttttaatgatcaccattctaactggggtgagatggtatctcattgtggttttgatttgcatttctctgatggccaatgatgataagcattttttcatgtgtcttttggctgcataaatgtcttcttttgagaagtgtctgttcatatcctttgcccactttttgatggggttgtttgcttttttcttgtaaatttgtttgagttcattgtagattctggatattagccctttgacagatgaggagattgcaaaaattttctcccattctgtaggttgcctgttcactctgatggtagtttctttcactgtgcagaagctctttagtttaattagatcccatttgtcaattttggcttttgttgccattgcttttggtgttttagacaggaagtccttgcccatgcctatgtcctgaatggtaatgcctaggttttcttctagggtttttatggttttaggtcaaacatttaagtctttaatccatcttgaattaatttttgtataaggtgtaaggaagggatccagtttcagctttctacatatagctagccagtttcccagcagcatttattaaacagggattcctttccccatttcttgtttttgccaggcttgttaaagatcagatgtagatatgcagcattatttctgagggctctgttctgttctattggtctatatctctgttttggtaccagtaccatgctgttttggttactgtagccttgtagtatagtttgaagtcaggtagcatgatgcctccagctttgttcttttggcttaggattgacttggaaacgtggactcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctattttatttcattgagcagtggtttgtagttctcctttaagacgtctttcatgtcccttgtaagttggattcctaggtattttattctctttgaagcaattgtgaatgggagttcactcatgatttggctctctgttatgtgtgtataagaatacttgtgatttttccacattgatttgaaatggataaattccttgacacatacaccctcccaagactaaaccaggaagaagttgaatctctgaatagaccaataacaggctctggaattgaggcaataattaatagcctacaaaccaaaaaaagtccaggactagatggattcacagccaaattctaccagaggtacaaagaggagctggtaccattccttctgaaactattccaatcaatagaaaaatagggaatcctccctaactcattttatgaggccagcatcatcctgataccaaagcctggcagagacacaacaaaaaaagagaattttagaccaatatccctgatgaacatcgatacaaaaatcctcaataaaatactggcaaaccgaatccagcagcacatcaaaaagcttatccaccatgatcaagtgagcttcatccctgggatgcaaggctggttcaacatatgcaaatcaataaagctaatccagcatataaacagaaccaacaacaaaaaccacatgattatatcaatagatgctgaaaaggacttttacaaaattcaacaatgcttcatgctaaaaactctcaataaattaggtattgatgggatgtatctcaaaataataagagctatctatgacaaacccacagccaatctcatactgaatgggcaaaaactggaagcattccctttgaaaactggcacaagacagggatgccctttctcaccactcctattcaacatagtgttggaagttctggccagggcaatcaggcaggagaaggaaataaagggtattcaattaggaaaagaggaagtcaaattgtccctgttttcagatgacataattgtatatctagaaaaccccatcgtctcagcccaaaatctccttaagctgataggcaacttcagcaaagtctcaggatacaaaatcaatgtgcaaaaatcacaaggagtttctctcttaaaaaaacacgattgtcatatgtgagctttctgtttaattcgcatttgaaattatctgtaaaaaagtgaaaaagatgccttacaaacacaatagaataggaattatatcagagtttaacaggtataataagctcatatttgtaaaaatattaagaaataattaaaataatttgtatactaactgaaatgtatagtaaagaaaataataatcccacagcagtgataacagaaaccataaactggctcagttaactcaaatgaaatattcttcaccaatcactccgaaattcgattcttggataaaaagtaaacttgcaaatgtatcactatgttatgaggtatgatggagaaaatagggtcacacactggagaatcactaaaattcaagagcaaggtgagagaacatttgttttataaagaaggggaaaaaagaggtaacattatatatttgtatgtgttggaggaagtgagggactatgcaatgcctgcttaaatatttatttaacccttaaaaaacttaaaatattgacattttatttcaattttgtattaagtaactaatgtctagctaatgtatatatgttcctcagatgaggcagcactggaatttttacaatatatctgattatccatcaatgtattcccctactctaagtgaaaacaaggggaaaaacaatctacccagagactagttgtattcaaataaaaaaaaaagattttcagcttataaataaatatggagggaaatcaagaaggatagagacttatttggagatggaggcaggggtaaggagcacataggatcttgctaaacatgtatcttttgagcagtgatggaaaggcggtgaaagagtgagcccagtaaacataatgaggaagttgatctcttctgtatcctgaagtactttcttcactgtcacttcatgaaaacacatgcttttctggtgttactgtcactcacccccacttctcagtacttttattttcctcctcatctttctgacaaactaatgggctcagaacacgcagagaaatttaagttttaactgtgatatcctttggtgaattaccttctttggaaaatattgaactggttgaaattagttataatgttctaagaaatgatattagttcaatgtatttcagaaacaggaaatattattttcacagctctatcttctctctctttgtttctcgtttttctaaggaaagggttgaatgaagacacctaagcattatgataattttcaaaagaggaaaatatctttttgtctgtttattttgatatttattttttaagagcagactggccatacctattgaaatgcacgttcttctcttgggccaccataaattctaacttactctgctttttagtgtacattaagtccagattctaaagaattgctttctcctgagcactagagaggagaagttattcataaatcacggaaggtcttgtttagcctctgccattattttagacatttggggcacctcaccatccttccaggattcaggctcctcgtctgtaacatacagggactagatcatgatcttgaaggcctcctgaaaaaaataataaaaccaagactccactgttcttgcatttactacttagaccaacatacagtgataagctattctgaatcaacactgggatatttatatttatgcaaacaatactttatgtctcctccaacaggtattcatgtgaaaacattgcatctaattgaccccacagtaccatggctgattaagaaaaaaaaaatcaatgcgtttgcaatgctagaaaataaagtgtgatgaatgtttagaaattatatactgtgtttttcctaaaatctaatgcaggatacagcaatttagttgattgttttatgacctgaatttgaaaaataactcaagttggaagaaaagatcctttaaaaatatttttaaacagaaataatacagtgtaattaaaatcaagagaacaagcaaaattaaatttacgatttagagtttgtcttttctttaggttattcataccatcagtgccactgataaagatgattttgccaatggaccaaggtttaacttctttcttgatgaacgcctgcctgtaaatccaaacttcactctgaaggacaatgaaggtgaacatatatacacatatttgtttatctatgtggtatctgctttgaccttatatgtaataggctttattcttatatacacacaaacatcttgcaaatcagcattcaaagtcagtttgatgctactgtgttatgatctgtgaatagcttgtgtttaaaattgagccatatgtacaaataactttcattgaatttattcagaagcatctctttaaacaagaaatgtacatgtaatatgctcttgggcaaattttaagagaaatcttagctgacaaacttgtttatgagagctgctgccactgcttggaggtagaaaatattcaaattaggaaaaaatgaaaaatatatcctagagacagttactaaaggaaatgcaatgcttgcaatcatcttgtatgagcaaggctatcaagatgtgctttacaaattatatttcctcttgttattataagcattgtccaaaatatgggtagaaggatacacagaagtatgcagcatattttggaaatttttgaatcattttcatttagccttctgtatagtgtggttaaaaataatcccataatttagtaactacggaagtttcttcattatttagatgtcctctttggtacatttctcaaggttccatataagtcattcttcatacattagggaaacattaagccatatggtatgtgcagttttctgattaggatcaactttttctttgtccaaactatatatttgattatgtttatctgaatatgctgctatttggaatttaacacttgcctcagaatcacatgcagaaaacagtggcacatacattttgaagtaaacattgaattccctttctcttcacttccgggagaagattttcaaatgcaagtcactaaatgacaacctgccaaaagcatttttcccattttccctgaacatctttaaatataacaaagtatcaaaatgcgcacaaagccaaaagatctatatgaacatttaaagcttaattgtctctcacattttaagtggccctatgtcagctctgcttatgggaatcaatatttgtgcatgtttgtgtatgacaaattgcatttaactgactattgtacatttacttacattagaacaggctgtcttataattcaaatatacttagtatgattaactatgtgaaacttgtgaaaaaatcatatttttccatatttcaaagaattgtaaaatttggcagaggttatttaacttgcttccttaggagattggaatcatatgttgatccatgtacttatgtttcagttgcatttttttctattccaataaaaatttatattttaaaataatttaaatttgataacattacaatgaaaatttgacttcgatttgaagatgtgttcaattcaagcagtttaacctacataggtataactctgaatgtattttagaaaaaacagaataattttgctattattgaatcccacattcttttttttttttttttcttttttaagagggaggtttgctctcgtaccatgcctggctagttttttgtttgcttgtttgtttgtttttttcagtagagacagggtttcaccatgttggccaggctgatctcgaactcctgacctcaggtgatctacccgcctcggcctcccaaagtgctgggaatacaggaataagcctctgcccctggccaaatcccacattcttaatgagaagttcttcataaaagattgttatagctggaatttgtgaattaaattaaaattatatatatataattgtaattatatatgtaattatatatatgtttatatatgtaattgtaattatatatatttttatatatatgtaaatgtaattatatatatttgtatatattgagatagagtttccctcttgttgcccaggctgaattgtaatggcgtgatctctgctcactgcaacctccagctcctgggtccaagcgattctccttccttggcttcccaagcagctgggattacaggcgcccaccaccacgcctggcaatttttttgtattttttagtagagacagggtttcatcatgttggccaggttggtctcaaactcctgacctcaggtgatctgcctgcctcagcctcccaaagctctgggattacaggtgtgagctaccgtgactggccgctaattacccattatatttgaaatgtcttaattaaatgatttgacaacattactagtgtcagaactcatatataggttttcccctaaaaaatatgtacatgcttttaaaagagtttgtgtgtacattttttaacatttaactatgcaaatgaagtttacatcagctacagtagcttgagtgtgagaagtctgtggatggttgcatagtgctaaagatgtttaaaatttttgttagaatatttttacaatttttgagtattgaaattataaataacacagaaataatttatcttggatagaaaaaagcagcaattcttttggatggaaatattgacacatagctgaaaacatgtacttgagttaacagtcttggttgtcctccataaattcagcccctaaacctcctgagcctcagttcttaaatccattttccatgattacaatcactggcttagtacccttggtagatttaataataccatatataaatatattagaatcaaatggtcttgcctccatagacaaagcaattatagataatactgtataaagatgaaattaaaaataaaatagccctaccaaactgtatacatacatgcatatgcacatgcttacatacatatatttattcatgtactctggagatcaattaaaatgaaaatacagtggaataagggtcagaaaatgctggactgcagggtcttgtgtgcttgggctttgtattatgtaagttaagtgacatttacatgcccacagaacattaaaaaaaaaaagctagaagaaaatttatcattttctgtgcctatgtaagttaactgacatttacaagcccccagaatataaagaaataaatctagaaaaaaattattactttctgtgcctacttctcacatgaaagtctgtattgagagaaacaacagaaatcagacatagccccgaaaccaggatgagtgatcagaaagctattggtttagtgacatctcccaaattgctatatgacaaaaagcaagggcacagaaacagatttttcaaaaaaagagagagagaaagagatgcatgttgttgttcatgataagcctgagaaccaaaaatttaaaagatagtgaatgaattgagaaagaaatcagaaaaatgaatttgctctgactaatgaaaaatgcataaattatgacaaaaatgcttttgttacttcaaaatacagaaataaattaataacatatttacaaaaaagataaaaaaattggttagacaaaatgaggcaacagtaaaagaaatatgtataaaaaattagaaaattcatgtcaaaataaaattatagttttgacatatatagagaactatatagatccacatagagatatgtagaaatttaatgatatatatgtagctatatatatgttcagaaattttaattttaattatatgtatgcacacatatgtatatatagcacatatatgcaattatagctattgaacaactaggaactacataaaattgtataaatatttagtacaattgaaatctatagttgggaaagaatctgtagttaggtagaaaagaagtgggatcagatagaaagcaaagactgtaactgtaatgtcttatatcttaaaaagagatcagaaacaaatgtggcataataatgtgtttcaaatctaagtggtaatgttttcttttaatttctacatgagggacagagttcactaaaacaagtttagcatgtttccaggcacaaaattggagctcatgtattcattcaaccaacgtgcatgtaaacactattcctgtaggtttctgtggcaagtgatgatctcatcacaggtgtggtcaggctatttcttgttctcaaagacatcttgcacacactgaaatggagcaaagaataaacatgctgctcaaccagcatataagagatgtgtctgtcctggaatggggaattaggactagttcctaaagatggagatacgtaacttgacaactgaatgatgaatgaagcttaacaagaaaagagggaatggctaaaatttataggcaagaagtttagcaagcctaaaggccctaagatatgaggaagagtagcagagtgagcttaaggaactggctaaagttccatataaagtcaacataggtattgaaagtggaaattaaagttagagttgtctggagaggcaatctatagccagcttgatttcttaggctgtgagaagtcaatctcagtttttgtttctttaaaaaatcaatcataatttcaatggaagatagcgaaactaactttttaacatgagtgatgtagtacgatttctaaaggaatattttggctgatatgtagataatggattgtgagcaaggaagtgcagtggtatcaatcatctttaattgtaactattgtaaaataccttaagactacggaacagtttccctttgtgagcaataataccaggacttcttcagatcttcaattcttctcctcaggatgttcatgctagggcacaatttctcatgaaactcttgcatttcttcatgtcttgcgagcagaggcattaattttttattttcttccagactgtctcttctgcagtgtttgtataccaatcagccttggaagatacagtgtcttccttaggttgaaaagacgtatttatttgatgtatagtattaataaggataatgatactctctgatacagagattgggcatgttttcttacaatttattatcaaagatccaggctccctaaatttaagattccttagttgaggtacaaacccactgtgtgctgcacaccacctggggcctccacatcactcctcttcaccttaaggtataaggaaacaaatctgaagaagaacttatgctccttgctgtgatgtaagtaaaaaatcctttgtctttgactcaggaggcttgtgttttcttccagcatctataacactgtgtcaggctaactgactagcatgtaagtaggtacaatctcagctcacaccctttacatttcttgacactttatggaagtaactcctacgagcaactattgtaaaaacacctatgttcttattataacttcttaatgcatgcattctgagttcataccagagaatactttagcagtgtttatgcctagaattacataaggtagctaatttcctcacaccaagaagatcttcgcccatctatactctgatgaaattctcctatttaatatctaaatctgctttgctaaataactaaatgtaacacaatgttccatggttttgtcggatctttcccattcccatgggatctttcctgacatatgttctaaccctcttgaatttggaatctgatgattcacctgaacgttgcagaacaaatgtcttctttaatgttccatcatgtttatttttaaagtttctttattttggacctaggttttattactgtgacatgtgctgggaatatattggtggaaatactagcatggagctaatgaactgcttaaggaagcaacagtcctataagaacaaatacatccattcaaagaaaatgtggtctatacacatacagctttggttgatatccatttgattattttatagacatgtaaatcactagtgaaattctttatttttaacattttctttagcattttattcttaatgattttacaatcattgtcagccttttctaatatctagaacaaatgccagttttttgtttgtttgcctttttttttgtcctggtgggggtaggggaaagtggagacaggactggaacacatggtcttatttcttgatatatagagaattttttattgaatgtcacatgttttgtgctgctatagtggaatacctgagactgagaatttgtatagaagaaaaatttatttctcacagttgtggaagctgggaactctaagatcatttgttgtctgtaagggcctgggctctgcttccaagatgacacctttggacagaaggaacacttttctttatgtggcaggacagtggaagagaaaaaaatctcactcctgaaagccttttttttttttttttttttgagatggagtctcactctgttgcctaagctggaatgcagtggtgcaatctcagctcactgaaacctccgcctctcaggttcaagcgattctcctaactcagcctcccgagtatctgggactacaggcactttccaccacacctggctaatttttgtatttttagtggagacagggtttaccatgttggccagactggtcttgaactcttgacctcaagtgatccacccgccttggcctcccaaaatcctggaattacaggtgtgagtcaatgtgcccggcctgaaagccctttttactgtggcattaattccttcatgggactggagctctcaagacctaaacaccacccattaggccccacctcccaacattattgtgtcggtgactaagattccaacacatgaatttgggacgggacaaaaacattcaagctatagcactaacagaagatcaaatgataatatgtttcccaagagagtattcaccatttctctggtaagcaattagagaggattgtagtcactttaatccactcagagtctgaactgagtcacagctgatttgcagttttgtttagtttcagtttgtctctgatttgtctgtttttagaagatgaccctctagggctctagactgagagcctccttgtgcactcacagtggcctttagctttaatcactgttcaacaccaagatataacaaaaaagcttttcttttgtcttccagggcttttcagcttagaggtttagcattctgttaaacttccaatttaactttcaatctaaattttgaatgtaacaaatgtctttagggaaaatcagccatgtccctcaatttccaatttaattgtagatccaggaaacttccaaaaactcccctcatttctctgtccccagcttagaatcccagcctcttcttagttcctaatataagtaaatacctatagaagaaaggctgttttgcaaccaacggtttgcttcttctctagaatattaactcctctatttatctcacttcagcagttttctgctgcccataagtggagatattcttttctttctttctttctttttttttttttttttttttttttgagacagtttcactctttttgcccaggctgtagtgcaatggcgggatctcggctttcggcaacctcagcctcctgggttcaagccgagtagctgggattacaggcatgtgccaccacgcccggctaattttgtatttttagtagagacggggtttctccatgttgatcaggctggtctcaatctcccgacctcaggtgatctgcccatctcggcctcccaaagtgctgggattacaggtgtgaaccacagctcccggctgagattttattgatattttaagcttctctctttgtttttagtgggagaatttgtcgatcaaaaactgcgtattttacctagacctacattttataaatgaagaaccatttgtttgagaaaagtttcattaagtaattgggacataaatggagtttcagagaaaggatgccgttcaatgatagtctaattatcatgaagatgattgctgcctggatattcctttgaatgctacagatatttgctctttcaaatttaattaaattgggttagaaccccatctcatgtacctagcaaatccaagtttctctccaaaatctctgaggattagtcaccatttcaaccaatattccctgtttctcaggcacttgttgcctctattacttttacatgcctgctacatatccttcccaaagaattcttcccaaagaattatgttctcacagtacgaactgttaatgaaagtttgagtgtacagactgcagggaaaggaaaggccagcttagtagccatctgaaaagggatatcaggtgacagaaattatagcctaagaatcgatttccaactcattctcttttccaaatcttaactgggataacatggacagctaaataaacttgacctatggatggatcccaaaagtcacctccaaggcagagagactttgagatttacaggaagatatttagatgctgactcaattctacctacgatcccttactatgttggaggaatctctgggaatcagagctcaaaacacctttcttagagaaagatcagaggacatggcaggggtcaagttagttcaaggacagaggcagttattatgaattaggacatattgaacgtgattatatatctaagtgagactttttgagctaacatgaaaatttaaaaaatctggtaagatgatacaattcaaatggaaactattaaaaactgcatcagtgagcagaaagttcaaaaggggaaacaaatagaatgtttcggagttagactctagaaacagcttgctgctgtttgaagcctggcttctctagtaattataggtgaaactatggccacttccttatgtttacgggatctctgttttctcttttgtaaaatggagacatataggcaattattattttatcagtgtacatagagatgaaacaataaagaatttgaaaacacacatgcaatgtaatgagtcataataggcacattgaagataactaaaacataaataaatcgatggaaaaacaataatggaataactaaagaaattatcctgagtgaagaaaaatatagatttaagagtggaaatcttctaacttgacagatgatgaaataatgttacaaatttccacacagtgaatttaaattgtaaaagtagtagatagtgtcaaaatactcatttgtaaaattagaagtgaacagccagttgatcttcttttagtgatatttgaaagaaagaactacaataaaagaatccttttctaagataacactcatgagacaagtaagcaatggtatttcaaaatactgaatgttacagaaaacaacaactgtattatttataataaaattcatttggcaaaaagttacaataagggatttttcaatattgactatgtaactgttggagctattattgccaaatgacaataagatgaaataagaataaacatttttcaaaggtgaagtgtaaaataaactttctctaaactaatgtgattaaacatttaccagaaacaatgaagtgttgaatataatcacatataaaaacaatgataaattgattgaaaatataggatttcttatgaaatgtctattaaatacactttgcatattgtcaatatgaatatattcacttattggacctaattcaaaatgaagacaaacgctttacacacacacacacacacacacacacacacaccccaattccctcgggctgacattttaagctatctgtccagcatgtaccactctagcctcacatcaaattattatttatcatcacccttccttatgttccttggaaagaacgcctttcttcttaagagaaattctgtagacagttcttaacattgtttttcttctgctagttaatttttccagtgttatgtactgtctgctgggtatacagcagttatttaaactgttctgattcaaggaattcaaagacacaggtcctgctttcaaggggcttgctgtctagttggggaaatgaggatgatatgaaatgtaattatgtaatttgcagttgatggaggtgaaatgtgagctactttagagagatcactacaaattgtattgttaaaagtggtagaacatggtttgactttaaggatagaggctgttccaccagggagagtgactcagagattacttttcagtaagtagtagattaaaacaacatagagatgacagaatgcagcgtcaattacttggttggaaaaatctagagagggaaatgtagcaaagaagagactcaatggcattttaattcactcatgagaacatactaatgactaagcactgtgccttattctgtactccagtataagatactctgacattcattctttagttgctttagtaccaaattgtggtggctagaaaaaattgtgccaagaaatcctccgtatttatctggaaagttatttctcccaatttattaaatatttaacattgattcagagaataaccaagtgaagggtttttcttttataatatatattgtaaaatacataattttgcttaatattgaccttatttttatcgttaattaatatgttggtaataacataactttatttaaaatttaaaaaccagagttcaaagatgatttttaagttagagcatttaaagttgtattttctaaaacaacaaaaaagtatgaaatgttttctgattaaaatgtagtttttttcttactttaagttgtgatgtcaacttttaattttaacatcaaataatttcattgtataattttaactgcttaacttcacatctatagtgaataaactatggccatattattactaaatttatgaatataggcttgagccagacttccaggaatataataaccatgttcattcatttgtaatatgcaagtgcaacctaatcccccaatatgaaatcattagtctacaaagataaatccattctgtttcaagatcttcctgctgtttcttgagggaatgtgctttatttgatgtaaagagatttgccaacctaattctccggcttaattctaactgtaaggtacatttgtaaatcttacagattttattagggcaaaagattattagtaattgtgtgtgcatttctatctctgtttacagggttctaaatcacatttaatttgtcttttacatttgaaaatgcttatttttttttgatgatttgctatcaggaatatctactactcacatcggtttttattatgttctctttttttgtatgtgttttccattctcatagatacttgaattctttaaaaataaatgagtcaacataacacattatttctaagacaagaaaaaatgcactggaaattaatttttttaatcctatgaaacaagatttcttggagtgtcattattactttgttggtggcattctgaagatttactgttttctttggctttattacttgtttttttttgcagcattcattctcctaaaaatgatcataacatttataagttgctttataatttttaacaaaacacttaaaaggaaacaggaaaactttttttcttgtggctatttggggttggcgaaagaagatataactttaagctgatattgcatagaagttacaataagggatattttcagtgttgactatgtaactgttagaaagaagtcttttggagtcttttcaaatttcacactccattggtagggaaatgcaggtatgtagtttgatacacattggaaatcaagggaatttttaaatgtttatcttgtatttctttggcattgccagatttgtagcagtcaacattcccgtagtttatttttgtccttcaaacaagaactcacagctggtgttgtaatatgcttaatttctctacagagtataaccatttaaaattttgtttttatccacagggtttcaagagaccatttagtgattcctcacattcctaaacaaaataacacacatataatccaccctaagttgcaaatcaagcctcatatatcctctaatggatgtggctgtaactgtgtcctgctgagtcagttatctaaggtcagggacgaggttggaacacatggattttattctacagtggctctcctttctcctatcagtcaaatactaacatttatccagatgcaccttgagagaattacaccatcctttacctgaatgcagacactcaagcttgactagtgagaaattaaagagcatgtatacaatcttgaccctaaaatgtaaaagattgtggattaactgtagtgatccattttagtggctctattgctttaggtagaaagatatgcttttgttctctctctggttatttcaaactctattaattgttgttttatatatatatgtaaaacatagaaacattgattgttgttttacctatatataaaattatttttccccttatggatttgccagcccacaccacctctcacctttttactcctactcacaaatgaaagaaaactgactcatattcactaagcaaaaaaatagaagtagaaaaacaaaacaaaaacattgctaattttggctgggcgcagtggcccacacctgtaatcccagcactttgggaggctgaggtgtgcagatcatgaggtccagagattgagatcatcctggccaacatggtgaaaccctgtctctactaaaaatataaaaattagctgggtgtggtggtgcacgcctgtagtcccagctacttgggaggctgaggcaggagaatcacttgaacccgcgaggtgaaggttgcagtaagccaagatcgcaccactgcactccagtgccccagcctggtgacagagcaagactctgtctcaaaaaaaaaaaaaaaaaaaaaaaaaaaaaaacagatttttatatatgtgatatatcatatataaaaaaaactaattttatcattgcatgtcacttgctttccttttgtgaaaaagtaggttccattcttctgctttaattctttccttactaagaaccacatggtgctacaggagtcacctgctccaccatgtacattaatgcaggtgaagaaaaactattttaaaaatagaattatacattcacttgttaaaactctctgaggatttatgcttacaatttttttttagtgtttataaatctagtgactccaaacatagtttttttttctgttttaactcattcattctctactaaaaaaatactgtttataaaaggtttgtgataaataacgggtagaagttttctcttggagttcagactcctatatttgttttaaaaaaacagctgttcttatctctacttctgcagttattatattatagttgtatgtttatgaattattttacattttggcttggactttattttaaaagctcactttttcttcatttccctcctctttaaattaacacttcaacaaatttgtgtgttattcataagcacatttcctgatattcttcaagaatcacatagttgtttcatgtgtatttgtgcttattttgtaaagcccgaaatacagtcttgaatatacagatgtaatggcaaagaaagattgaacaatttaaaatacttttttttaaaaatcttggtaatagatggcagcttctttgcagaaaaagatgttttcgtgacgagagtggaaaaacagctcagaagaaaaaggacaaaagaaacttagaagagctactgtgtagcatctgataaaagaacaaatattggccaggcgcggtggctcacacctgtaatcccagcactatgggaggccaaggggggcagatcacaaggtcaggagtttgagaccagcctggccaacatggtgaaaccctgtctctactaaaaatacaaaacattagccaggtgtggtggcgggcgcctgtagtcccagctactttggaggctgaggcaggagaatcgcttgaacccgggaggtggaggttgcagtgagccaagattgcaccactgcactccagcctgggcgacagagagagactcagtctcaaaaaaaaaaaaaaagaaaaaaaaaagaacaaacactaacagattgattactaatctcctcggagattataaaataagtacatttattttaaatttttctatatactaggtggaatcagttaagatggttataatttgtatcagcattatttgtgaatccaaagcagaaatagacaatggacactgtatttatccaggattttaagattatcaagtaggaaggagtgtggcagatggtcaaagggatgacattccagggtgcagatcagaacataatgacatattggatcatgcatttgtagtttggcagaaagacaagtaaggccacaaggatgtttgcaaactgagatgaacaagcagaatccagagtccgaaaatggagattaagccactgtaagattcaaagaaagggaagtcagagaatacgaagaaataaaccttcgttaaagagcataaagagaacatgctgctgaagtgttacaagatatattagttcattttgctttcaatttcttcctccatgtcaatataataaaattgtaacagaagacaagttcctgctgagtgtagttcaaatcattattaatcaagtaccgattatggaaagggagctttgagggaatgcaaaacaccattgtttgatgcatgcactctgataatggttaaattatgaatagattctatttctgccgcaagactgaaaaaaactcagagacaatatgaaaccatgcctattgatttgtctggtggaagttgagccgtatttcctagctttctcttcatacacattaaaaaattttttggtctaattagagatccacatctgaggatttcaaatgtttctgctgttctgatagatttggaaatattactttaatggtctggcaggctatgcttgaaataaaatatatctttgcctgcattatcagaaaagaaatttgctgatataactgagagtaggtgtctgataatttcagtttcaaaaaacacatactttttaatattttctaagctataaggtaattttggactaaaaaataggatttatttttgccccaaaacctattttaaagacatgccttattttaaattgaactgtattatagtttgctacagtggcacataaattaaagtctatcctgcaaggtctttcaaactattgaacaaaaaaatgagacatataatagtagctcaagaaaactacatctgatctccagaagcatgtgacttgtattctactaatgtattctgtggcctgtagaaatacagaagttgaatgcataactacctaacaatatattttatgacaaatatttttgtgaaatagccccacaacatttttaccaattgtaaacatctttggaatatttattgctagaaagatggataaattatatttattattatgattgcttttcaaataaatgaaatttcaattatttcacagttatcacagggtattattagagtgtaggcataagcctgatattatatatgcatgtgaaaacctccctgcttcatcctatttgtgtccatattctttttgaacaagaaatgggatcacataacaaaataaataatgcattgtcatctatttttaaatattaaaatacatgcaacactatttctgcattaaactaagggtatggtttatggaaatactaggaacatattggttataatgaaaaagataaaaagttttccaaaattttctggacattttcaggggcccttttgtcaacaaaattcatatatgacatgtaaacattctgttaattcttcatgtgaaatattttccaaactattttttaaggtctcaaagtcttctaaacacatattattggtttaaaattttacttttaatgcagtgaacccaaaactatgcccagtactccagtgcagccatcctttcaataaagagaagcagaaatttcttatctttattgaatgctctcagattgtttagcttgtttgacagctctgtagacttatggctatatgtctatatttgtctatctaatctatctatcatttacctatgtacctatttacctacctttcaatcatctatctatattttaaaataaagctgctattcaagatcctccctatgtgatactttccaaagtctagcctctaatatgcatctttatttcctgtcttattgttaaatttctttgttctggctatacaaaatctcctcgaatcttaatctaatacattagctttactagcttggcttccaagtgttctataatctgctgtcttcatccaagctatagagagttagaattaagaacccagctatggtgcacattattagagattgacattgacaattagtacttctcatccacagatgttctatcatgctatgttttctctttattcagcctatattaatttttcttattcatttggatgccatttgagactttctataatatcttatttatttatttatttatttagagacagagtctcactgctgacagcctaggctggcatgcaatggcgtgatctcggctctctgcaacctctgcctcccgagttccagcaattctcctgcctcagcctcccaagtagctgagattataggcgcccgccaccacacccagctaatttttgtatattttagtagagacggggtttcaccatgttggccaggctggtcttgaactcctgacctcagttgatccacccgccttggcctcccaaagcgttgggattacaggtgtgatccactgcgcctggccctcatttattttttaaccattgtatatcgcattagagatttgttatgggtcttgtcgcctaattttgcaatttcagcaagacgtattttattgtgtctgatatatacacatatatatgtacatgtgggaattggtgtgtatggtgtgttgtgtttgtgtgtatgtgtatatatgtatgtgtgtatatatatatttctatataatacatatctatataatatatatatatttcttcttcctttcatattcttcctcagtgttcaaaattttatttttcaagttcagtgagccttctgccaagtacattttgtactgttccggtgaggtacagaatatgccttgtcaagagttcattattctgctgtgctaagcctttctaggtgggaagctcttgcctcctgaatcatcctttcttttcaaaagtcaaaactttaacgggaaaaacaggaatgaacatctttatgtccttatgtcttagagatttctatttcaggacttaaaatgcactagaaacatattctggtatttgtcttatttctgattgcatttccaatagttttcctgaaaatagcatgcttcaagattattaatatgagacgtatgctaggcctgagccatgaaagagccgccatctacactgcatgttctgtcatttcacatgttattattcgtgtttcctgagattcagggaccagtgtctcacatctctttttcagaggagcagctgtaagattgtcaaacatgtttgtgcccgtgaatacttatttcacacatttcccatagactaaagacttctgttcattgtgatgcaacatcctacagctgatagatctgcttccacaaaagtcaggttttctgggagagtaaacatgactgataaattattatataatacacgtgatgtcatttctccacttctttctctatcctataacatgtttaaaaatagacagctggccaggcgcagtggctcacgcctgtaatcccagcactttgggaggccgaggcgggtggatcgtgaggtcaggagatcgagaccatcctggctaacacggtgaaaccccgtctctactaaaaatacaaaaaattagccaggcatgttggcaggcgcctgtagtcccagctactctggaggctgaggcaggagaatggcatgaactcgggaggctgagcttgcagtgagccgaggtggcgccactgcactccagcctgggcaacagagcgagacgccatctaaaaaaaaaaaaaaaagaatagacagctgatgtagtttttaaaaattcttctttcactaggtaagaaaattttcttcaatttctcattagattatttatttctgattttcagtaactcaatcatatatgtatgtatgtgcatattttcttgtgttttattatatgtagtacattgaatattttaaaaattagcttttttattatgttaatttagcaatgtacaataaataatatcattttaggatattgcactgtgactgttataaacatacctacataaaatacaatttctattttcagaataaaagacattgttaagagaaaaagaggccctaattgtaattgtctaatgacccacttactttttagtgcaaaataattaactcatagatgtagctgcctattgagttccctggagttgaattggcatttggagcgcaggtgttagtggagtatgccattgggatcaacatctgtagatcacaggagaaggaagaacgacagcgtagagtgacagatggagctgacattcactcttaatgtctcttaatggctgaccctatggaaaagctctggagctaaagttgtccatcagtattgtcagtagtgcaggaagggggatggcccaacgtttgtaacctttcagcagtgagtcgttagttatatgctattccagaagtgtgacctgggggcaggtggcaatctatagctacggcaacaggaaattttatgaagggatctgaacagtacatccaagtatggaccatgtgggttttcagctatgcattcagggacgaggaataacagtacaatgaaacatatattatgcgcactgcggacatcaataccatttggcagtgaattgtagatgaggcaatgtgacattgtggtgttgagcagggttctagaatagaggttttatccttatcatttactagctttgtgattttgggcaactaacactctgggactagggttatttacttttaaattagtatttataacaaaaattattttcagctatgaattaaagaatttagcatcctgtccctcataaagttttatagattgaacacaatatatcatgcaggcatttattatagtacattgcatttaataaacacatttttaaaaatatgattagctattttattcatcattaacttccccatggtcaaacaatacagcttcaaatcacagccaagtctaaaaagtttgttgcttgatctactgtctccatagaaatattatataaaccagttattcttatacctgttttatgcatcaacttcacctcagtagtttgctaaaaatacagatttgtgctcctattacctatattcagagcctctaggtttggagaaaatctcattggctcacttcaaagtataggaccctaagtgtatgacttcaggccgtccgcatccctttaaatcttatagctattaggtccatgtccaaaatgttcattgcttcctcctgctttgtcttcccactattttctttcatctttagtgtggctgtattaatttttctaaataggtttctcagttggagaaccaatattagcttctctttaataattgccccttcgtgttcccttgtccatttcataaactgaaacaagaaagatacacatccccattttatccattaaaggaaatgtgaatcttgaatggcggcttgactaagtgtattttgttttgcttatgtctatcatagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctgggtaagtcattctaaaccctaagtttgcatgatggcaattctgaatgagagggaatcattttgacaaatcttaaggattaggcatccataatgtgggtaaggaaacagctgctccaatttcctatgaattaattttctcaatactgtcattaatctcaaaatagttagattcaaatatgttggaagaactgaaataacagaagaaggataaaatcggaaagaaatagcttttgaaagtgtatattttggaaagaattaatattaaaatattcagaatcccaccgtgaaagagcttttaaaaatttttggcaagaatctaagcggcatcattctaaatgaatctgaccaagaccccagcccgcttagcttctgagatcagaggaggtcacccattcattcagcatgagggtgagggtcatatggccttagggtgagtaaatgtacaaaaaatgagagatcaaatatacaacaaaaggactttaattaataacaatattgtgttgtattggaaatttgcaaagacagtaaacttcaggtgctttttccccttcacgtgaaaaaagagtgtaactacgtgagatgacagaaacattaatttgcttgactacactaggcatttcactgtgtaataatagtgaaaactattattgggaaaacatcatcatgttgcacaccttaaatatataaatgaataaaccataaaacaaaacgaatctgaaaaccaaataaaaaatagataacttgtagaaacttctactagttcacaataattagttaatcattaatgttagctagttattaacatactgactaaatattttttggtcttagagggatattaaattttattgaatttaattatattcccttaaaaacaataatttttggccaggtgcggtggctcacgcctgtaatcccagcactttgggaggccgaggcgggcggatcacgaagtcaggagatcgagactatcctggctaacacagtgaaaccccgtttctactgaaaatacaaaaaaattagccaggggtggtggcaggcacctgtagtcccagctactcgggaggctgaggcaggagaatggcatgaacctgggaggcggagctggcagtgagctgagatcgcgccactgcactccagcctgggcaacaaagtgagactcagtctcaaaaaaataataataataaaataaaataaattttttatttgaaattttcattacagtttattaaaaaacacactttctctaattttacattatctgttgtaataatctaaatcttttcacagccgcatgaagagcttctataactataaactctttagaatgctctttgaaacaagatagcaaatctgtattgtaataacaagaaagatggatgtaaggaatctttctgcttcatcaagtggggacctgtgtccaaagtcttttttctttctcttagcagcctgttttttattccttttatggtactgacatacatgaaaagataattgactgtttttctgagaaagaggtattcttgaaaaaatatgttccttgttttgttcctggggttgaagacaaataacttgtatagatggagtggatattaaagtgtaatgagcttggaaaggagaagggatttgtaggaaagggtgagagcatccagagacttgtgggagatggcaaagctggtgagttttgttttaggagtgtaaagaaaggtttaaagctagagagtcccattataaaatcttcaatttgcaaaagatgactgtgaatgaaatggagaatagaactcctggtgacaagagggcatgtagggaaaccagttaggaaaagtctgcccttgtctcccttcgacacagtacgtgttagagtagcatacttataacagacctgaggaaaagtgaataatatctaggtactttcaatggactcagaaaaatgatctttgataatgtagatacctgcatgagttagaatggcctcaaatataacttcttatatgttgctgaatgtagatcctgaactaccctgagctagaggacactggaagtccacttcattcaagttgcccagcaagagaatatatgtagagagataatggactgggattacacagtgagaaactacaatgtgatcactaaataaggatgagatagcagaggacagtgaagaagtgagagtaggaagaaagtaaagtataatgtcacaaacgttgagggaaaagagggtatcaaggagcattatgctttgtagtaaatcttgtcaacaaagtcaaaagatgcttacaagttcaataaattgagcaccaaaatgctcagttgtacttagcaacatgaaggatggaagtttggtgcaccagagcaagaactatttcactgcattccagtcatttctagctcgtcatggtggcatgcacctgtagttgaagctacttgagaggctgagatgagaggatcccttgagcctgggagttggaggctgcagtgagccatgatcacaccaccgcacttcagcctgggtgacagagtgagactctgtctcaaaaataaataaataaataaaaacaaataaatatgtacagtaaatgtatggtggagaggaaagtcaggaaaagagcctttagaaactttatatggccgggcgcggtggctcatgccataatcccagcactttgggaggctgaggtgggcgcatcacgaggtcaggggatcgagaccatcctggctaacacggtgaaaccctgtctctactaaaaacacaaaaaattagtcgggcttggtggcgggcgcctgtagtcccagctactcgggaggctgaggcaggagaatggcgtgagcccgggaggcggagcttgcagtggagctgagatggcgccactgcactccagcctggatgacagagtgagactccatctcaaataaataaataaataaataaataaataaataaataaataaaataaactttatatatttattggtcagaactgctgttttctttagatattaacatacttcttttttgtgtatatttgaaaagaagaagagcacaaacactccagaaagagaaaacaaggctgcacaacaattaccctggatctctctagagtcctaactgaagtcatagagaatagaacgcagggattttaatgagagttcttccagcgttcttactcttaaaagtcgatctcttaggtgaagcatgttatcttcaaattttgagcttgtttatcatcataaaactatttttgtttactaagataaatatcaaaaatgtaattaatgtgttaaatgtctaggtacatgttgaggtgcattattgaaagaacattttatgttttcatggaatgatacttcattttaattggtttttatgaaaatgttttctcatttggggtaagtaatagaacatttgtaaattttattatatccctcaagactaataaagttactatatgatatgtttactttttcatttttattagttgaaactcaaatatgctgtaaaagcatatttgagccgtgatctgactgggacctctgccagctcccctttcagtccatacctcacatataagcaggtgacctaggtgaggccaccgtaagtgaggcatggactgctccttatcctagatataaatttccggataaatggggatcgaagtgggtttggtgtgaacacgtggtggacaaagagaagaagatggaattggtgagaagatgctctaaaagcatatttaagtttcaactaataaaattagtgaaaatatataactacaattatatattataatgcaatatttgcttttcatggcattgattcgtttttattgttattcagaaagtatctagccaagggatacaggatatagccatctgtaattttaaaataatgttgaagttaatttatgagattatgattttcggcataaatatcgacaaaaccaaatgtagcaaaactttatttttgaactcgtaattctgaaataacgttcaaccctcgcagctaaacaaattgtaaaattaatattttaatattaaaaaattttccctctcagcttcttgtttgtgaaaatggctatgattgtacaaacccagctctagttttgccaataactgtgtgatctaaagccacacattcagtttttcttgtttctatttctaaacctgtgagaatgacatttcagttgaaaggaccttagagtcattctgtagaattttgaaatgcttattcttgttttattaaagattgcatatggttcaacattttacaacatggtcggaatccatctatgtatacgttgaatggtgcttgtcaaccaaagaggctaactttaaatgatagatataaacattatgagctgagttactgtctgttgaggttacctttttcaggtctattgcatatgatggatggaagagaatttagagtgagcctttatgatgcaatcagaatttaccatgacagtagaggtagctgaaatcctctctccctcccagaggcctgacttttatttcccaactttaccccatctcttgccagagggactagagtagttggcaaggcaaatcttgatcacactaggcataagtcattgagtcgggatctgactgggacctcttccagctaccctttcagtccacagcttacatataagcaggtaacctaggtgaggccaccataagtgagacatggattgctccctaatattggatataaatttcctgataaatgaggatcagaatggagttggtgtgaacacgtggtgaactaagagaagaagatggaattggtgaggagataaaggtcagcctgcttttcatttgagctatttcaaatggttttgtgtgctacccttggtttaaaaatctaaggtttcagagagagatgccactcccaagtgtggcaagtcacactccgtaagtcaataaaaataacctccctgactcaggccacctcaattctaccaaattcagtgccaacatatgatggtatgacaaagaatcaagtggtatttgaggtttaaaaaattctgctatgcaagctacttagggaggagtatgttgagattcagtatggaatgggttcaaattcaagttgtatgatagtttatattatgggaactgaaagccacttagtatgccaagcactggaatgatacataatatataggaaaaaatacatattatgagaaaacaaatacaaaaaatgtttccccatctttgaattacttgatgataaaattaattcataaaactccacaaatttattctaatttataatataaaatgataatctcacgggcatttaaaattctgcccaaacttgaacagaagaaaaagaaattcactaaccaaggataaaatatttattttagactaaagacatgtaaaaaattctacagcttattcaagtttcaatccagttggcttcaaattatatcataaattatttattattttgtacaaagaaaaacaagttctatatcttttcttttttttgtaacaccaccttggttctctcatattgtattttaccagatgactcactgtaagaagaggtaccttgccaatgtgtatgctttgataggttatcagggtcatttgaatacattcttttgactgtcagtttttaaataaggatttgactctatttatatgtataattattatctgcactcattcttttaaaatatactttggtcttaggattttttttggaaacatttcatttgtttttcaaacattaagaaatattctccagtacaattaggagtttgatgttattagtaaccataagctaatttttaaaaaatatcttaaaattattttcctagtgaggctattactgttcagggtaattcacttaacacaatgtcacattaccattttcacagagattttttttttgtttgtccacatgataattgtttatggagtatctacctggtgccatctgctccagaaatatctgtggaaccaacaggaatgaaaataagttcatcaggaacacaatgtacaacatttttctgagttgatttgaatttatctttaactagagggatcctatgtctgcatttgccctgatgtcctgacataattatgaacaacatcccctttcactcaaaaatgtctcagattttgattttatacatatatatatataaatatatatatatatctccttttattaaataagtatgtaacaagcctaggaatcactgaatactagcaaataatatccagaaaggtagcaaatactaccttttctggggaaaaggtagatgtaaaccttcaacgttcaaatgtaaatggtctctatattttgaatcataatatatctgaattattttcttaacttttgagaaatagaaactatatgccatgataattaaaaagccaggattatccctgtatttcattaagtgaatatgatacatatgcaaagattgaaaaattgcacaaatattgaaggatgcaaattacctccatacctctatggcagtattgattacatattccctgttgtgtctgcacataaattcccttgacatcaaccaccaaccaattcaatataaaagaaaataacttgatttattggtgaaggtaagaaattgtattataataaattaggcagtctttataaataggtctttcgatctagaacagcctcctcatttaattataaagatgaacagagatatatatcgtgcatgataaatctaaacttctgaatacagtggagtgaattacttgaggatgttgtttggagctttgaattagaaaactgtaaggtggatttatgctaaaatacacaggcagttattaaatgcatatttcctatgttcagcaaaagccttttttaccccaaaataaaggcatatattaagcaatgtctttgacatataggcaacgtatatgggaaaatctgtaattctgtgcataatatttgtagatcagggcatgtgtagcaccaacatttcattttcagctttctgtaaccacttcattttaaacagtagtaattcaatgcttcccatgtctgctgtagtgaccctcattgaattttctcattaccttcccaatgctaatatcttttcatttcacacgtttctggatggttctatgactttctctacagatgtttttttcctgtctttttggttccttcatagtctcccatttgcctttcctctgcaaaactgggtacctcccagtgcacagtgaccatccctttctctcactttcctttccatctctggctttaaaatctactcctcttccacaagttttctctagttttaaaacagataaaactagtccatatagattagagttatacattaaaatggttaagctataaagaagaacaaagtaaccataatgataaaagtgaagataaaagttactttgcagaggtaagcagtaaaagggcagtttctggggggaaagtatgttctttatcagagttagataacctggtgtttgattcacaaccattcattcaagttcacttataatcaaggttgccagacacaatgcagtatacccagataaatgtgaatttcagataaataagaaatatatctatatctgtatataggtatgtatgtgtatatataacataaatatgtcacaaggaataatataataatatttggaacatatgcatgtatgcttagcacaatatttgcctgtgtgtatctcaaatattatatgggacacacttaataccttatgtgtatgtgtgtgtgtatgtgtgtgtgtgtgtgtgtgttgcagatggtctccaaccaacaatagtttgacttaagattttttgacttaacaaggatgtgaaagcaatatgcattcagtagaaaccatattttgaattctgattcaaaattctttatatctttattataaaatacgttttgtgttagataagtttggcaaactgtaggctaatgtgttctgagcacatttaaggtaggctaggctaagctataatgtttactaaattatgtgtatcaaatgcatttttgatttaagatattttcaacttcaaatgggtttataagaatgtaagcttactgtaggttgagaagcatgtgtgtgtgtgtgtgtgtgtgtgtgctgttattgatctcaaattcacgtttaattgagaatcctgccatttatttttgtttgctaaatataacaaccttaaatgtcaatcgaatgtacctccctgattattatgaagtaaagaatgttaaaaatattaatgggcatcattatcaccatcataaagcctagaatatcagctgagcaggaaaagagcagtctatagagctgaagtaaataatactcagcctagtaacacagcctataacaaatttgatgtgagggaactatttctatttagtaacagtttaatttcatcaaatagaaacagttgaaaatattgataaatggccaaagcaaagttcccaagacacatttctatcacatcttctaatgtttgcagcattattggaaataaagacaaatccaccatatttagcaagagctatcctaaggcacatgtccagttggacactcagtttattatttcatgtctttgaaatactgaagtagagtatttttatagtagaaatatcattacctgtgatgcgagaaatcacattatggtacaagctcttccacttgccatctgtgtgatcttatcttttgatcttggttatttagatactctttcctgagtctcagattcctcattctcatttatgcctagtgttccattattggaacattaagcttgtggaagttatttatgtcctactgctcaaggttatcgccaaagtctgatttttcacacacaaaaaattgcaacctcaggcataaatgggttaaaaatagagtaaagccacagctctgctgtgagaattaaataaataagttatataaagaacattcataaatcaaaaaattcctatgaaacaagttgtgtacaaataatgaaacattattttgtccctgaatgggaaaatgcaattattaatgcatgataatataattttaaaggataattgacaaaagagatcaacattaaaatatttctgctttgattttctacaaagcatcaaaatttaaagggtttaacgttaaggctccttcttccaatattccagaaacttaaaacatctttagtgtatctacctagaaggattaaatatctatagagagaccagctcactacattattttttgagttaaaatttcatattattttttcatcatgtgtttatctcactttaatcactaaatggttttactgaaatatgagccaagaaacctacatcttagcaaactgagagtattgtggttttctatagaagatcagcaattcgcaatgtctcctggggtaatcatcttttacattatttgaggcattacagtaccttgcggtgttattcagagagcacagagtgagttgtgctgcaatgccagcctaactctggaatgtggttaatgacgaatgggaaaatgggaaattgctgttgtaaaatctctaagaatttccttcctgttttcttaattcttcatcctttttccattcttcctcagcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttagggggtcagttcttgcaaccttgtggaatttgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagtaaaaaaaaaaaaaaaa

SEQ ID NO: 76 - DNA, 125995 bp, Homo sapiens
aggtgacccggaggccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaaggtaaaattgcagcccctttcagatccagtacccaatccctcgcctcaggggttctgctttctttgttcccctaagagacctgactgctgttccagggggcaaaaccacgtaggtgggctagagtttaggggcttcggaaactgaagagacgtggccacggcgaggacgaaactagaatggggcttgtctttttagggggttgcttctgatggccacctgtatgacttaggagggagaggggcgctgggacagtgggtgatgtgtgactgttacggcccagcaagttttaaagctgggatctgactcagcccttacaaaagggatccggtcatcctcgtcccaccgtgatgcagctggcaaggtttgagccgagctgtttccttgttcccagccttgctttatctgtgttatgttggggtccttccaaggggcaggtgtttctgtgaaagtctgaattcatttctggcaatcacgcggggcttgtgatccatcaattttccatcgtaccttatctctttctggggcttgtggtggacatctatcttattaggtgaaatagattataaccagaggctgagcgatgtggccagtcgtagtgctgacccgataattaaagcaccagtgaaagtactttccctgactattgtcaatgcagaatttactccgaagtacggtttcccattcatatctttcatgttttaaaagagccatttgctaatttggcagttggagagggctccaatggctcacgcatgaatagttgcccagtgtattttaccttatcacagttttatgttcaaaggagccctcgggcagaatgaaatattgtcaactctcttaggcaaaataatcaagatactttaattgctatgttaagatggtccatgaatgtgagaggattgtaagaactgacgttggaggcaatatagactatctggaccctctcttgaattttaagaagactgttcacattctgtagctttgggtgggggtttattctgtcgctttcatcagccagacacatgcacattgccatgcaaatggattcagaaaaacattatattcccttacagctaaactattatagctgactaatgaattttttctgcatgaagatgatctgaaaatgatgtacatcatgtttctctgtgctacagggacataaattgcatttttatgtaaacagtgtaagtggtgcttggattatttacaggtacatagctttccttccttgatctaagctaattgagctttgttttgaacgtgtaaacttccataatggaacataagtgaggtactttggttcctatcatttgcaagtctgtggtgtattcaatgttcattctttttgaactgctgaataacagagggaaaatttacatcattcataagaaattttggtagtacaaaaatgtgtctgatagcctataaaatgtactgctgttttaaaaattctattccgttttcaaacttaatggtgtataagctatagttattaacttaaatatattttgcttttaacatgatggaatttgtggcatatagaagacagtctgccgactactgctttttcaaaattgctttgttcttgatacatggcagtaggggtttacattagatgtatactacatgctttcaaaattagttgatggagtttatcttcatgataaaaaatgtaccagattaatcatagccagtcaatacgaaagctcataactaatattttcactacttttaaacctataatagagaaaaatgaccctttgctaagcaggagaaatacccatattttataaattccttttaagactatgtaagtatatgccttgcattaatcttgaaatctttaaaaaaaaattgtcttaatgagggctagactaagaaatacatttcaaaaatcaatttccttagctgtttttaaaatagtgtttgaagtagcattagtcatattatccttctgcagatctacataatagtctcaaattaactttttctcaaatgtggtcatctcaaaacaacgtgaataactcagaggagctaacatcctctaactggcttattttctccaagtggctgcaccaaagacatggcaacacccccatggtgagcacagttcctcacacattcagattacctcccatttctctgtcctcttcctcctcaaccctttcccttggtttggtcagagctgctttcaaggccttccgtgcccccatttctccagcccagtttgctcgtttcttctttaggcattaggcttagtgattctcgccagagccatctacgctttcttttccgtggtctaaatccctaagatttccttggtctgctgtgtttattcataggatactcaatttcctcattgtgccctcttaaggggagaaaatgtatgtagaaactcaagtgtccggaagtgagccttcttttcctggctggtgtatgctgaaactagtgtttttgacaccaagcccttagggcagagtttcttcatgggttttgctcagtgcaaaataaatagtcacttctcagtaataaatgatagatacactgactaatgttagttcagaatcactttgatgatgtgttctcaactgacactgagttgctgctagatccacatttgcctgaccaaaaatagctaggacctataggtagagtatcatatgtgctaggtactacagcattttctttaaaagaaagaaatggaatctgcccttgagaagtttatgatctagatacacagacaaatatcacatattaaatgaacacaaattcataattattaagaggacatcacatgagaaacgctttcaaaatcatcctatttgctatgaaataatagaatttttttttaaaaatcaaagtttggaacttaaaaaccttaacattttcaagctgtttctgcatacatcacctttctgataccaaaacgaccttacaagataggcaagtctgataacatcttaacattcttatgttatagacaaggaaactgagcttgagactagctccatgctatttcaatagcaccataccacctttcctcagccatcaactattggaaacattttccatggaggcatcattagggatgcttaagatagtggtaaatgatgaatataacatatctagtccctggagtttttgtcaccttctctttctccagttctctctctcttttttttttttaatttcttttcttttctttttttcttttctttgtagtgagacataccgagaaaaggtttcattcatatgtgtggggcattctgctcctgttatcagattaagagccgtgaataattttgtaatctatccttctatcagaaagcccattctcagatatcttttcagctgtgttaaacaggttagtatattccgcttgggatttgtttcaataaaaacatccagtaaaatctgactactttgcttttcatgggacaaaatgaaaaaagtgcttttataagctgtaaaacttaattgagagaaaaaatcacgtgtggcatttgtagcaggaggtatgagctcagtgaaataaaaaagttaactttgtaatcacatacccaggtacacatatttctctctgtgattgcataaatgtgtgcaagtatgtttatgtaggttactcccattgattttaatttctataataaattatgtagctatagggcccacaggcgattatataatgggcaatagaatttgaaaatgtatctctcctaatataattaaggatagcaattatgaaatgtgcttagagaatcacaagttatcgtgaaagccaggttcctgtactccaagaatgtgaatgaggatttagtcattcattcaggacaattttttgacaacctacgaggcatagttctaaaatctggcatttccacagagtataaaacagatgaaaacctctaacctcatgacactctgttctattgagttggcaaacaataaagaaatacataactgaaatgtgttgtatgtcaggtgatgataatagcttcaaggtagaataaaatggaaaagagaatagtgactgtcaaggataagagagagtgggatggtgattgaaaaactcaatagtgaggtcagggaaggcttgtcttcaaaggtgggctttgggctagaatctgaaggagataaggaagtgagccaggcgcatatgaggagcacttctcaggagtgctattctcatcttgtttttcctgaaattgtgcagttcacagcttgcacaactgtccatagactccctgattttggagggagatacctgaatagtgcccctgtttttgtagggaaatacctggacagtgcctgccatcattagctaccatgttaaagatgaagatacaggagtggcccacatctcttggtttatgagacatggaagaagaagacccagagtgttgttttgtttttttttttgtttttttgttttgttttgttttgttttgttttgcatccgcctggtcccatcccatactccatcctctatcagagatattgctccattcagacaattttccttcttattttccacactgtgagcctgtcacagtgggatttgttgagaaggatacccatggcttttttcactgatcccttccatagtataaatctaaagacagcaagaggcagttgctgatggtgtgcagcttctgtctgctatgcacttctttctttccccctcgctctccttccttttcctttccagtattaagtcactgcattggattttcttcctcttttcttccttttcccttattcccctatttatatcctgtatcaagatttgcaaacaggtaacttaaatgaggaaaactaaccatttcactagggattgacaaactgcttaggaaaagcagaggggcagtcactgcttggcgtgattagagctgttgtgaggctcagtgtatggcatgggcccatgtggtagtatctttcagattttcaagagaagctaggactctcccaattttaaaatgttgactcagtgtctttaaaacaccatacagcttacagtggcagaaagtctgcaagccagattgggctcctgatggtcccaattgcagcagcatgcatggcccgagagccccaggactgcttctacaaaatattttattttctaaaattctcagaaaattaactaaacaaattttttaaaaccaatattttatgtcagttcctattggcacgtggttatttttctaaactcatcagcccacatactttacatcaaactatgtacgtttctaaactaaagggtaatctagttatttcattcttaaactgaagtagtagttttctgaaacctgaatccatcatggctttatgcatcaatttcatttccaagttctctgattcaggataaactccccctttggaatattgtctttctctctctctctctctgtctctctctctctctgtctctgtctctggaaatgactgaacttcacccgttgttattaccctgccattgaaattcaaaacatgcactgccctcctggtttccagtgccctttaaaagcaatcagatcagtgttaaaatctatttttccaaaggaataaaagctcacaggttgtgcactaatttgtttcctttaatcctaaaatctcagtgaaatgcccaagctagcagccctccagaaggccactgtgttagaaagggagattatgtactgtatttcttcctactattttaaatgcaaatataataatatatcatgaaacagtgcacatacagtatacatattaagatcagtggtctattcctgttttgaaatggtctcctactccttaatagttggaattctgaggcagcacctagactctcaggtccaatttgaaaatgtatgtttttttttaaaaaagaatgacttggggaataactgtttgataagaccgtggaagatttctaatttttaatattttattaaaaatgtaaagaaagacattcaaagctgagacctttgaaataatatggtctttgcaagtcagagaaaaagagaagtggtaaatttattagagataggttgcctcctttgaggcctaatcatgtgggaaaggaaaacccagccaaggtttgggtccataagacaattcaacctagctttaaaaataggttttggctttgcttgggaccagcattgggaccagagtgtatctagaccagcattttagctattaaattttaaacctaggggtcttttaagggaaatttaatccatgtgtctttgattcactaaatcttaaatcattactcacaaactgtatgtccctctaagctctttgatgtccaagagatctctaaaattgtgtaaggcctttttgttccagaaaaaaataggaagttggtttttgctaagcgtcaataaacagcatcctcaaaaatctgattaggtctaaaatcttgcaaccatgacagtatggatgtttgaatgatgcaatgtgaaaattttaagcactttttaaagtccttgtttaccagtaatactcagttgtaatccttactaaccccaaggaaattattttgacacatttcctctctgttttgtaatataaatacaaagcccaaatattcatcattttattctggcacatagtaggtactcagtaagtattttgtagagtgttgaatgactctttcttctgcccagaaacttctagctaatgtcagttcttctattcaatattgatatccatctgtcataccttggaataagatctattctaagtcagtgaccttgttcgacaaatttttaaaataagccatctaactaaatatatgacatttattgaaattcattttgcaccatgaagcaactgccttgcaaagagtgctgaaaataggaaggaatttctagactaatttgattaaatattcagttgttgccatatgctttctgaaaattgattttcccccttttactattcctgtcatccttcctcccaccttgacatgcttactgattgaaagctatgcacagaaaaagggcaggtcgcttgtatgtataagcaagagcagcaagtccaaacaggcttagaaaacgtaatgctataatcacgagttgtcataatataggagaggggagagaggaatactcagcaataagagtggtgttgggtattgctccaaattacatggatgacacatctttgaactctattgtgtcgggggaaaacaccttcttgctgtagttagatttcctgtttgtgaatgtgtattttctggtaaccagacttcctatatgaatttgacatagctttaagtgcatttcaaatgacatgattaaagaatggctgctttggagacagcagctccttctctcttaaagaaataaactatcatgctaaaatataggcattgagatctttcttgataccatattgtgaatttctaatggctcatcacatttttatcctcagaaaacctttcctggtgaaaagcatgctgttttagtatcacatttggggtgatggaattggcaatttcttatatcttgagggggcgggggggtaaaaggaaaattgtgttaatagggtcttaaaatagagattctcttaggttaacctgaagatttactaaatacattatcattacagcttgttttgacatttaattgtagatggcactgtatcagcactgacttatttatacagctttgtttagacatgcctaatttttatttcattggtggaaccaaaccatcagtaataaatcatatatcagtgtttttgtacacattcgtatttacatgacttttaaaattccaatgtaaaggtctcacaacttgaaaaatgaatgaatgcctgagtatttgaacagttgggaaaatgtagttcaatttaagaaagattttttatgacaattcttatgccatatatagaaaatagataataaaggagaaggcctggaggtttagatgggatattggatcaatgagcaaaggaaggggaaaggtgggcgggatatgctgaagggtcatgggcttgagtgcaccctaagtcataaagagggtgtcccattaagaatcaggctgcctgaattctaagtaggaaagaggcaggtcaaaatggtgtataggccaggcacagtggctcacgcttgtaatcccagcactttaggaggccaaggtgggtggatggcttgagctcaggagtttgagaccagcctgggcaacatagcaaaacccccctcttaaaaaaattacaaaaagtagctggacatggtggcgcacacttgcagtcccagctactcaggaggctgaggtgggaggatcacctgagcctgggaggccaaggctgtagtgagccgagatcataccactgcactccagcatgggtgacaaagagagaccctgtctcagaaaaagtgggggagggagggtatggaataaagtaaagctcatgggaaaatggtacctttaccattttcccaccttgggaaatggtgggaaaatttagacattgctttacaaagtctaaatttctgccaacttgtgttacatgtggtttgattctggagaaagatagactatcatctatccagtcctaaattgggcctcttagtctgtcctcccctcagttaccaggaagaatagcaggaatatgtcacagaagcagagaaagcttttattctgagtgtcagaggcatgttctaagcactctgttatctactcccaggcactctaaatgaaattccattttctctgaggaaatcaaaatataaaaagaaaactcaggcaaatttataaaggttttacaccattttcatgactgaaatattctagcatatctagctcattataatctataaattcctgttgggaccaaaagttatggccctaaaacctgttatctgtaatccttttccactgggatattgtctctggggatatatattagctttccttgaggatactaccttgaaaccatttctttggtccttgactatacaaagttcatactagcatggatgtaggaattgtatttttctattctaaatacgaatttagacagtgatataaagattcaaggaaagcttctatcaaggcctgccttcactacttgtcttttggctcctctgagggtcttaggtgagccactttcatctgattctgccctcacttcaggcagaattcatatggctccagccaatggctacactgtccaaagtgagactgtggtctcacaaccatctggttaatacaaagacagcaagccaatatgatcacttaggacctaggcaaacctttgggcttaaaatattaccttagctattgttgtttttaatgagtatcaaatagtatgatatttgtaatttgtattatgtaaagaagtaaccaaagcagagattgttgacaaaaaaaaaaacttcctcctaacataaatgaatatgcattttggacttttcaaaaattccctttctgtcttgtcaaaattaagatatttctaaattttatttcggtctcactaacacatacttggattattgttcattgaaatctgtacgtcaaggcccagtgattttaaacattcttttggtcttcaaagaacttaccaaaaaaaaattgttctttaaatcaccagaaaagtgcagataaaatcccagacagtttcattaatgacaatgaaaggtgacagcccttgaatctatgtcataagttgattaattactttccaaacattattaaagatattagacgaataacttagactggtatccaggatcaaggttccttcataatccctaaatgggttttaattttcagagttagatgatcattatatgtgatttatttctttaacatctttagactgttggctttattgaaaagagaggagagtatctgtttcaatgtgttttcttttccctgaagttattccttgcagaattcaataaaaccggttttgaaataaaaataattaaatgctggcattttctgttaataagggcccatagacctgatgaattatataaacattacaaggaatttaccactgagttcataattatgtaaccatttaatgcccaaacctgcctactgacagtgaagacgttcaatgagaatggacattgtgcattaggataaggatgacctggagtgaactttcattcttgttttggttctttcccattttgcccaattcatagcacctgattctcttaaccagcaagtctgtttgcatgtctccagtccaatttttcgccatgcccactgcagtgattccaaactctcaccatttcttaagctcttgcatcttttgggctctccttattctcagtataagatctttccttatagtttagagagtaaacacaagcccagttgtttccatgtcacccattattacctctttctgtctcaaaggatgaaacagtcttttctacctaagtcttgaccctgttgttccccacacctgtgagcacctcctccctctatcctacccaccttacaactcttcccgtgtttaaaatctccctcaccatttttcttttttaaaaaaattatattttaggctcagtggtacatgcgcagatttgttacataggtaaactcgtgccacagggtttatttcatcacccaggtattaagcctagtacccaatagttatcttttctgctcctctccctcctctgccccctcaagtagaccccaatgtctgttgttcctttctttgtgttcataggttctcatcgtttagctcccacttataagtgagaacatgcagtatttggttttctgttcctttgttagtttgctaaggataacagcctccaattccatccatgtttctgcaaaagacagaatctcattcttttttatgtctgcatagtattccatggcttctctatttttcattcacctcttactcaacttactgattcttctagaaagaaataaaacacacacatcaggcatcctgataggatcttgaatacacaatttccttaagtagtcactcctgttttcattttagcctttaaataatgaattcttgaaaataaatgtctaactcagtttctctactttcttcattcccattcattcttaagtcattcaactcaagcagtctgtaccacatgcccaagaaagtgtcctcattctaatcaccagtgccctcctcatggccagatctgatggacactggtttttatcccttttgacccgtctgtagaatttgacaccatacattttatttctcccttctcgaaagttctccttagcttatctctccacattttctttgcctacaattgttctttttaccctttaaaacataaaggttagattctagtcttctgtaaggctccatctgaattcctcctttctacttacaaaacacattcacaagtgatctcacttcagtgacttccaatacaccgatggacgagtggttcacaaaccgctctctctcacttcctcttttctctagaccaccactttcatgttgtcagctaccttacagactccaccacttagatgaccagaagctacatcagggttattaactcaactaattacttttaccctcaaagtctcctctccctattttccttaccttggtttatgatacccagatagacaattttttagccattcttggcttttcagtctcctctacaatcaaaatccatattgaataattcccacataatttttctcactttaatatgtgtataatctagtccttcctttctttccataatgctagaaactttgttcaggaacattcttttgtatattgattgattctgttgtccattcattcaataaatgcttactaagtgccatgtaatgacactatgctaagggctaaaagtggagcttacactctgatgggagacacagataaataagttactatatagtgtggtaaaggctagataaggggaagacaggtttgatgtttgagcacataggagagttcctaattccttactagaaggtaagagatgcatcagagaaggcttcccagaactgttccctaagatgaggcttgaagagagaggacaacttatccatgtgaagttgagggcaagaatatccataaagagggatccacatgtgctgaaacccagagtggctgagcacatggcttgcttcaagaactggaagagggcagagtggccagagcctagatttctaatggtgtgatggcaagaggcaagactggagagtggggcagaaaaaaatggtatgtggtttgtaagctctgccaaggggttgacattttttttcagcaaagaagtgacatagtcaaattgtcagtttagaaagatatctctggtatgctagggggcagatgatcagggtgagaatggagagggaagaccagcgaggaagctgttgtagtaatccaggtatgaagtgacactgccctgaccatgggcatggaagccaataaggagatggacatgtttaaaatatttgtaggtgggtgtcaaagatgatgtcctagaaatatgggacatgttcagcactgaggtaggatacagagagggagaccaggttttgtgggagtagatggagataacagaaggatatccaactgctccttcttggtctcttgtcccatctgtctttgtctcctgacctattagctttggtggcgccatcactcagtcctcctctcttcattctctacagtccctctcctcggagatcccatccactctcatggcttttcatgatgtctacatgctgacaacttcttaatttaaatctctagcccagacctttctccttaaccccgggactcaaacatccaactgcatgcccggcatctccacttagatgcctaaaaaatgtatgtcaggctgagtgcagtggctcatgcctgtaatcccagcactttgggaggctgaggcgggtggatagtgaggcgggtggtggtcaggagttcaagaccagcctggccaacatggtgaaaccccgtctctactaaaaatacaaaatttagccaggtgtggtgatgtgtgcctgtaatcccaactactcaggaggctgaggcaggagaatcgcttgaacttgggaggcggaggttgcagttagccaacaccacatcactgcactccagcctgggcaacagagcaagactccatgtcaaaaaaataaaaataaaaaaacctccattgtgggcaaaactacattcctggtctcctcatatcctacaaacatgcttcaccaaccagagtctgcatgtcggtaactggcaaagccattctctctgttaaaaaagtcaaaatccttggcatattctcctttttttctcacatgcctcagatctgactccatcagtaaatccggatggagttcgatctgaggcatgtgacaaaatagctctgtcttcaaaatagaaccagaattcggccacatctccccactctccccttccttcctggcccaggccaccagggtccccctcctggaacaccactggagcctcccagctggcctcaccactccacctttgccctgaactgccccccagccactagcagtcttctctcccatatgatcgaggtgaatacattccaacataatccccccttgttcaacaccctgcaatgactccccatttcactccaataaaaacctgaatctcccaggggcctacaaggccttacatgctctgcttctttgtccttttgatctcagctcccggtcaacaaagtccaggcttactggcccccttgctgtgcttcagacacaccaggcacatttagttcttccttcttgcctctgcccagaaatctcttttcccatctcagacatctgggtccacaaaagccaccttcccaatttccgagctacaaacctatccccatacctctcctccaggcagttctgatgccccagccctactttttgtttttccctgtaacacacatcaacttctgaaacactacatcatcagcttgttatgggtattaattgttgtccccagctaaaaagtaagttccacaagagcaggggtgttgggttttgtttactgatgtatcccaagcatctgatgcatagtaggaccccagtaaatacttgtcaaatttggtcttaaatagctgttgcatagacaaaagtgatattggagagatggatttcgggattctctggagatccttcaacaaaacatatcagactttctttaatgtggccacagcctaatcttatacctttttccactgtcaacccagcccacctggcctctatgccaattgcagcttcctggacaaccctgcatcttctccccaggtgcccgtgtgtgagtccactccacccaaagtgtctgtcccctacctcagctgcacctgagcagctccaacttatcctgcaagacacagctcaagtagtatcccctctgaaatactccttggccccgctttctgtctgcatagttagctcttctcccccgtgctgctccactgacatgcgcacacctttacagcacagcctgggcgtgttgcaggtggaaggtggagattcccagtcaaggggcaacacctgtatggttggaaaagttgtttgttttaatttcttgccctctcttctctcttctatttctttcctctcccataaatacacataccgcctatatacacacaacctgccctgaattgttttccttgaattgatgagttacgtaaatgcaatcctaagcacagttgttttcaggttgtcctaaccttttgctttattgatttttcaaggatccagagtgtttactgagtttcagaaattggattctgtacttatttttctgtactatcctagttttatgagaatctatttgctcagcattctctattcttttaaaagtgtttaagatttttgtaaacagttttgtttggttctttattttctggtgacatattgatctcaacataatgctattcatatacttttaattcttcttccaacactgttaggattgcattatgttcacccaaggaatccacatctgtacaaaatgtggccaggtttggctattccttcacattcacagtattctcatgatttctaacaattcttgtctactttgcctaaataagaaaatgtcatatactgacaattttgatcgtgaaaaagagaccttagttcataccagtgtcagagtctacttgcaaacattgatttccaagaaaatttctcaggtgtgagcaaataagcaaaataaattcagacctaagagaaaatagcactacaaggaacgcccagctcattcaaacgctctgcattttgagactagagggggcttggcctttggcaccctcacacctctcccctttgtctctctgtccctgggtgctgatttctctttctttgtgtgacagccactgtgaaaagaatggggttcactcaccacctgcattcctccacagccatttgatatctgctttcgataacagcagaggaaactgatcagtcatataaatccaatcctgagcatagttcctcgtttggaattgtaccatgctttatgccgaggacattttcaaacacggagggaggggatgtctgattcattcgtgagtaatgtaccagcttcctctccaacttgtctcccttcagtggttcacattctgactattcagtcggtttatcctttccaaacccagtatttgaatgcaactggcaaaggttgattgcctctttttttttttaatatatagacttggaaagatgtttctcaaatgtgatttgcggatttatgttattcagtcttcctggattaattgaacaaaaactggtaacactgctacacagtctgaatcacaaaattatgtccatccatttggctgaaaaatacgaaaacaaatacttgtataagttttcatgcattttagcactttctttacattggggaagttcaaccttcacactttcaagggcaatgaaacatttttgtctgacctacaatttattaatgggacaaaagcccatctgtcaatcagggctctgagagttcaatgtattttctgaacaatattttttacattatgtacaatggtaaaaacaaatgtccatttattcttctttccaagaagttgagtactttcaaccattcttaaaaggacaaagatgtttgctgacagaatatgaatttataaaggataatcttgaggatataatggcattctattctttttatctttactcttgccatatcagagttggataatagtctcaatcatatgttacaactagaaaatgcacaattggctttttcttatgctaacaggcagccattttcaactttttaaatgattataggactaagaggggatgcaaaaacagataagaatctgaataaaagcactatctgtcaaagaaacaacatttgtgtaataatcaagaaaccgtttagagcaccccctggaaacattaattataacacatgcaaatcattcctgtacaaagcttaacttgtttatctcctatagccacctgtatttgaattttttaataagctcatttattataaataaagcatgtaaatcaatctgggaataccttttctgtttcagaaatttcatgtaaatgacaggctgccacatacagtacaactatagaggggaaaaagtttctttactccctttcatatagttataccttcatatgacacttaaaaccacctgccaggaacttttaaaacatgttttagatgcacagaagcaaacccaaatgaaaaaatgctatgcagttttgcaatacatatataccacagaaagctttaaaaacattctaccccaacagataaatagatttggcccaaatctttttaatgtgagttttgtgggtaaaaaagattattgttcccttatttttccccatttgctgacgactaggattgtcatataaaatacattcctgggacatgcttatactaaacaaattatccactgtttatctgaaattcaaatttaactcagcatcctatatctttacttgctaaatctcagttgggatatgggcttactctttttttttttttttttttttttttttgagacagagtctggctctgtcatccaggctggagtgcaatggtgtgatcacggttcactgcagcctcaacctccctagctcaagtgattctcccacctcagcttccacagtagctgggactataggcacatgccaccatgcctggctaatttttttattttttgtagagatggggtttgcccaggctggtctcaaactcctgaactcaagcaatcgtctggcctcagcctcctgaagtgctgggattgctggcgtgagtcacagtgcctggcctgagctaactcttttttaaagagttaaaatactggttcctatttgtttttacttctctagtatgggaggctgttactgtggcttctgtcttggggggcaattttcgaagggcttcaagaacttgaaccgaggttagaggaaaaccacaagatggctaaagggtgggaaaagaagaaataacactatttaaactttagatgagaggactaaagtgatgaaacagtcaccaggtatttggagtggtctcacccaagggactgtgccaacttcctcattttttatgagggcaggcaaaaactggccaaaacacaagttaggataataagcatagtagctattattaaatgctagggtgtgctgcataactgaaggacagtgtttctcacagtttatctccaactctcatggccaacccatgagatgtatatcattatccccacgttttgaatataagaaactgacactcaaatcagaaggcatgtcagtgaaaaaggccatattcacatcccatctaagtctgtctgacactaaagcccacactctctccactacactccaccttgtctccagaatgttttgggctgtttaaatgtgattataccaaagagcagttgaatgcactgaaaaattctgaagattcctcctgtcccttcgattcactgttggaaaccattgtcaaggtagtgtctggctacgatagaagggatttttgacatggcctattgttttatctttttaaagtaaatgtaggtgcttttgatgatcataacactaactgttaagtctttaggcataagaatcaagcattcaactaagcatgtttacaaatttgctttcagcccagtggatctatccacttttccatttaggttgcacatttagatttcggagtttatcctgttatcttcaaatccacggactgtacactctttgagggaagaaactcttagtatctagtcaagtacgtggcatgcaatgggtgctcccaaatacttgattaatatcatatgatataatgtaatatgattcttcataaacagtgagtgtttataaatacagtattttaaatgtcattaggaatcttctattggaatcttaactttattttaatagacctacttttaaagttaataaacataatataaatgtggacagggctaagatttttccctaagatttcactctggcaagtcttcctggagatttagccatggctatttttatgactgtaatttccttaatatggggcctcagccatattccatcatcataaatccctttcttgcacttaaaagcaatgttgaaatattttccagtttctatatcttaactctttacttagatccattatttccattttgagattatcttatgtaaatattgtagaagattttagaattatataataagaaaatactagtataccacctcagaaatcttaactaatagatatgttctcaaatgcaaagtgaaatatttaaagtaattattcaagtaaataaagagaccatctttgtcccaattacttgaatattttacgtaaagttggttttatgcacttgactttgtgtttaaactcaagtttgtagtattgtctactggacattgttagctcaggaccttttcaggagcaaggaatgaaagaatcatttttaaacttatttaaaaaaagaaataaggaagaaaagaagaaattttactggctcgccttagcttaagacatggctggatacagatgctcagacaatcacatcaggagcctgcctccctccgtgtctgggctctctggcctcttgggtcagtttcatgctcaggctggctttctccacatagtggcaaagatgggcatcagacatcccaagttaacatcatctttagtgctcatgctgtcagaatgaaagaggccctctcccagcatccatattaaatctccaaagagattctgtttggccttgctttggccacatactcaaccctgaccaagctccgtgtcaagagaacagagttcgttgaaaggccagcctggtttgcacactcattctgtgttgaaagatgtagaccatgtgattgacagtcccaggagataggagagggagaattttcaaaagagttgccggtataagagacagtggattctgggaaggtaaaaagaggtatttattaaaatactgtgcctttggaataaaaatcttttccaggaaatgcaaataatttaaaacaattcaaataaggatcatacattttaaaacaattagaaatacactcagaagaactgaattgctcatttagtagatttcagataatattttctcctctttgaacctcagttttgtcatctggaaacacaggataatgcttaccttataaggtaatcatgattagaagagatgatggagctgaccatatctatttactataaagtgctatctacatagttataaattatgacagctaagaaaattaatccctaaagaaagcaaaattacctatgtcacggtttagaaagtctctctcttaagaagaaacttattctattgcctctgttgggttttttcctgaggaatcggtgtttgaatgcaatatacatttttgtaggctctgcaatgtttttatgatgaggacagtcatagtgttgacaattactcaatgaatacttagagatttgaatgtatcgctagatttctgggaaatgaaaagaccaatgtaagctagttgaatgagaaaaccagaggtgggcagatggtggacagattaagtcgctggttttaaaggtaggctgaactggtatttgtaactattaataacagccatcttctttaaaggaagtactcctaaatatcaatagtttagtggccaaggtgccattgagatgatcactcccaggaaatgttttgccagtgatattaccttaactttcatctgaaaagaaataaagaaatgttttatggatgattcactttcacctgatatgtgcacaacattttaagagaatgaattagtcagtctgtttgaatcatctttacgtgttccttttagcagggaactcaaagttggttaaatggctagctctatttcagaaagcaaaaataacagaaacagtgaaaagacagtctatattgaaagcctgatccagacacatcatgggggaataaatatatcaggacaaaaatatatgaaaagtgaaagtatttctggagtatttcactaccaatataaatattaaaatgctcacacagccagatctggcaagttacatagatgaggaagtgaaagcaataatatgccaagtcaatggcattggtgtaaaatgtaatcatagaggaacaatctcagagttgaaaattattagaattggaaaacactttgaagttctttagttccacccaggagtatgccattaaatatttaataaccatccctctgcgggctttaataacaagccctgatttgtagtgtttgccaatttctatggtgtcaatacagccaccatggctgattttaggctaccaagatgaggtcactgaaacacaagttgggaagagatgcacatagtaggctgtcatgagccagcacacagctggttcagcattataattttcaaataagaaagcagttgacctcagaggagttgggtgacttgcctgggtcatacaaataattagctgcactgccacaactaaacctaggccctctccagtgtttgacctcagaattgtgaatgcattatgaggaaagcaccatgattgattgattggtaagcccacgtgactttctgtcctagttaagttcccctttaagggcctccatagacatttctacattgagtttaaactatagtctgcctatctccactactggcctgagatctcactgacatttggaaagcgttttatttatctttgtatcttcagcactctgtacagtatctgacacttagatgcttataagtgtttgttgggggccatgtacgaacaatagagaacatgcattgacctgctatgtgccaggcagtgttcttagtgatttacatgcattaacttattgaatccttagaataactctcacaagtgaggtaggtactataatcctgcccatattttagatgagaaaatacaggcttagacttacttgcctaaggtaacatggacagtgattggatttaaaccctaaaatctggccagtgcctgtgcacttggcctctcagttgtcactcatttaactagcagttatcatcatagtgcccagctcagcgccaaatacttctaaaaggtctccctcctttccttaggaaggacacaaaacgtttcccagaaaagatctgatctgaccaacacacacctttgttaatggggaagggcctttattaatgggaatgatcaaggaaatggggcgtttttggtgattacattttctcattatctgaggtttaaacagaaacctctagtttaattaaaatttctgttgctgacaataggccctagtcccatttttttctttaattaaaaaagttaacctttttttgatgtattcacttgaaaaatggcatcaccatatggtaacagataatgtaaagaaggtgtaggagattaaggtactaactccaactgtgttctgtgagggtttttctttaaatagaaaatatattcttcttccccactgattttccatttcatcaaatgaagtaacaaaaagcctatttctacatgtgtacattttcttggattcttgtccactgagatttagtacagtgtgtgacttatgtgcgaaccttaagatatgaatcttattttaaaaacataatttaatataatatctctaatttttttgtttttgtttttattttttttagatggagtctcgctctgtcatcaggctggagtgcagtggcgcaatctcaactcactgcaacctccaattccctggttcaagagattctcctgcctcagcctcccaagtagctgggattacaggcatgcgccaccacacccagctaatttttgtacttttagtagagacggggtttcaccatattggccaggatggttgtgatctcctgaccacgtgatccacccacctctgcctcccaaagtgctaggattacagattattttgaaggctccttcaaaaagcctagaagaaaaaatgtcattcacacttcacactgcattaatggacatcaactaacatgcaaattggttacaatatttttctcccttttggcaataataattcgtttcctttctttcattataatttctacagaaaatacagcaataaattatatattaagctcaattttgttagatacactgataccatattgataagtgcagttaacttttcacataatatttatttttcccattgtgctctagatggtttagatacatatttgcagtttggtttacagtttgtatttgccctctagtacaacaaattgtccctaatccttttcttctatcccttgttattccctctaccagcaccaaaaatttgctagtacattgcaaaacaatgagaattacagataaaatagcaagcatttatatatactctatattgatcaaagtgctttcagagatgagatctctttttgatccttaaaatggtcacgtgagaatatctgaccctgggactcagaggtgggtgattgcctggagtcacacagctagagagggaaagggctagaatcagagggctgattgtctgacttctgttctagtgcatgctcccacctcgctttggaagctgcttcggcatagtgaagcacttaagagcatggatgggttcttgttagccagacgtggaattgaatcttggttctaactgtgtgattttagcaagtttgcttatctagaagagaaggataataatacttccttcttcacagggtggtgatgaagagtaaatcaaagagtttagcagaatgcttcccatatggtaagcactcaatacatgttcttgttatttttattattacatggctttgccttactgaggcttcatcttgtcctctggtccaactacagttctctagcttggcttatcccttcataacctgtacccccagtggcacgatcttggctcactacaacctccgcttcccaagttcaagcaattctcctgcctcagcctcccaagtagctaggattacaggcacctgtcaccacacccagctaatttttttgtagtagagatgggggttcacagtgttggtcagcctgggttcaaactcctgacctcaagtgatctgcccacctcagcctcccaaagtgctaggattacaggcatgaaccaccgcgctcagccaggaattttcattctttatcctcctttgagactcggctctagcatcatttccagtcgagttggtctcccttcctctgcattctgataactgttaaccatcaagtgacttgagcttcccagggaagggcatcatgtctttgtagacatccaataaatgttagtagaagaaaggggggtcctgccaataatcatatgtctttcccacaatttaaactccttttcaccctgttactactttttgcttgtcttccctttgataaacattctacttcttcatcacccattccctcaatttaacatctgatactactatagaaactactgccttgaagatcaacaaacgggttccatgtggaccaacgtcctccttgagaccctcacttggcttttgtgacacagtgcaatatttgctctcttgatgcctcactgaccttaaccttccttgactcctgcatagatttctcaactgtgggtatcccctaagatttaggccatttgccttctcttctttcatctagtccattcatgaacacacccattcctggttttaaccatcacctctgtgcagataatgtgcaaagtttatttctagtcggagtggagtctctgttactctgccaatcaagttctaaatttttattccttctagtgcagcagtggcaaatacctgacactcatgtgtctcactcaagacagatactgtttcacccaagactgatcatgccgctttcccagtcaaggcaggcttctcagaatccttctcatttccgcctctgttctttggcactaatgctctgtctgcccagagttttcattcttcacttgttccaggcacctgcttcctggtgaataatgtaaaacctgctagtcatccttataggagaatatgcactcatttcccagcagcacacccgactcaacgtggttaaaaccaatctaccattcccatatattcagcctaacttcccagtgcagtctaccctagttttataacttgttctactttttccagataactgctaatcatctttgtttgtctttgctttcttttttgcactgtgtttgatatattagggtatcaaatcctacttattcaaatatgtcccttattcattccttctatccttggtgctaccatatttgttctggctcttgttacctcattatgggatataaaaatagcctgtcaactggtctttccattgccaggatctctctgttctaagccaccctgcctccagatcaatcttcctagagtaaaaccttcattgtatgacggtctagctcaaaattccttaatgattattaatcacctcttaaagtccccaattcttagactattagtagggtaaaattatttttgatttggagtcaaaaaattttggacgcaaattttggctactacacttaaccattatgtaacttcgaatttcggcttaatttttattcatcatttattcagtatctatttgtttaacaccttctgcatctcaggctctgtactaggtacttgggatacaatgatgagccaagcagaccttgtccttgctctcctggacctcacaacatggtgaacttgtctctattgctcatgatcataataatcctaagtacaggctgtgcttttttcccttgatacttgtagcttttggtttgtgctatgcagggtattgtaataccatttgcagtgccacaataatcagcatatatgtgttatcactcagccacattgcagcttcactgaagggcaggggctatgtcccatttctcatagcgcaagcacagtgccctgcacataccagctgctcagtgatttctgatgtggtttttgtagatccagggttagtctttggcagtcatgatgcctagtatgtttttagaggctccctttgtcctatcagaattatgctatttaaaaaaaagtcatacctatttagtttatattcattctaaggcctctcctttccaacctactaccctgcctataactattataaggagaactcacaatgtttataacttgtgcaccttaagttttaaatactgaataacaggcccattcatgtttcctcatagaaatactgtctatatgcatacaatgaaatgttaaaataatgttctttttactaaatagctttttgacttggtaatgaacaatatgttgtttttccctgagaagtagttctaggactttagttctgaagattatgttgtattttatacattttcagcctcctgtttttcagttcccagtgatcttacattaaacatttgtctgtctaaaacaataggttaactatagccaaattataaccataccattcctctccacacaaaatcctataaacagcatgtgatcatattgcttctagaatttatgattgttttcttccaaaaggaagctaaatttagcctagtaattctacatgcgctcaagaaaacaatgcctgctgtgatttctagaataaatgaatgtgaaccacagttcctttacttgactaacagagaaagtttaaatatcaacctagtcattaaccacagttattaaaccacgttaaacaaccagcaaggggttaagaaagaaagttgctatgttttttctttcattgctgaatgagtctaacttagttactgtatcaaccttaatacagaacattgtttgcatctcaatggttctctaaaattattcgttcatggcttgagttctaaaattaaactatgtggagtcatgtccaaccgcacaatgcatctttatgtgaaacttgctagagtttttgttttccttctatgtaaaagtccagttgggaagctttatttctgatagattaaatggtataggtctttcagttttctcttcatttctgacaactgaactgctctcgccttgaacctgttttggcagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaatagggtaagtcacatcagttccccacttataaactgtgaggtataaattagaaataagtatcagtctcaaaaagaatatccagggcttcttttgtgctttgtaaatggtgtttatccaaaatagttgcagattttttccaagaaaattgaggaattgaatcttcatttacacctaaaattatatctttaaaatgtaaatggtaactaaaagaaaaatgtttttacaattcagatttgcatgttcgtgacatttcagattatattaaagttatttcccatataagcttttttatatttacacagattttatcagatttacacagattttatcagatttacacagatttttatcacagcagcaattcccataaaacataattattgacatttctatataatctctgcaacatttacaagatgttcaagctaatttgtatgccttaaagaattgttccttatgagattatattctctcactgatacacaactgattaatctatattcttgacattacttaaaggaacttaactttaaaaaacctcttctgaaatgctggtaaataaaacatttttaaatgagctcgtatacttctctaaataacctgtaagagtagagaggaaatgtttgttcccaagtccttcctttagagcttgactttaatcatggacttccttctggaaaagacttgtgtctaccaagttctagcttggcactttacctggttggtatttgttatttataagcataaatattttggttgatgattatttatacttatatgaaatggtattttcttaggagctgttagagatattcttggtgctgtgatttaaatatagtaacagctaccagctatacctggagatttatcctgctagtcagttgatcacctggtctgagtgtttattgtggctttgagtttcttgatctgggccagatttggaatacggacctgactatgaccatcattgaatgaacaaatagtatagcttttctaaagacagtttgactttggcatggtatgtttcacttactttaacaggtttcaatctaagatataaaggttataattgcaatcaggtagaacattaaacatgtcctcagtagcataaagtatataatttgctgaggggtaaaggcatatgaattcagagacatttggttgacttttgctgaaatgtctgggacacttctctagatggaaactatagttaactttttatgatgctaggaaaatacttccaagaaagtcagttcatcttttggtgaactaaaaacaaaacttccttcctctctcttccaaagtctatgaatatacataacataaatgcacatacattccaactaagacttatttccccctacatacatttaatatatgttgcaaagaagcaatagaattccttatgaagctcccccttttctttactagaaactacaaaagaatgaaaggaaacaaaatgattttcagaaacctgggattaggaaataaaaatataatattaatagcattacagagaagatatttttctgcatccagtaagttgattctgagacacaagttttaaaagagtctattaggaattcctccagggctcctagagcacatggatttgctatttaaatctttctttgttaaaaattaaaaagaagggtagggcaagaaaaaaattaaaaagagaattcataaaggtatattgatatctcattttttaaattttgtacatttcaatccttagatgtaaaaatacttatcaattctagaaattctcaaaacacatctgaattttatcctacccttttgacttttttagtgttccaagggagacaaacagacaggattagccaatgaaattcaggtcagttttatcgcccaggaaaaattcccaaaatgcactagccacacctgaaaccattatcactcccatcacaaaaattcttgcgggaaacaagatggaacttgccaacatagtcttcttacaaaggaagccaacttttacactggccaaattccatagacaaataccttcaaacctcctctatttatttgcctgtttatcttctctggttacaaagatcaaaattcttctgagactgagactacacatattctctctctccatataccccatccagacctcagattgttccaataatgagcatataatcatttcctagcttaatgccaaaatgaaggcacctagagccattcatcacacacaaaaaaaacaaaatgattacaagatcaaagctgtttagcaggactctcaagcaataagatgactccattttgtcttggcagatttacttggccagaaatcaagtgacccttttaataatttcttggaactgagtttttactttggcatcaagtttggtgaaaagacacacatattgtagttttgttattaacatctctaatacatttataaagggactcttgtggacaaggttaagaaagctgagctgcagcagtaactttctacttatgcttctgcccagtcctcagtgttgacacattgctgaaagagggatttcctggcactccaagagctctccaccatgtgcaaaaagtgtttctatcacaagatcagataatgggagtgccagggacgggccttttacattttaggggtccagcaggtgtaccaggcctgacttgcttgtttaggatcacatattttgttgcttttcccagtctcacatttcatgaaatatgtctatgcaaactcttcacatgcatcttctcatattgatgacatcacaaaagccctcttttgagtcatttgataattcccagtactcgtcatcttcacccataagctatttgtgcttcagaactctttgtctccacatatgatgctgtttctggaaacttatcccaagccacaaatgcccacttatagaataccagtgttgttgactatgtcagttgttctataagaatatattcttgatcctcacaatgtgtccattttttatgttgcttttgaaagtgattctaaagaatttgtttacagtgacttccaatattgagtactatgagattatacacccacaaataattactaaatctgtttaatatctttacctcctcctttacccattcatcaatcaacctctataagcatcctaaattagtattgattgaagttgttttaggctaatgcatattctctaaatagcatattattattcaaaataaaataattgagaaaattgtcccataatatggatggaacctttgtaaaggcccatatgtagggagaaaaaaccctcatctctatttgaggataagcagtagcaaaaatttcattaacttgtttaaaattaagtggaatttaattttaagactgtggaatctctaacagtcttttacatataagggattgattaatgtgacaatttcaggaaaaaaaggagaatcagtacacattggcccaatctcctacaaatgagaatcaatacagaataagagaattttttaaatccccaaatcagcaaagatcctgttccctaagttatagaatatttattaaaacaagtgaaatcgtacattttagaaaaaattttaatcaaagttgaaattagaaaagcattcttgaaatagctctcgcctctcagaaaatacaattagcacacaacactgtttttcttgaagttctattatcaaagttttgctctatagataagcatttgaaagacctgtagcaagtattttcgccaacatcttgatgaccttaatgaccaaagttggatcaagtgaaggggaaaagcatttggtgccagacacacctgggtggaagtcctggtttactgcataccaaccatgtgacttctgccacattacctgacttcttggaggctgagtctcattggtatcatgcagataacaatacctacttcacaggtttttgtgaaaatttgggataatatatatgaggtacctggcacaagatgactataaatttagcccgttgggagacagcatggactaatggaaagagactaaaatcagagatgttggttcaaatctgaaccccaccgtcttctacctggatggccatgaaagcattatttaaactctgaacccatcgtcctgcgtgcaggactatagtgtggacaagtatattaataacatctgtaaaaggtcccaacttggtccttggcacaaaataaatagcagctattattgtaaggaatacttgcgtaaagaaagacaaattcaaatgattggattattctctggaagaggcacattctggttctattgtttacaagtctttcacttccctctctaactgttatgagtgacctacctccataatggttaatttgtgttatgttgttcttaagattataatagttccaaaaaagagatggggtgaggagtggtggtagtttgagggggcagaggatggggagaaagacaattgaatcaaaactgtactatagtcaagttagaaggtataaattgttctccttcctctcactttcaatcctaactatccatgacctaagatattactcttatgtactttgtcatatcttgcattcaagaatttgcagataatgcagttttagaaaaagtcaacctcataggttgtttgtattgggcttccttgtttttaaatatcatttatactcaaattcaaagagtagccaactgcttcccaaaataaaggaaacttaaggtagtaattttccatctccgtttcacagaatgccaaagttaaagagtcactactcagagccatcaaaggaagaaagcaaagtgattagaacaattttaaaggaggacaaaaatcaaaacaagatgcaaacaaggaataataggaataggcagaaaaataaacatacagtgatgtttctttattatgattataaagatgatagatgagtaaaatcgagttacatttaagttgtaatggaagaaaataattgcagccttccatcaggaaaccacaaggaccgttattgatctgtcatcctcagggcatgtctcgtaatatttaataaaataaacaaagatttataacttttataggccatatatctataatctcccacaccacttgaactgtgaatgtggagtcaatgttacaaataacatccatgtgattatactggtttggcatgccttattccaacaatctagcactctcaagagaatgtattttgtattagggatgaaaaatgtgaagccagattatagagttttttacttattgtgctcaaaaatgagaaaatgttatccaatatgaaaaatgttgttaaggattcttcattcttaatattagacagcctttcaaacctaaatattaaatatcttggccatatgccaaatgtaatagctaccaaagcaaaatcttgcaagaaagaaaatccttgaggtataaagattcaatgtactttttaaaaaatgtaagtaaaaggttattaattttacatttcatttctttttctttcctagacactacttcatcctctcataggctcagggagtcactgcttcctaacttctttattttaattatccatgctactcattccacgaaaagtggcatattgcattattttattaaaagaaatttaaaattagtttctttccagaattttgtaacgccccctgagatcactgggcacacccttggggtgttagaaaacatgttacaaaatgaacctttaattccttttgctttttcccttcctcttgctgactgctctttaaaccattacatggctcattcacaagtctctctaccccaggaaagatgaaaaagcaaaggcatgatgtttttataacctaatagcaagagaacacagtgctgaagctgtcaccaaaactgtgggtaggttttacccgtgggttatattaattcatgatatgattgataatatctctcacttgtgtggggaatgaagcgttaactatgccgcatgcattttaaattaatttgacattattcttaatgtcctttcaagcaggtggcattataacctgtgtcttatttaggtagttgatttctacacggagattcatctgataaaactgatatcgcaaacgggaaggagtttgtacaaaatgaaataaatcttaaagttgatttttgtaaagcccaaatgttaattaaaatctttgaatccacaactctgatacatgatattttcattgacataaacatgattagcgatttctggaagcatgtgggatgctgcattgataaggatatgaacctccttgagtaataatgtatatttttactccgaatactgtttcacattttgggtgttacatccttacttcagacttctgccttatcagtggccatcccaccctatgttcttatctcctcagtctaaaaagaaaaatggggacccatcagaatttggatagaagaccctccaggaatttctgccactgcttattcatgggttggcacagacactgattcagtgggcacacagagttcagaatgattcagagcccagatatgtgccctaagtcacatctccagcgtccagggaggactgtaaagtgctcgttatcaggaaaatgaaaccaagggctcagctactcctgaagtcattaaaactccttcccttgatttttttttttttttttttaaatagtatatgtggtaaccgaatctaggatcctggatacattccagtctgctaattacatatttttttctaactaaaatgttccaggcaggttcatttgcatgtgaattacttgctgagccatgttgacttcctattctaaaagcctcactctgccttgggaagcagtttactgcacttcaccctagacctagtctaatgttggagcagacaaagtgtagctacccatatatacttcaaaaatattttccagtctccccacaagaggaaagaaaaatgtctagcaattgcatgctaatttagaccaaagctttgttttaaccattcttggtgatcacaaatggggaaaaatgatttatgaacagtataactataaaacaaacaaaaaaaaaccattgtgaattcagagtgaagtctgacttcatttgtcttatttgggtaaatcagcaaaatgttcatcagtcagaggacattaaaatggtagatgatacttcaaatcgtgccctagataaaaggagagaattaaggttagttttgatttgtaaaccattctcttcgaaggctgattttataaaaattaagtttgctgagtcatcatctcaaaatatatagttattcatgattagttaaaatttgtgtctgtgtatcaaagaagtaaatttgtatgatattaaattttctaacaatgttttaaattttaaaatgtccgattaacacttgcatctagcaaccagtctactaactaaactataggtgaagtcatgctcaggaaatggggaaaatgcacagattaaattggtctgttagctctgagtgaatcaatagtatttagtgctaatgcactaaggagattacaagcactaatgcagtagcagtcaatagcgaaaactaatatctctaaaaaatatcttgacaataaaatgtgcaatattttccatttatcttaagctaattacattacctgcttgttctttcatcttattagtttaagccaagtgctagaagcctaaccattttatttagtgcataaaagggccaaaaccttgtaatcattgttttcagcaggagacagaggaaaggattaattcatgtaaccaagattcaaccagaaattcaacagatatttatttagtctctaaacctgatagtattacaatggagaatgagctagactgtacctgtcttcaacaagcagatagactagtgaagatgacagtaaacattcagtcacaccagtgaacaaatacatcatgataatttatgaaatgtgctgtgagggaaataaacatctgtgaatgcaaatgagagggaatatctaaatttggtagttgagtcacaaaaggctgtcctgaggaggtgaaagctaacctttatataaagcttaaaactttaaaaaagcaatacgtctttagtacacaggcaaatatataaactaaatatataaactaatagtcattacttatttcacaagctttacatcttaactacaagctgctacattaaatcagctttcttaagtggtttgtggtcattagtgcatactatcttacacttagaaaaacattgcaagaagtagtacaatgctggagaatttaactttttaaaacatttcctgccttaaaataaacagcagtaaatgtgtttaaacattcttttgatttctaaatgaattaagttactttttattatgtggttcttcttcatatgaagaaaataatatgtagattactagaagctaagaacatactttagatcctgctcacactcactgcctttcctggcctgtcaccttaatcagcttctttgaaaatcactgtttcttacataggccaggttgtttcttccttgtttccctcttcttccttctatggccaacccttgggaccccgtttgtcagaagaacatgttcctctttggggaggaggggattgtccttttaccaataagttttatgaccaagagaaacataagaatctgagaacacacaaaataagctcttttgaaactatcaaaattataaacattaatagaattcaagggaatgtgatgctgaagtgatcccaagtcacattgtctttctgcctctgtgcactgtactctgcacaattgcatccatttttagaccatttccttctcatgagaatcatgtgcatggagggccaaaggagagacaagtgctcacaaggatatcatgagcacttatgaatgtacaaatgagtgctctccagtcagtgccatctttatattgttccggtttataggcaatgccttcatctttacctacagacacatgttgcctttctgtttcattttaatcctgttcatctatacatatttaatcacacaaatatctaaataagtttatgtcttgtagggaaggcactttgtcatgcttctttgtacctaagcatatgctttgcaaatcataaacaatagtgttgattttatttgatataaaaacttggattctcaaaagaaatctatgtgttcacacgataaacagagaccatctgaattgccaaagtatgactgaatcataagcagtattgttttagtcatctttacagaccaggaagatttgaaatacaggtgtaaaaagatgtgtgaggcatcaaaagaaatattcacctttctttgtgttcattttttttatttttgcttggccgagaaagaaggggtgttttccaagggaataggaggcttcagggcttattcctgtgcctacaagtcagagaggtcactggcttgccccttcctgaaggctgtaattacaggcagaggactatttattttcccgtaaggcgaccagaatcttgagtgtaaaaaactgtttacaagagtacactgtgtataggggttacacacaacctcaggaaaaataataggaaagtgagactatttttcttcatgtattcaataatatgagaaggtccaagactctggaaatgttctaaagtacaataatagagatgaatatgaggtcaaattaggtgatcctggggcttaaggaactgaattaaatgaataaagaagaggaatttctaatagggcataatctaactgataatttgttaaatgtaaacttatttgtggctccaacatcatggtaaacaagaatgaataaatgtattagtaagagtaattgagaagtatttctaatgtgaaaaacaccaattacattgggtttatctggcgccaatgtggaaataaatgagcaatatttcttactctcaactaaacttactctcactttcagaactgttataggaaaggtattgattcaagtagagttgggcatgcaaagcacaagatcaattctgttactggcctgatattaaggatattagtcagtgtttgaaaaaatgatttgtaatatataagtagtagtttaacaaagtaggtaaaacttgtaattaatttcaaaaggtcaaagcagagattattgacatgtacaaagaggacccgctttatatgtgcctgctttgaaaagtaataccgtagtatggtaaattgtgactaattctgagattttctgtctagattctttttaaaaccaaatgcttaagaaaaaaacatgagacatgagtagcaattacattttttaggctgagtaggtagcataattgcctcatgcctgcctcctgtctccatttgtttttagtagattttgcacagaaaaacatgttgacctcggtactgaaattttggagttcactatttgcggcacagttacagatcacagaaaaaaatgtacaacaggacttcaccacacctaacaaaagaaagttttcttattaaaaaaaaaaccctccaaattattgtgagatctagggtaaccatggtgttaactatatgctatttgatatcttataaccctggtgataagataacaatccaattgaatgcagatgaactcatgaaaaaagaaggattatgaaatatttggaaagtaaacacctaaattttcataagtaaatattaattatttgtgtgatctttagatatgaaagcttcccctgcatgcacttggctcttggaaccagctgttaaaactcccagcaccttagttaataccctgtatgctggtggttcaagaactagttaagaaacagtcacattttctattttcactgccaatgtataataaaatctctgttccagtgaatggctggccaattattttaataacgatgttggcatggcttcattttacctttcttgctattagcaaagctttccttttgtactctgaagtacgggtaaatcacaaattaaactgagctgttgtttgtttaatgctgtgtttcctgctaaccttattcttgtctatcaacctgaacgtagttccccagtggctcagaaaaccctcaattgggattaagtaatagtttacacaaccttgctcagtcattaacctgtgttgactttctcattcttgtgttccagcctcatttaagagtttcttaagcactctatccagttgctggtttggtgacaactaacaatacctatttaatcaagaaatttaatatttccaaggaatcatttatcgtatctcagacttcttcattaacataatctaattcagtcttgtattccttcttcaaaataaagcctggtttcattcatagtaaatatgaagcttaaaaatttttacttcttttcttctctatacacacaaagcagaaagagaaaattgtatattatcattccagacaggtttttttttttgtttagtgtattgacattgatgccaataagataaaactagacctcagtggctcctcctcaactccacccaatctatttgtctccaaagtgctgttggagtaagtaatctttgttaagagcaaacctatttgtatatctgatgataatctgagggataataatatgatatttaaggagtttctgtccttggccctgactatttcctggtcctccttcacgcccagtgatgtgctggtaaatgttaaactctggggggaggggcagcagaagcccctaatttgtagcatttgccaatttctatggtgtaaatatcccactgagccagtttcaaggtaccactgaaacagcgttagtcactgaacaacaatgaggaagagatgtacacacttggctctgtgaactgttatgagatggttcaagcacagcactgccaccctgtcctacacgcaacctgtcattcttgtagttcccagaatccatcagcctccctcacaaccctgccttaacacgtgtagcttggtccacttcagattccctttaacactcattttgtcaagtgaacactttttccctattctttaaaacttccatgctggcattttccttccccaggacatttttccctagccttcaactcatcccctgccccccatattctggatttgttgcgtttcctgagcacaccagtagcactctgcttatttctaccatgtctcttatcacactccgtggtaatgtgtccaacagttccatcgttagccccctgaggggatgaactatgccatttatctccacagtcccagcacctaatacaatagcttgaacaatatatacatttatcggatgagcaaagaagtatgacagagccctgtatgtaaaatatattactataaatagaatgctgattcataaaaataattatttagataaaacagtttttccgtctctcccctaaatccctaaaaactaatttatagaattggggagttttcaagagctaaattagcactggagaaaaactggggagttttactcactattacctatgcccctcccgtcccccccacacacaccctccttcattcaccagtctgcaatgaagattgatcaaagaacaaagaagaagaaaaatgaaagaaaaaggaaagattaagatagggagggtgaatagataggaattccagagttttgtaatcgaaatttggaactcagaattaaagtcattaaaaggagaaagagggaatactttctctgctcccgtaaggttttctcaagcctttcaacagcactcaccctttgagcgggtgataccatctgtaagagggactttacgcaatgctttagtgggcgtggcttgagcagtgacaccagtagagatacccccttgaaactttcatttgaagtccacagattttcactattggtcaccaatccatgatttcaagttgaaaatgatatatgggttaaggaaaagaggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggggtaatggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaggaaaagaagttaagggcaaaggtctttatcaacaccatccttcctgtggccacaggatcgtaatcccagtggcaacattcaaaggcaccaagtacgtgcttggtacagagagaagctttcctgagcttggccttggtgtagatgcagtgagaactgagtaagggcctctggcagggaccttggctgctgagaaggggagcccacagatggaggtttctgatcaacaggtcctatcagaaacaaggggagcagataagtaaagagtctcactccacggtggcaagatggaaaggagggataagaggtcatgacagttggattaatggcaggctagaatatagtcatgggcttgaacgatatattgggacacaattgaaggactcttgtttcatccatcgttcatctctcctggccctctgtgaagacatttatcacctgtttctattgaatgtgacactgttaggcacataaacagaccatggctcttaccacctccaagaagaactacttctgttttatttgttagtgcagggtaattggtgttgtgtcttctgaaaatctcttatacttctatgagtaagtgcattgaaattgtttctgttaactaagtagaggaaagcagaaaacctctttgcactaagcattaaaaccttcctaacttggaacaattttctttatgaatcactctgtcactcctggctatgattgaagtgcagtatgaaggctgctaaccaaaaacacatggacacagtctgtttcagatctgattcaccttaggaaatgatgataaagaagcaaaagttttaacacttagaattccaaggtccatatcattgtagaattgattcttttgaattgtggtggtacctcaagagaaaggatttatttatttcatttatatttaaatgcgtttgtatacatatgtatataaacccatatacacatatacataaaatatattctgctccaagtatttatctctcttttctctttactaatccagcttccattaagaactggctcaacttcgacctctgccatgagccttctccagctgtttaagcccacacagatcttatttttttcctagtcttagaggatttactgccagtacagtgttttcagaatgtaactatcaactgagttcttatactttgcatcagttagctattgtacgtgtcaatcttttgtctccctatgtagaggctagacccaaggtagaagcatttgccaggattgacaaacgatagcctgtttttatattctcaacaagtgaaaacttattttgtttatatttttttccctttttatacagttaaacactcacatgcacgcacacacacacacacacacacacacacacacaggccacagggaccctatggccctcaaagactagcatatattctatctagccctttcccaaaaaacatgtgccaacccctgcattagagaatagtgtaaaataatagtggacagataacaggtccacaaattttggagagccatggatgaccttacttatgaacttaagtaattctcttcaataggtgtgagtgtttccattttacagatgatgaaattgaggctcattgatctaaacaattggattttgtcttcataggcattatgagggcttactagaccaacaatagtgataataataactgtttagttgcacaaggcagggatttatgtcttttttatttgctgccatatccttcagcacctagaacagtctgtcacatggtatggtattatattcattttccagagctcccataacaaattaccacaaactgggtggctgaaaacaacagaaatttatcctcacatggttctggaggccagatgtctgaaatcaaggcatcagccagggccatgctccctctggaggctctagggaggactccttccttgcctcttgcaattctggtgtcccaggcatcttaggttgtggcagctttactcccctctctgcctccatctttatgtggcagtccaccatgtctctctgtgtcccctcttcttataaggacaacagtcattgaattcagggcactcactaaatccaggatgatttcatctcaagatccttaactaatcacatatcaaagagcctatttccaaataaggtcacgatctgactttccaggtggacatgaattttgggaagacattattcggcctactgtaggtcttctaaatgaagtgaccatttaatatgtttctggcactggattcatttcatttaagcctcaaaacaaatctgttatgtagatatgtgttttcccactttacaagtgaagaactgaggtttagagatctaggaatcctaaagctgcacagccaggaagggcagggccacccctgacccaagttctctgctaggttagcatggttgtcacaggacaagctgagaaggtatttagggagcattacactaaaaagttgtagaagtcggcttaaggaagaagattctaaaatcaaaggaatcagattgtaggaggccatgtaggcaatttcctttaattcaatagaagagagtataagaatcagccaggcatggtggctcatgcctgtaatcctaacactttgggaggtcgaggtggaaggattgctagagcctgtgaattcaagaccagcctgggcaacatggcaaaatcccatctctacaaagaaatacaaaaattagccaggtattgtggcacatgcctgtagtcccagctactctggatgctgaggagggaggatctcttgagcccagaagggaagaggttgcagtgagccaagattgtgccactgcactgccgcctgggtgacagagccagagcctttcaagcaagcaagcaagagggaaggagggagagagggagagagagagagagagagagagagagagagagagagagagagagagagagagaaaagaaacggagagagagggagggagggaaggaaggagggaaaaagagagaaagaaagagaaatatgaaagaaagaaagagtaaggaaggaaagaaagaaggaaagaaagaaaaagaaaagaaagaaagagaaagaaagaaagaaagaaagaaagaaagaaagaaagaaagaaagaaagaaagaaagaaagaaagaaagaagatatgaacaataaaggaaagactcaaagatggttcagatctcaaacttacggagagggtagctattgatgcattgagaaataggaagctggaagaggaaatcagtttggagagaaaagtgatggctttgaacatcatcaatggcgtattcaaacatagcttgaaggcatttgcagagacagggctggtcctcggaagagatggcaacggggtgtgtagagttaggtcatcaccacgaggctgtgagggcagagccacagtagcttccatcaccttgtgaatcaccagtgctcagcccgtggctggctggccggatgcctgcttatgctgtgctcccggctgtctggctgcacacacaaccgcagagcatgccctctctggctagggcagaaagaaattgaagcctcttaaattttgccccccccagctttgctcccttgctaggacttccaggccatgactattgaagccatagggcaggattacttcctcaagaggcgttagtggaaacagatgtgttgaggaagcctctttcttttcaactgtgccctgagcacatcagatggagtcctcttcatagcacaaaacaacttggtcagattcttagggtttgaccacagcaccctaacagcctggccgtgcattaaggaccccaaagagaaggatctgctttgccagagagctgactcttctgtattttacagacaattctgaattcaatgtcaacatcttagacatctcagtacagacagtaaagagttaaaatatgtctataagaaacagcgccagaccctgaaattgaaagctctgtgcctccctgcgtgcagtcagttccacactgtcctctctcccagttctatttaataaaaaaaacacatgagtgaaatttagggaaataagaattcctgaaattaaagcaattaagttttcagtcaactgtatgaaaagctctagacaaagaggtactttctatttcaaaatatgtatttcccagaaaaccattaccatatctagctagaatttctacaaagaatgattatgaataaagtatatattcaaatgcttctggtaatttagtcatggtcaaagaggagagaaaggtgatacaagtgaactggcaaagattttacaagatagtacatttttaaaaattttatttgcaagactgatttaaattatctatagatgagctaaatctgtcctatagatcaattaaatgaatcactattttaaatatatcacattcttaattacactgaattaaatataattacatattcactgcatacatcataatgttaattaggggaaacattttgaatcaaatatattgagatatatagcacttcaattttctttttataaaaaaagctatatgactaagtcaggtaaaaagaatctggcaagtactcatagaaagctaaaggaagactagattaattgatgtatcacatcaaggcttacaaattgtagaggaattcctattctttaactctatgacagtatataagactttgggctaaggaagcaagtttgcaacaagtttttaaaaaataataaaacaggaggcagggcacggtggctcacacctgtaatcccagcactttgggaagccgagacaggtggatcacaaggtcaggggttcaagaccaacctggccaaaatggtgaaacccagtctctaataaaaatacaaaaaagttagccagatatggtggcgggcacctgtagtctcagctattcaggaggctgaagcagggaattgcttgaacccaggaggcggaggttgtagtgagccgagatcacgccactgcactccagcctcggcgacagagctagactccatctcaaaataaataaataaataaaaattttaaaaaataaataaaataaataataaaacacattgtttaccattgtttctcagagacatacgattattttagaagtggataagccttttttttttatactttaagttttaggatacatgtgcacattgtgcaggttagttacatatgtatacatgtgccatgctggtgtgctgcacccactaactcatcatctagcattaggtatatctcccaatgctatccctcccccctccccccaccccaccacagtccccagagtgtgatattccccttcctgtgttcatgtgatctcattgttcaattcccacctatgagtgagaatatgcggtgtttggttttttgttcttgcaatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgtcgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttttttcttgtaaatttgtttgagttcattgtagattctggatattagccctttgtcagatgagtaggttgcaaaaattttctcccattttgtaggttgcctattcactctgatgatagtttcttttgctgtgcagaagctctttagtttaattagatcccatttgtcaattttggcttttgttgccattgcttttggtgttttggacatgaagtccttgcccatgcctatgtcctgaatggtaatacctaggttttcttctagggtttttatggttttaggtctaacgtttaagtctttaatccatcttgaataaatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtagttttttccaattctgtgaagaaagtcattggtagctttatggggatggcattgaatctataaattaccttgggcagtatggccattttcacgatatggattcttcctacccatgagcatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttccacttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttaacatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagggaggattctctctttttctattgattggaatagtttcagaaggaatggtaccagttcctccttgcacctctgatagaattcggctgtgaatccatctggtcctggactctttttggttggtaaactattgattattgccacaatttcagctcctgttattggtctattcacagattctacttcttcctggtttagtcttgggagagtgtatgtgtcgaggaatttatccatttcttctagattttctagtttatttgcgtagaagtgtttgtagtattctctgatggtagtttgtatttctgtgggattggtggtgatatcccctttatcattttttattgtgtctatttgattcttctctcttttcttctttattagtcttgctagcggtctatcaattttgttgatcctttcaaaaaaccagctcctggattcattaattttttgaagggttttttgtgtctctatttcctcagttctgctctgatttagttatttcttgccttctgctagcttttgaatgtgtttgctcttgcttttctagttcttttaattgtgatgttagggtgtcaattttggaactttcctgctttctcttgtgggcatttagtgctataaatttccctctccacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggttttgagtgagattcttaatcctgagttctagtttgattgtgctgtggtctgagagatagtttgttataatctctgttctcttacatttgctgaggagagctttacttccaagtatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtactcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagctcttcctccatccttttattttgagcctatgtgtgtctctgcacgtgagatgggtttcctgaatacagcacactgatgggtcttgactctttatccaatttgccagtctgtgtgttttaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatatggaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcaaggagtatctttgtggtgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctctcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttcttttcctttggtttgaatgtcctcccgtagctcagagtaatttgatcatctgaagccttcttctctcagctcgccaaagtcattctccatccagctttgttccgttgctggtgaggaactgcgttcctttggaggaggagaggcgctctgcgttttagagtttccagtttttctgttctgtttttttccccatctttgtggttttatctacttttggtctttgatgatggtgatgtacagatgggtttttggtgtggatgtcctttctgtttgttagttttccttctaacagacaggaccctcagctgcaagtctgttggagtaccctgccgtgtgaggtgtcagtgtgcccctgctggggggtgcctcccagttaggctgctcgggggtcaggggtcagggacccacttgaggaggcagtctgcccattctcagatctccagctgcatgctgggagaaccactgctctcttcaaagctgtcagacagggacatttaagtctgcagaggttactgctgtctttttgtttgtctgtgccctgccccgagaggtggagcctacagaggcaggcaggcctccttgagctctggtgggctccacccagttctagcttccaggctgctttgtttacctaagcaagcctgggcaatggcgggtgcccctcccccagcctcgctgccgccttgcggtttgatctcagactgctgtgctagcaatcagcgggactccgtgggcgtaggaccctccgagccaggtgagggatataatctcgtggtgcgccgttttttaagccggtccgaaaagcgcaatattcgggtgggagtgacccgattttccaggtgcgtctgtcacccctttctttgatccctgaccccttgtgcttcccaagtgaggcaatgcctcgccctgcttcggctcgcgcacggtgcacgcacccactgacctgcgcccactgtctggcactccctagtgagatgaacccagtacctcagatggaaatgcagaaatcacccgtcttctgcgtcgctcacgctgggagctgtagaccggagctgttcctattcggccatcttggctccgtggataagccttaaaaggctcaatactttttaaaaatttcctataaaatccagaatctatctagatttttgagcagcctgtagtggttggaggaccatgattgtttactcatttggtcacctaaacatcccaagcaatgatttgttctgacagcagactgataacagttttttttactccttggaatcggaaaaaaaatcagcaagggaagcttttggaagccacccggtagagctggaagagaatttcgaaatcaattcgctcaacctctccctttacaggcagaaaatgtgctagattggaggtgaagaccctggagccagagagcctaggcttagtcctagccctgcactgaaggtaatgtgaacactcagtgcctcagtttccttctaggcttcttgttctgagattccatgaattaatatttgtaaaatgcttagaactgtgtctaacacattgtaaacactaggaacaaatgctaaggtcatgcaactcatcaatgcctccctggggtagaaccagccttggcccatgggcatgctcattcttcttttagacaaggctcttaggcatccctagagtgtgggttggccttcctatgcctgtacgtaagaagtatgatgtaatgtaaggaatataggattcaaaatcaacaattaggattcaaatgctaatatttattgactcaactctctgaatcttagtttcttcatctgtaaaattataatgatcataacaaacccaagtcacagacttgttcagaggagcaaatgagataatgtactttgaaaaccataatctactctgcaaatgttatgtaacattataattgtgagttcagcaaagccatgagaatgtttcaaaactgtttaggacatcaagaagttggggtggggaaaattcttaataggttttctccatatcctcattttccatttattcattgttttaaaatttatttttcttatgatatacatatatatatatatatatatacacacacacaaaagaattatgtacggtcctgcattgcttgcattctgagaaatgcatgaataggcaattttgtcattgtacaaacatcatagagtgtacttatactaacctaggtgatatagcctactacacacctaggctgtatggtatgaccttttgctcctaggcaacaaacctgtacagcatgttactctgctgaatactgtaggcaattgtaacacaatggtaagtatttgtgtatctaaatatatctaaagatataaatatgtctttataagtatacaaatatatctttaaatatactagtatatatttatagatacaaatgtataaatatatctatagatgtactagtatatatatttatagactagaaaaggcacagtacaaatatgatattattagcggggtgtggtaattcatgcctgtaatcccagcactttgggaggctaaggtgggagaattgcttgagccctggagtttgaggttacagtgagctacgaacacatcactgcactccagcatgggtgacagggggataccctgtctctcaaaaaagaaactaaaacaataagatagaatcttatgggaccaccataatatattcagtctatcactgattgaaatgtcattatgcagcacatgactatatatatgtatatatatatatatatatatatatatatatatatgggatataaaacaaatactcatatctctaccaccaggctcaaaaagggaatattacctttgaagtcccctgaatatcccatcctagcaatattcctccccctcctggaaaagtgggtaaacaacaattgtaagtcatgtgtttgtctttcctttgcctgtagttgcgctacacaggtgtgtgcccagaaaatattctttattggatgcatggggtttccttcttgactcagagatctcaagctatacggtatcttcctgcagccttatagtgtccaccttattctttgtcactatttccctttcccagccaataaagcacattacctctgtcattcaaatgaactcgtaaagagagattttagaaaagagctggttcacctcaggttcacctgagcaaggaatgggtgtcagtgactgtggaaagtggagcacagctgccagagcagtgcaaggacccaagaaatgggagggtcttgactcgggataaccactctgagattcattggatgtcctagattgtcaccttgccttacaccttaagggagaaaaggataaaaagataaggcagatgtgaaagctatactaaggagcttagacttttcctgcaggcctttgggaagcaactgaagctttgaagaagggaatgacagcttgagactgcttcaaggcagaagagataggagaccagaaggccagtgaggaagcacttaggctgggccaggggtacaggtgtggctggaagggctgcccagaagcaccactgtggaccaggctgagcaggactgagtgactggttagatataggaaatgccagagaaagagaaggtggtgatgactgaaatttcagagttacctaaatgcaagcatggtatgttcataaccaaaataggtagcaaggagagctaggtttgagagccaagctgattagtacagaatgcgagtggttatctctgctgtttccagaaaataaagattaatttcagccttaaagtcagggacttaaatgagatgatctcgaaagccctttccatttttgtaattgtgcaatcctcagaacgttgcccagaatagtaagcagaagcaaaagaaattcaggagtttgaacataagagagagctgttctctgatgcctgctccaatgggaactgggcactgtgactgagccctcggctcactgagtctcctcctgaggagtgtgataaaacctcacagggctgctgtgggtcttattatacatgaaaatacccacctcagtgcctggcacattctgggtgcaggaaaaagtttgatttcctccctcccttccttccttccttcctttttcctccctttgttaccataggagagagtcaggctggttccctgcgggtgctggtgtgaaacctgctctttagactcttctgcagttccccaaagcagctactgtcccagagaactgctttctgccagcaatgctcagttttaccctaagacacgataactcctggctttgagggaagcacaggtagcaaggggacccctgacagcaaatgtgtagttgttcttccagctaggccccagccccaccttaaatgccacatccaggcactgtgtctacagtgctgagataaagcaaccccgtcttttccacacaaatgagcagcaaacatatttgctgattatctttgagggacataatgaatcagactgagatttagtcatatttgcacaatgctttacatctgagatactgaaagcttaatccaaggtttccctgttagttgaagtcctactgttagggctcaaagacagggtgcagctctgtaagccagtccctgatgccttgatcccaatcattgagtttatcaggattctccataggaagacacaaggagcacctctgctgcagcaaatgctggagtgttagtttttcctagaggctagtgcctcaacacctcttctgcagatctcagctatggagaaaatgaaaaagaaaaaggttagagtctcctggcttatgaaatttgaatgccacttgaacctgacatatttattttttagctctaaatcacacaagatcaagaagttctgcagatcctattccaacattgtgcaatgtctctatatttacaaattttatttgatggggggggcaatagagacataatttaatcctattagttcttgaggagatactatttagagatctcactaattcctgtcctgaaggagaagacttgaagtgtgcaatataaatattgcattaactctaatacagagttctacatttacgccttacatgtgtgcaaacaggtgcacagaggctaaagttctggttgtattgctctccctccatttacaaaagatcagtgagttcctgcttgcagattctctgaggagacccttagtttcatctcctcttcattcttctgctggcctgattcagcaagaccaaccacaaagcaaactgagtaggcaaatgggctttatctctggtgactttgcagatgcactaatttttcagcaggctgtcattaaatgcctactgggtgctaggcataatacagggtcctggggataaaagatgataagacaattcctgtcctcttgttgatagaaggcaggtagtttgtggtcaaagactctcattcacacccaccagattgtttttatatcccagtgaatccattatgtctctggcagcaccacacaccaggtcaagtttgaggctttaaagttcccaggatgtcacctagacttagagatgaagaaacactaacaaaagaagaaacaagacaaccacaaaaacctgagcctgaagagctgccacctctataatggaatatttcaaatggccttagatttaaaattggtctttgctcctttaagcagattcccttagctctggctatctctgcaaaatggatgattgatcaccaatagaaacttaattatcaattaatcggttgctatcgaattgctggtacatctcagttatctgctactcctcagagtaatccatagtactttagtgaagaaatacttctaattaaacagggaaatagcacttgctaatatatcaaagtaaatgactagacctaaaacattagtattaattacaagagtcagtgggtttagcatctctaagtttctatttgctaatttattgccactgaaaatgaagaaatcgttgttgatatataaaatagagcattttaggtggtttttaatcataaaagtcagtagatgtaaaaactctggattgcatgtggcagacatttgaccttaaggaataaggtcgctatacagaaggataactaaacttttatttgtttgttcttaaacaataaaatgatttgaaatatactttgatcattttgtgattattatcatatgggatgataatagagaatttcttacttcctaatcattttcctacacttatagttacatacaaagatgtaatgaaatttgctctccttttcttccaaggtatacatcattttccttaatactttctcccgtccccatcgtctaccccagatttaccaattcccagctatctccttaggacagtcaagaaccaaatactcccatttgtcccttataaactcttttaacttccccaatttctggaaaaacaaaaagctttaataatatagttttatatctccatactcatcccccatctacttataattgattcacttgttcattcattcaattaatatttactaaacatctactatgcatgatagttaatcaactactggcaataccatggtgaacgagtagggtccctgatcgcagcgagctgcttgggagaagtttcacattatcttataaatcacgcaagcaaatgttatgttgcagcttgtaactatgttacagctatgctatgggtacacaggtaaatgatattatgagaatctacactagaagcatttgacttagatagtggggtcagggcaggcctcctgaagaaatggtgataagctaagatctgaaggagatgtaggagttaacaaggtgaatgaaggtggaaggagcatttcaagccgggaaatagcatctgcagaggcccttaatgggagaacacgtgacatatttggagcgctgaaagaaggcctgctcgctggagcactaagaacacagatctggagaagttgggcaggggccggatgatgggaagggagccatacagtccatgttaaaaaaatgttgttctttatcctaacagcaatggggaagcattgagtgttttaaatagagagggatatggtcagatttgtgtttgaaaaagaaaatcctgctgcagtgtgaagaacagatcacctggcaagggtaacagtggatgtggtgggtctagttaagaagccgccgcagtagtccaggaaggaatgaggtggctaggatgaaaattgggaggaagggcatgaaggagaagactggatgggtctaggaggcatttagaaatgaaattgttgggaattggtgatggactgtatatgggggcggagggagagggaggaattggagatgacacttagatttctgacttgtgcacctggaggaatggtagagccattcactgaggtgtgtagtgtcctaaggtcaggcaggaggaagattgtggtttctaggatgggcatgttgttgaatctgaggtctctgagacatgtgaatggagatacttgagtgatgttatctacaagtgctgggctctttgtttgtttgttttgtttttattgcgtgggaggtcttccagaaaacctgctagacaaattctaaaagaaatataacactcatgctgggttctattgtgagagatttatataaactagcttgtttaatagttacacaagctctataaggtaagtactatttttttagttctctctactttacagattagggggaataaaacacagaaattacatgattttctgaatacagaaagattattacataaagcaagtaagcattaggggccaggatttgatgccagcacttgggtcagtgctctgtggcctcccagtgagttatccgttaaccaccactccctaccatctctctgcacaagaatgcacaaaggcacacatttaaaaatataatgtcagaacatgcctctaacatttattattattccagttgaaattcatctcatcagacttgcctgctagaagcattacctttgtgtcaagggctgagacatttaaaagttttgtttttcttataatagcagcagctaagttccatttttaggcgtgcacatattgaaccatggtgtgaattgcgatagtaaggttttagagtctataaataatgcctagtgaaattggagccattcagtccctagaaatatttatgcctatctgtggctatttgtctatttgcatgattatccttgccattatcctccaggctctgaaaatacacactgaaaggtttcttaccagcttgttcatgtctggattcacattaactctatgaccatattttattccagacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggtaagtgctttctgagagtagctgtgtctgttctatctggtattgtgcaattaatttgttttcgtttttgcagtaaggtatttgcaaatactgtaaagtccaaatcatagtagaaactggaacacagactgaaagccaaacaatgaagcctggtctactttctgttaaatgtgtggtctctttttattaagttcttgaagctttcagtttgaatctgtttgctttaattttctcgtccagaatggtgtggcattttttttccatttataatttctgtcacgtgattggaaaataaaatgaaacaaagcacttctaggcaatttttttttatttcaagggaagctacagatcaaaggagagctattgtgtgaaccatgcatcttcatgagaagaaacattcacatcattgagaaatattggcaggagttaggaagggacaacattatcatcaaaatcccattgtaactcaagctctcctgattctgtaaaatggtagggttggatgcaaataagttcagatacaaaaaaaatccagattttattaagaaatggttttaatggatagcaacagtatttctgtacaacaaaagtttccatttcaacttactgtgtttcctagatacaagaaccatagcactttgcagaaattaaaagactctcttgttgggttggtttttgctgttttgtagttattggtgcctttaacatgagttgttagtagattcttgatgaggaaagaatgacaatagcatctatggaaatcttgaacttctgtgaatactagaaatttcttttaaagggagatttcgtaattgtctgatgtagttagtaccctcatcagacaataacctctagtaaaccaactgagaatgataagcttttcctataacttgcctgtctatacatcctatatgtgtattcttctacaaaacatttttttaattaccactctctttatagcagcctggatattgatcattgccatattttaaaacctgtaagttatgtttttcttgtactaaagggcatggtggaattttttcaaggtcaaaaaccatgtaaataaaaccttcctagctcaaaactaatcatacaggtcctgttatctaattattcccctagtaatctcccttctattgcttcacattgaactacgccttttctccccctttcctctgtccattccactgtgcttgtttatccaactcatccatcttgaccatttaattctatccttaacttctcaaacctgaaggagggaagccccgcccctcccacagagacatgcactctaatggatttgaaatatgctcatatctattatgtgtaaaatgtgtagtattgttctgtgtttatacatgtttttaatttacatcaatggcattctatacaattgcaaaaatacaaagaaggactagaaaagctggcatctattgatttcctaatgtgttcattatgttgatttgcccccttttatctttatttctgcttttttttttttcaaaatcgtccattacctcaccaatccagttttgtatgaataagctttttatgattactttagctccgactttttttaacatcaaaagttccctggcctatttccacattctaaagttgtaatacaattccttatttaaatatgttgctttattaactgagtaaattctgctgtgtgacagagtcaatcgcctgagggatatgtcacgcatcagtctcattatagaaacgctgtagcaaatgttttattcttgtctcctagcctttgtgtaaaagaaactatattttgcctattaactatgcatccaaaacaaaaggtaaaaaaaatgcttattttatgaaaagtactggtatcactgattttttttaaaagtggcttttaatttatcaaataagtatcaagaactacctaactttgctttactatacaaacgaatgaagcaaaggaaacagtgacacagaacttacctttaagaaattaaattttagtaggaaagatacctgataataatagtacctacagacaaagggctattcgaaaccacagagaatctatttctctgacgcttgcctaagagaatttcattccattaaattttataaagaaacctaaagcatttgaaggatcaaacaatcaacatcactgaagtccatatatttacagtaaataatagtgcgggaggagtcaggagtggagcacagatatggcaacctcccactttaatctgtcagagcagtgacttcctacaaagttctgtaaatgttttgactgcaccacagtgttaaatgtatggctaggcctgagtttctacaactcgtgttttagtaaatacgatgaagtttctgttacaaaatagaatggacattttttttccccccaaagacagctgccctacacaaaagggaacagaaagatgattttacttccttcctaccctgaagcctaatggcaaagttgctttgcaaatttttttctcccaagagtttgcagctgtttctgtctttcctattgtgcttatgttcagctctggctgggaacacaagctacagccccagctgttgggtgcaaagtgaatcaggtatttcacagtggtcatttgattagaaagaattatattgtttagctaacaacattttgtgtatggcagggaagacatttttgacatgttcctaacatttaatgatgtgtaacttatcttgtacaggtgcagctatatctgaaaatactgatgcatacatatatttaagtctcaatatctgcagagccatgtcaatgtagatgaagatttaaaaataatttttatttgcatgatcactctcttgggatacttcgaagtaaaatagtaggataagcaatgtttgagatagtgtaagtgaacaatgagaacgtgccttcttacagactggggaaggagatgtagaacagagtcagacttgggaacattaacacagtgtacacagctacgtgggagagggaagagggattctcatgaagatcacaggactaatcacagggattgtccacgtctcccttctgagcgcctcgtctaatctacatccagaacaatgcttccttgattttttttaacagcacttgtataaggcttttaatctctaaatgcaaagcattgctattaaaatatttgtgcatgactgtcaggccagggagagtgagtggatcagggatgcgagagggggtggggaggccctttcaagaattgtttcaagttcagctccacaaatactcactgggcaactactatgtgcactacactgtgcctgctcccaatggccacagcctgggcactgtcactgctgctactgggctccgtggttccatcctagctcttcccgcatgcccctttcgcctctccaagttcctaaatgttgttaccacccactcatcactcctgttctcttctgcctcttaactggactagttggatcttaagtaagaaacccaaggaggtagagatcacctaaaaagatgtcccatgttcaagatcattacttatgaccactacttaaaggactgtgttagtaatcagtgaacctaagaataattactcacttccaataagaaaaatttgtttatctgttgacctcctgtcttcaaattccttcagttcccgtgcccccatcgtggcatgtcagtgctttctgtgagaagcctgtagtatgcatcatgtttggaattactgccattttagagtatgtagatgcagatccccaattcgtcaatgttgtgaacatctggcagagacacagctgaaggaagcttcaacttgaacaatgattctctttagggatttctaacttacccatctcttttataaaataatcagataaaaatattatctgcctttttgtgtgtgtacatcattaacttagttttaaccctaaagaatgttagctttggctttttttttttttttttcacagtgtctcgctctgttgcccaggctggagtgcagtggtgcaatcttggctcactgtaacccccacctccagtattcaagcaattcttgtgccttagcctcctgagtagctgggattacaggcacgtaccaccatgcccagctaatttttgtacttttagtagagacgggtttttcgccatgttggccaggctggtctagaaatcctggcctcaagtgatctgcccgccttggcctcccaaagtgctgggattacaggtatgagtcaccgtgcccacaagatttggtatatttctttagaggaaaatacactcaagggttctgaaatttcttttgtgtaagaaagaactttttataaataataatttcagttatgtccataactaaaaatcaaggattccatttatatgaaatatctagaataggaaaacctatagagatagaaagtagattagtggtagtcaagggctaagaggatatggggagactgggaatgacagctaagggatgtggggcttctttttgagataatgaaagcattctacaaccctgtctcaaaaaaaaaaaaaattaaaaccgttcaattgtccactttaaaaacaatgggggaggtatacagaaactgcatacaaacatcttatcttaaattgtattcatcattcttaaaatttaattctattaataaaacggtttaattaaagataaaactgtatatgggaggtaaggagatatggcctttacatatttgtggatatctcacacaaagttactttgttcaggtttacagatttgggggcctagccacaacagttttatttgtacatgtatttcttccccatgtcctatctacaaggggctatgtgagatcaaaaccacaaccatttggtaaattcagattctgccctgccccaaatgtattagtcctgtattttcaaggccattaaagaaaaaatatcctgtgacctaattactaaagattagttgttgaatagtaggaactcaaagataattgttggtcttctattttatgcgaattcttctaagattcccaggttatttatcataagaattacatttacatggcaaatttagttctgttcctagaaatatctccatgacaaccaaaaggaactcctaatttctggcacacattacttcaggggtattttgagagttaaagtggttaatcgattatttagaatcctagcaataagagaaagaaaagaattaagggtagaaaaacatttatagcagtaggtatccctgcagagaacgggctaatgatcaactaaaaaggcatttgcatctgtggtacagcctctgcgcaaaattccaaatggcattctcacttccaagtcacctcacttctccatgtgccttcctgtcttctcatcttcatcccattttctatagcaagcaacactcatgctaactcgtgatcaaaagtagagcttggcggagtgtgctagtaacattttctctatgccctcaaaaactagttagatgcagagactttctccttaggcacacttaacttgtgcagcaaaaattactgaaacacggagtaactggcgaggcaaatatattgtgaaatttgttttagtacttttactcacgagtggctcttgggagctcagagttgaagctttttcaatggtatttactctggtgctccaagagcctagcagttgagtgtttaagaggtcaagcacatggattctggcctcagataaagctctgtggaaatctgactcatgtactttctagctgaaattctatgttgtattttttttaaggaaaataatagtacctaccttataggagtattgtgaggagtaaataaaatctccatttaaagcacttggcacaatatgtgactcagtttcctgttatgaaagtacaaacatttggtgcttttcagacaaagctttttaacagaggatacacatatcaatcaatccaagtccagaggtgcaaagagcttccgaaaagaaagagaaaggttaattctttctgggaaaggactatttggatgggcttcagatatttcataaagtcaaagatgatgacctagtaattaagaagggattgcttattatagatttgggaaatggtattaaaaagagcaagaaggtaggagaaaaaaagggctctaggaggtgattgttatgtagccggtctaagtagaacggaggaaaccagggagacagacacaaaatgcaggtgtccattgcaaggttcatagtgatgaataatcttcagtgaagtgcaaagcatagaatgagctggaaaacaaagtcagggtattaagacagactggtgttctgtgttgcttttgacctgtgtgtgagaaaaggagtttttttgcttttgtgtttttgtttttgttttgttttttgttttacctttgcagtttgaagtgattggcaacagccaaagaaatatggggggtattgggcaggagtataggaaaaatgagatgtgatgagcccagaagggagttaagattgcaaaattgggtaaccaaaatctggagaatttgtaatagaagctttagaagtctaacatctgatattctgcttgtaaccagtacccaaagggaggtgggactggtaattgaatttctgttcactttgcctgcaaaggtcaccaatacctattgggccctaactttaggaaataacaatagtttccaacctttcccatcctgaccaagtgacccttcatccatcacttaacttctgtgcaaatataaccaccctttttaatggagatgttttgaaagcgttgagtgtttagagtagaacaaacattagagcacaaatgtcatgatgtttaacttttacagctgtatgtgagcttggttagtttctctatcaacaatccactctctgagaacaaattaggtactttgagaatcttcccaaattgcttcaggatacttggctcctttgttatgctgaagaaaaaatttacaattgttccccagaacatttatatgttgtatgtgtttgttagagtacaaagcagttaattattgctgtaattttcattcccattatacgaatgagaaagctgaggtagagggagtgactatgtaatcgtaatctcacagatgtccatgtttgtcctgtgatttcatacccatcgcgagtaaatgcatgttcaatgcaatgtaaaaggctattagagatgttgggcaatttcacaaagtagatttcaagtctagggctgtgctgagcctcctccaccttcatgtatatgcaacccagtggcctacttaagagtgaaagtttctctgagaactccaacaccctcctaaaaatctaagtgttcatgtaagataatcatttggattttatcccaattgttgtcaattatgctctgaactttattattactgggttctaggaacaggacagatggaaattagatagctgggaaacatcccaaattttaaaaacctgaaagcaaaaatgacatcaatcatcaaacctcatttcccgggcattgttaaaaccatcaggccttattttaaagccagaccaagaagcagagttttataatccaagtaataatatattgtgggacagtggtttataaaaaaatacaacacatcatttcaaagtagctgggggcctgttttgacctgaaaagatctataaatgtggcttaagagtagcacagctggaactagctccagtattccagactccgcgtccactactcttaaccattacatcaagggaaactgcctggcagggaggattaagaggatatatttaaaaaataatccagattcattgtagcatgtgtggtgtcttctttctggagagagttttggttcctccattttccaatacaattgcagggatttgtctgtatgtgctgccaattgattgaaagatctctttcccttgaaaccattaaaagatcataggcaaagtctgtcttgggggttcagataatttggcttcaaggcaagagattagaagatgacatattgatttacaatgaggggaactgttgggtcttcagttcaaacacccacaagccctgctaatctgttattaccattatcatctacattttccacttatatttaaactgagcttgttggaataaggatgttataacttttttgctgtttaggttgtggtttctcgatcaggaccatcaacccctcatgtgaattttctcctggactcccatccagtgtctccagaagtgattgtggagcatacattaaaccaaaatggctacacactggttatcactgggaagaaggtaagctgttcccacagggaatttccatagacgtggtttttcccaaatgcatatttacaaccagtgtcacttggccctttataatgtctctcttcatcttaaatttacccctcctccattaagttctttagtgagtattccagagatcttctgaaatctagttaatttgttctccaagaaagactagacctaagggaggtctttttcaaaacttctccttttgtcctatatttctcaacaagaaaaataaacacacagaatgagaattacagtcctaatgacagagctctagtgcaggcagataaatcctggaaatgtacattggaatccgactccaaccaataatcccttttctcctagagaagaaagtgcatcttgatgccagaatgacatgcaactttacttagaattttccagagattcaagtgtgttttcccaccacttaaattatactctcttgttattttaaaatcatctcagacagggcacaatgtccctactatgtagaacctctaacattgtgtggcaatgctatgctcactggacaataatgttactttttcacatacctgctaacaataaaggaaaggaaggaatcagatttttaaaattttaatcaccgttatgacaggatttgcacacatagttgctaagtctagaaaattccatcaaatgatatttacatgtaccttttgtgtacttactttataattaattaacaaactagatacccctctggaagctctttccaccccttctcttcacagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggtaggaatctctaacagctggcatacatgtttttgtttggtgttttttttttttttttggtttggtttggtttgttttttgtttttttagatacaaatcccactaatgaaaaaaatttaaaaatcaatttactcatttagctgtgagtcatcagctaaagcaccatctctctcttggctttatccctcgggcagggagggggtggtgtttgggcatccccccaagtcctgcacctgaagtgcttgcttcacattgtctaggttctatcgctgggcagctgctcacctttagtgccgtgtgaataaaagagtggtggtgaataagcaacagtgctccccattttctcacactggggcctgttccctcctgactcacccactctctgattcctcgccacttcctatataggccaagtgcccagacatgagcctccatcacagaaacagatctgttcatggcatatcctggaaccctgagctgaatcctgcaaactggtgatccctgccatgctggggcacacaggacagttttcttcctgtccgatgcatagatggtggccttgtctgttcacagatgagactgaagattatttcccggggtgaggtgggcaaggcaagtggagggtcaacacccatgggtggctgtgagtcttccttcagtgttcccagaaaaaaaagcaaaggctcaacggatgactatactaacatctatacttctgtaagccatgccactctttaattcattccaaaaatatttattgagtgcataccatttagcaggctgccctctagtccctgaggagatatagtccagaacaagatgagcacatctcttgctgatagagaactcagtttctggcaatggacattggctctaacatcgcagccatgctaactgtgttgccttatttgcttaagcatatattcggcactatgaaaatctccacgcaatttttaaaaatttcttagtccaaaacatcttgcttaaaaacacttccctggtgagaacccagtgtgtatttttctctgtgtgcatgtagaaaagttggactttagtaaatagttcttatgaaagattcaagttaaaggtctcggtcacctggttcatgcccaagtaaacaaaatgtgcgagtcagaacaagaaccacccccaagtgcatggctgttttcatttagttacggtttggagcaagatttgtagtgggtgactgggttttaaaccaagttattttctgttaggtgtgacacagttattaagacttagcttgattgaccagagaataaactaaagacagtgacaaaacaaatttaaatctatactgtagtatttgtgtacttttttgttgttcagtatacttttggaaccgtatgcaattttatacttttataaacaaacaacttcagcaatttgagacactaggaatctgaactctgctattccatgaaatagatatggaaaatatatgtgtgtgtgcccatgcaattaaatcacaacaatttcatttcaaaaataaccaagctggtattttaagtaaagaaaatggtttgataacctgtacaaatgaaacatttaatttttactaatgtgcttccttttactaagcataaaagctatactaaaatgcttaaaaataaagtaaatatttcagaattttctggaaccagagaatctcttgcaatatttaaatgtccctcctctctcacccttcttaactctagcattctatagttgatgattctcaaaggttgcgtgctaccatgcacaagtcagtgaggcttaagctgcagttaggaaggcagggcagctgagtccataaatccctctaggttcatagttgttaggaagatttcatgctgcaccagactgtgacagttagcattcttcctgcaaaacataagacagactcgaggtgggtgttaagatggccgagtaggaacagctccggtctgcagctcgcagcaagatcagtgcagaaggcaggtgatttctgcatgtccaacagaggtacacggctcatctcattgggactggttagacagtgggtgcagcccacagaggttgagctgaagcaaggtgggatgttgcctcacctgggaagggcaagggattggggaactccctcccctagcaaaaggaatccttgagggactgtgttgtgaggaacaatgcattccggcccagatactacacttccctatggttttggcaactaacagaccaggagattccctcatttgcctacaccaccaggaccctgggtttgaagcacaaaactgggcggccatttgggcagacaccgagcaggagttttttttcataccccagtggtgcctggaatgccagcaagacagaaccattcactcccctggaaagggggctgaagccagggagccaagtggtctagctcagtggatcccacccctacagaacccagcaagctaagatgcactggcttcaaattctcactgccagcacagcagtctgaagttgacctgggatgctggagcttggtgcagggaggggtgtccaccattactgaggcttgaataggctattttcccctcacactgtaaagggtacagcttcagcagacttaaacattcctgcctgctggctctgaagagagcagcaaatcccccagcacagtgctctagctctgctaagggacagattgcctcttcaagtgggcccctgacccctgtgcctcctgactgggagacacctcccagcaggggtcgacagacacctcacacaggagagctctggctggcatctggtgggtgcccctctaggatgaagcttccagaggaaggaataggcagcaatctttgctgttctacagcctctgctagtgataccctggcaaacagggtctggagtggacctccagcaaactccagaagacctgcagcagtgaggcctgactgttagaagaaaaactaacaaacagaaagcaatagcattaacataaacaaaaagaacgtccacacaaaaaccctattcaaaggtcaccaacatcaaagaccaaaggttgataaatccatgaagatgaggaaaaaccagcgcagaaaggctgaaaattccaaaaaccagaacacctcttctcctccaaaggatcacaactccttgccagcaaggaaacagaattggacagagaatgagtttaacaaattgacagcagcaggcctcagaatttgggtaataacaaactcctccaagctaaaggagcatgttctaacccaatgcaaggaagctaagaaccttgaaaaaaaagctagaggaattgctaactagaataaccgtttagagaaaaacataaatgacctgatggagctgaaaaacacagcatgagaacttcatgaagcatacacaagtatcaatagccaaatcaatcaagtggaagaaagaatgtcagagattgaatatcaacttaatgaaataaagtgtggagacaagattagagaaaaaagaatgaaaaggaatgaacaaaacctccaagaaatatgcgactatgtgaaaagaccaaacctacatttgattggtgtacctgaaagttacagggagaatggaaccaagttggaaaacactcttcagaatattatccaggagaacttccccaacctagcaagacagcccaacattcaaattcaggaaatacagagaacaccacaaagatactcctctagaagagcaacaccaagacacataatagtcagattcaccaaggttgcaatgaaggaaaaaatgttaagggcagccggagagaaaagtcgggttacccacaaagggaagcccatcagactaacagtggatctctctgcagaaaccctacaagacagacacaagacagggatgccctctctcaccactcctattcaacatagtgttggaatttctggccaggacaaacaggcaggagaaagaaataaagggtattcaattaggaaaagaggaagtcaaattgtccctgtttgcagatgacatgattgtatatttagaaaactccatcgtctcagcccaaagtctccttaagctgataagcaactttagcaaagtctcaggatacaaattcaatgtgcaaaaatcacaagcatttttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatggataggaagaatcaatatcatgaaaatggccatactgcccaaggtaatttatagattcaatgccatccccatcaagctaccaatgactttcttcacagaattggaaaaaactactttaacgttcatatggacccaaaaaagagcctgcattgtcaagtcaatactaagccaaaagaacaaagctggaggcatcatgctacctgacttcaaactatactacaaggctacagtaaccaaaacagcatggtactggcaccaaaacagagatatagatcaatggaacagaacagagccctcagaaataataccacacatctacaactatctgatctttgacaaacctgacaaaaacaaggtatggggaaaggattctctatttaacaaatggtgctgggaaaactggctagccatatggagaaagctgaaactggatcccttccttacaccttatacaaaaatttattcaagatggattaaagatgtaaatgttagacctaaaactataaaaaccttagaagaaaacctaggcaataccattcaggacataggcgtgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaaccaatttacaagaaaaatctaacaaccccatcaacaagtaggcaaaggatatgaacagacacttctcaaaagaagacatttatgcagtcaaaagacacatgaaaaaatgctcattatcactggccatcagagaaatgcaaatcaaaaccgcaatgagataccatctcacaccagttagaatggcaatcattaaaaagtcaggaaacaatatgtgctggagaggatgtggagaaataggaacacttttacactgttgatgggactgtaaactagttcaaccattgtggaagacagtgtggtgattccttagggatctagaactagaaataccatttgacccagctgtcccattactgggtatatacccaaaggattataaagcatgctgctgtaaagacacatgcacatgtatgtttattgcagcactattcagaatagcaaagacttggaaccaacccaaatgtccaacaatgatagactggattaagaaaatgtggcacatatatgccatggaatactatgcagccataaaaaaggatgagttcatgtcctttgtagggacatggatgaagctggaaaccatcattctgagcaaactatcgcaagaacaaaaaaccaaacaccgcatgttctcactcataggtgggaattgaacaatgagaacacgtggacacaggaaggggaatatcacacaccggggcctgttgtggggtcgggggaggggggagagttagcattaggagatatacctaagtaaatgacaagttaatgggtgcagcacaccaacatgcacatgtatacatatgtaacaaacccgcacattgtgcacatgtaccctagaacttaaagtataataaaaaatatatataaaaaaagaaaccctacaagccagaagacagtgggggccaatattcaacattcttaaagaaaataatttccttcccagaatttcatatccagccaaactaagcttcataagtgaaggagaaataaaatcctttacagtcaagcaaatgctgagagattttgtcaccatcaggcctgtcttacaagagctcctgaaggaagcacaaaatatagaaaggaaaaaccggtaccacctactgcagaaacataccaaattgtaaagaccattgacactgtgaagaaactacatcaaccaatgggcaaaataaccagctaggatcaaattcacacataacactattaaccttaaatgtaaataggctaaatgccccaattaaaagacacagactggcaaattggataaagagtcaagacccattggtgtgctgtattcaggagacccatctcacgtgcaaagacacacataggctcaaaataaaggggcggaggaagatttaccaagcaaatggaaagcaaaaaaagcaggggttgcaatcctagtctctgataaaacagacttcaaaccaacaaagatcaaaaaagacaaagaagggcattacataatggtaaagggatcaacacaaccagaagagctaactatcctaaatatatatgctcccaatacaggaacacccagattcgtaaagcaagtccttagagacctacaaggagacttagactcccacacaataataataggagactttaacaccccactatcaacatcagacagatcaaggagacagaaagttaacaagggtatccaggacttgaactcggctctggaccaagcagacctaatagacatctacagaactctccattccaaatcagtagaatatacattcttctcagcaccacatagcacttattctaaaattggccacataattggcagtaaaacactcctcagcaaatgcaaacaaacagtctctcagatgacactacaatcaaattagaactcgagtttaagaaactcacttaaggccgggtgcagtggcttacgcctgtaatcccagcactttgggaggctgaggcgggcggatcacaaggtcaggagatccagacatcctgactaacatggtgaaaccccatctccactaaaaatactaaaaattagctgggcatggtggcgggcgcctgtagtcccagctactcgggaggctgaggcaggagaatggtgtgaacccaggaggcggagcttgtagtgagccgcgaaggcgccactgcactccagcctgggcaacagagcaagactccatgtcaaaaacaaaaacaacaacaacaaaaaagaagctcactcaaaaccacacaactacctggaaactgaataacctgctcctgaatgactactgactactcggtaaacaactggtacatttgttatttttcaagttaaataatgaaattaaggcagaaataaataagttctttgaaaccaataagaacaaagacaaagacacaacatatcagaatctctgggacacagctaaagcagtgtttagagggaaatttgtagcactaaatgcccacaggagaaagtgggaaagacctaaaatcaacccctaacatcacaattgaaagaactagagaagcaagagcaaacaaattcaaaagctaacagaagacaagaaataactaagatcagagcagaactgaaggacatagagacacgaaaaaccccaggagctggttttttgaaaagatcaacaaaattgatagactgctagccagaatcatcaagaagaaaagagagaagaatcaaatagacacagtacaaaatgataaaggggatatcaccactgatcccacagaaatacaaactaccatcagagaatactataaatatctccatgcaaataactagaaaatctagaagaaatggataaattcctggacacatacagcctcccaagactaaactaggaagaagttgaatccctgaatagaccaataacaagttctgcaattgagacagtaattaacagcctaccaaccaaaaaaagcccaggaccagacggattcacagccgaattctaccagaggtacaaagaggagctggtaccattccttctgaaactattccaaacaatagaaaaacaagggactcctccctaactcattttatgaggccagcatcatcctgataccaaaaccagacagagacacaacacaaaaaaagaaaatttcaggccaatatccctgatgaacatcgatgtgaacatcctcaatacaatactggcaaaccaaatccagcaacacatcaaaaagcttatccaccacaatcaagttggcttcatccctggaatgtaaggctggttcaacacaggcaaatcaataaacataatccatcacataaacagaaccaatgacaaaaaccacacgattattgcaatagatgcagaaaaggccttcgataaaattcaacaccccttcgtgctaaaaactctcaacaaactaggtgttgatggaacatatctcaaaataataagagctatttatgataaacccacagccaatatcattttgaatgggcaaaagctggaagcattccctttgaaaaccagcacaagacaaggatgccctctctcaccgctcctattcaacataacattggaagttctggccagggcaatcaggcaggggaaacaaataaagggtattcagataggaagagaggaagtcaaattgtctctgtttgcagatgacatgattgcatatttagaaaaccccatcgtctcagcccaaaatctccttaagctgataagcaacttcggcaaattctcaggatacaaaatcaatgtgcaaaaatcacaggcattcccatacaccaataatagacaaacagagagccaaatcatgagtgaagtctcattcacaattgctacaaagagaataaaatacctaggaatacaacttacaagggatgaaaaggacctcttcaagaactacaaaccacaagcaaatggagaaacattccatgctcatggataggaagactcaatattgtgaaaatggccatattgcccaaagtaatttatacattcaatgctatccccataaagctaccattgactttcttcacagaattagaaaaagctactttaaatttcatatggaaccaaaaaagagcccgcatagccaagacaatcctaagcaaaaagaacacagctggtggcatcacgctacctgacttcaaactatactacaaggttgcagtaaccaaaacagcatggtactggtaccaaaacagagatatagaccaatggaacagaacagaggcctcagaaataacaccacgcatttacaaccatctgatcttttacaaacctgacaaaaacaagcaatggggaaaggattccctatttaataaatgatgttgggaaaactggctatccatatgcagaaaactgaaactggaccccttccttacaccttatacaaaaattaactcaagatagattaaagacttaaacgcaagacctaaaaaccataaaaaccctagaagaaaacctaggcaataccattcaggacatatgcatgggcaaagacttcatgactaaaacaccaaaagcaatggcaacaaaagtctaaattgacaaatgggatctaattaaagagcttctgcacagcaaaagaaactatcatcagagtgaacaggcaacctacagaacaggattaaattgttgcaatctattcatctgactaagggctaatatccagaatctacaaggaacttaaacaaatttacaaggaaaaaaaccatcaaaaagtgggccaaggatataaacagacacttctcaaaagaagacatttaggtggccaaaaaacatatgaaaaaaagctcatcatcactggttattagagaaatgcaaatcaaaaccacaatgagatcccatctcacaccagttagaatggtgatcattaaaaagtcaggaaacaatatgtgctggagaggatgtggagaaatagggaatgcttttacactgttggtgggagtgtaaattagttcaaccattgtggaagacagtatggcgattcctcaaggatctagaatcagaaataccatttgacccagcaatcccattactgggtatatacccaaaggattataagtcattctaatataaagatacatgcacacgtatgtttattgcagcactactcacaatagcaaagacttggaaccaacccaaatgcccatcaaagatagactggataaagaaaatgtggcacatatatgccatggaatactatgcagccataaaaaaggatgagttcatgtcctttgcagggacatggatgaagctggaaaccgtaattcccagcaagctaacacaggaacagaaaaccagacactgcatgttctcactcataagtgggagttgaaccatgagaacacatggacacaaggagggaaacatcacacataggggcctgtcgggtggcgggggtctaggggagggatagcattaggagaaatacctaatgtagatgacagataatcttatgtgtcttaaactttgcaggcacaaaatccagctaatgtatggagtttcactttctaatacatgcaagttaacctgcttttcaaggtacatgatgttcagtggctaaaattctttacagttctagatatgagagatttcaggactgtaagcccattattttgcttcaaacatggtatctgatctcatacttaaagagcaatgagaaatgcttcagaaaagggagagcactttttaatatattctgaatgtattaggatgcagttatcatatcttgtaaggttgaaaattcaggccgggcgtggtggctcatgtctgtaatcccagcactttgggaggccgaggtgggcagatcacgaggtcaggagatcgagaccatcctggctaacacggtgaaaccctgtctccactaaaaataggaaaaattagctaggcatggtggcaggtgcctgtagtaccagctactcgggaggctgaggcaggagaatggcgtgaacctgggtggcggagcttgcagtgagccaagattgctccactgcactccagcctggatgacagaacgagactctgtctcaataaaaaaaaagaaagaaagaaagaaaattcaaccccagtgagacaacagaactattcattgatcagaatactcagaaaagcagtattatatagggataggagggtaggcaggcagtatactgccaccagtaaatatatttgtgagttctactaaagaggaaaggagaccccttttggagtttttttgttctgttttgtttttgttttttagttttctcatgttttatcctaatgggttttgaaagcatgatcatttaaaatactgttggaatgggcccatcagtgatgtgatctttcacctgtgaaaagacaagggctacttttgtggctgtatctcccctatccagacaggtaggagacccagcctctgtggctttatgccggacgctcatttcctgcccacagagtttctctgcccttcaggataactcagagtttgccagccattgttgggtctatccaagggtgtgtagttcacaactgcttccttcctttttccctagaagggtaaaggttaccccataagctaaggggaaaatgcccagcccagagagaaaagctaagcagagcgagcctcttggatcctgagggtctagcagagggcttataatatctcttcctattgccagtgccccagttgcgcagctctctgcgtcttttctcaaatcatcacccaatccgtttgccttttatagaaagtgatggtaatgatgtgtgtagagtgacagacttcagtttttacatagaaagacgggatgtaggcagtgggatcaggccaacatcagccttgggcagcgttttcagtggggaagcctcctcattagaagagccggcagcagctgtgtgactgcctcaggctgaagagagtcctgggagggttggatgtcttgttctctcctactggatttctaccataataataataaacagatttatttttctagtagttctcatttgactagacatggatgaggtaaattttcaggaaaggcacaacagtgtaatggatttttatgggtaaaatggctatcataaaagctttaagctaaaactttaaaggggtttgataacgagggtacattaagactttggtttgcaattatttacttaggaaggatggaaatgtttgcaagtttgaatttggctaaaagcccttcttaattgtaaaagaatcacttttagatgttcacaagctgagctttagcaaatacctttactggttcttgagttgcctctatcttagttttcccaccattgtactttacagcacaatttacaatatgtccccacccccaaaagagcatttcctttctcaattgtcacaaagctgctgagaagaagcttatttttaacttggaaatgtgttttgttttaatagttttagcctgagagcaattatcttacacactttataggtgcctaatgcggtcttaaatcatgactgaccaaggtttatcaataaatccattgataacataccagaaatgagtctgcaataacaaaatgagtctgttatttgcttaacatcaaccatcagggggaaaaatttaatcctaaaaatgagatataaaacaataccaatgaagataattaggaaaaattgttacaatactgattttgggccctctctggttccgtttttatctatttctaaaagaaacaacataacacatgtattaaatattacataatttttaaaaggctgagtgtgtcaactaaccagcctggtatacatcaaatagtgaccatatttaaagaacaaggaaaaatcttcagtcattaataaatgtgaactaataggtaaaaagaagtagattcacttttcatttgttagtgcctggtgcataggaggtgctttattaagaaataattaatgaaacctgggcagcataacaagaccccgtctctacagaaatttaaaaattagctgggtgaggtggcgcacacctgtagtcctgtctactagagaggctgaggcgggaggattgcttgagcccaggagtttgaggctgcagtgagctaggactatgccactgcactgcagactgggcaagagtgagacccccatctctaaaagtaaataagtaaataatgaatgaatgaatgaatgaatgaattattggcagatatgtgttccaaaaccatctatatgtttcatattatgctagctgctgaatgcaactgggcaaacactggataccaaatgaggtatttttactgtgcaacttttgtctctgggtggggaataccatagcaaccagaatgtagtgcacgcagccagtgcacagagcaaggcgtataatggctggaccttggcttatagagcacatgaaggagtttgataagagctcagtccgaaggctgatgaagagttacaatcagagttatgagcaagtaaaagtctgggcccaacgtgtttctactcctaccctaaagagccctagaagatgaattcacttcagaatggcccaaaaagggccaggtccaatggctcatgcttgtaatcctagcactttgggaggccaaggcaggaggatcacttgagcccaggagtttgagaccagctgggcaacgtagtgagaccctgtctctagaaaaaaaaaaaatagccaagcatggtggcccacgcctgtgatcccagctactcaggaggctaatgtgggaggattgcttgagctcaagaggttgaggctgcagtgagccatgatcacgccactgcactccagcctgaacaacagagccagactctgtctgaaaaagaaaagaaaagaaagaaggaagaaaggaagggagggaaagaaaaagaaagaaagagagagagagagaaagagagaaagaaagaaagaaagaaagaaagaaagaaagaaagaaagaaagaaagaaagaaagagaaagaaagagaaggaaggaagcagagaaaggaaagaaagaaagaaagaaagaaagaaagaaagaaagaaagaaagaaagaaagaaagaaaagaaagaaagaacggaaggactcgaaaagcccctttattcctaccaagctgcatctgctctttgtcccatctttggatctcctgaaaacaacttgtttcattaacatgtcatgtagttttaatgtttgttccagatgctctgaaatttgtgacccttttccctttagtgaaaattaaatttttactaaattgtgggaaaatgaaagaatttcagactatttaaggatatacattttgtttgttcgttttccatatatgtgaaaaattataatatattgggtttttttaaaagttctatgttgtccttgtaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacgtaaggatcttaaaatgctttgctggggtgtgcttggaaaataggttttgtttttgaatgaatatttcttttaaaattgctcaagaagctcatctcttgaattaaaaagggtcttggcctgtcacatgccttgtgggtctgttctgttttgttcttgtaatcccatttactcattggatttgaagagagagaaaggtgacatggcctaggtgaagagaagaggccagaaatgggagtttctcaaccatttatgcgacaagtcttcaggtgttgtctgagtagatttgcaagagtagcactagttgggatcacttcatccttggagtcttcaaatgtagagtctccaaaggctttttctacagaaatcagtaaacagctcagcatggatcctctcttttaaattcactttctaaacctcagaaatgtagtgaggcagctgaatcacgtgtttgagacttttttagatgagttaaaatttatattcagcttatatttactggcactgcaatatatgggctgtatctcactgaaccatccccacggtcctgggagggagcagtatcattcctataatataaaagaggtacctgaagttcagagagatgaagtgtggcttcacagaggtaatccagagagtaagagctgaacaagccttcagctcagctctgatcatcttctgatccaagacccgtgctagttctactgtattctacatgtacccttctacaagctttgaattccataatcatcagagaatccagaaattattcattatcacataataacaacactcaaatatttaaagttttatggttgaatctttatgattgaacccattctatcaggtggttattttatatctaatagaattcatttcagggttacacaaaggtccgaatctatccattttactgagaccaaaacactaatgaaggtaatatttgttagctgaatggcaaaacaaattttttctagaaatctcccttgtaaaatctccaaaactcttaatcattgcatataaatcaggacctgtaaaagtaaagcataattcattctctcctttaaaaagttatttaataaatcaaattgtatttaaattttctcagaactatatgattattcattcagaaataattctatggaaagccatcacaatttcattatcatttaagtaatttaaataagcatgtacaagtataaccacagaaatgtacctgttgacatactttaatgaagagattggcctatttgtagttagcccattgtttcatatgcatctgaagtggaccaaagattatccccaaatattaatattatccaaacttagattattatgcactattcaactggtgaggtctttatggataaggtctgatatttcctgtttgtctgtataagtgctatagtaccattaatgtaaagtttagtataagcagggtgcagtggcttacgcctgtgatcccagcactttggcagaccaaggcaggaggatcacctgagcccaggaattcaagaccagcctgggcaacgtagtgagactccatctctaccaaaaaaaaaaaaaaatttttttttaattaaccagatgccgtggcatgcacctctagttccaactcctgagtccagaggatcccttgagcccaggagttcaaggctgcagtgagctatgactatgccactgccctccagcctgggtgacagagcaagatcctgtctctttttacataaaaataaaagttaagtttatcatagtatagaaataggattatataatttttggccttaatgcttatcttgaaactctgcttgctattcaaagcagtcagctcaccatttagagttaatgtcacttcctataaaacaacctaaccagaaaattccttggatttgtcatgtattaaactttgggttttttttccagattgaaatgcacagttggtcctgccatgaataagcatttcaatatgtccataattatttcaaatggccacgggacaacacaatacagtacattctcctatgtggtaaggaagattctatcctatcatgtttgatttttacttaatctatttaaattataagatgaacaagttactttgttttgtttttatctcccctccaggatcctgtaataacaagtatttcgccgaaatacggtcctatggctggtggcactttacttactttaactggaaattacctaaacagtgggaattctagacacatttcaattggtggaaaaacatgtactttaaaaaggtgttgtaaatttattttttgttgcatctgtcaatttgaattaatatctgtaccttaaaaattaagcagattgttttgtgtgtgtgtgtggagaagaaaaatcaagatgtttatttgtttactctcctactgacaaaacttcctccttccaaaattcatctactccttttgctgatttttcttcctttctcttgttttttagcaatcctacttttcagttttgtcttcccatccaccctctttattgttatagcttaggatcttagctatactatgagctgtgagagtctggtcattgataataatttaaaataaacattttcatcaagatttgtaattagactaagtcactctggggaaggaagaaatggggaaaattgggtctggaagacagttatgtttctgcttcttagagttggaagagctcagtttaatcaagtaccaaaagtactttaaaggtttttttttcaaatctcaaatgttttccagtcaaggatagcttgtccacaacaaaggtaagtttgagatccagtcagattaaacagcctacactagaaaaggcttccactcaggaaattcccacttaggaaccattgagttatatccttttgatttgtggatataattctaaaatatgtgtatctctaatagctaaaattcacttccttaattttttttgttcagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattaggtaagtagaagcttctgatgggtataagaaaacaatgaatacaaggatgattttgctgtagaatagtcaagaggaattgcagttttatctctggctttgatgctgttatgttgcttttgaaggcttctttccaattcaggagagaaaactatattcaggttctgagtgtagtttgacttatcaatgctagttcattccaagaagtatcttatcctgttctattacatttaaacagagtatagcaaaatagtttaatgtggcattgtagtatacatgcacttacattatgtacatatcaattctatactaaccttagtgcccagaagtggaattaccttttttcttccattctctagatatgtttttgtcctgcctgctttacacacagcttttctttatgccagactctctttgaattgatatctcattggacccagttcaatctgccttgtttccgttaattctatcagtctagcaacaatagttaagttcggttttctttgtatttttttcagaggtgaaatatttattttgtgtaattcggtgaataaaatacaaatgcatttcttaagcttatgaaatatgcattttaaaaatattttcaagttaaataagttgtttccaaagaacagttacccatgaacttccatttgatgttgactgtgcctctgacctgtaatcagtgcaggtgattaaattgaatccctctcttacagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggtaagtcctttgagcaatggttctactcagagctctgcatctttgcctctaaccatgtggctttcatggtacctgagacatctcagtttcgcctttaaggtttgctagttaatttccttgcagtgtagccaagtagtattttttatttaataactgaaattatctagagtcttgggctaaccatgtggaaaaaatacatacacatacacacatgcacatataatgtttagacaagaatgaagattaccaatttgagacagtgtttttttatgtttgttggttggttggttttgagggtttttttgagacagtatctcaccctgtcatccaggctggagtgcaagggcacgatctcagctcactgcaatttccccctcccaggttcaagcgattctccacctcagcctcccaagtagctgagactacaggcacgagccatcatgcctggctaatttttgtattttttggtagagacgaggtttcaccatgttggccaggctggtcttgaactcttgacctcaaatgatctgcccacctcggcctcccaaagtgctgggattacaggcatgagctactgtgcctggcctgaggcagtgtttttacagacagtcagtacaaatggaaatcacagcatttccctagtccctttttaatgtgtcatagaacatggacccttttgctctaataaaatccttggaaaaggttgctgatcttgcagcagtattcttgcatttctaagcagctgacgtatgctttcttacagccccctgttcttcttatcattcttcttgtccctttgttagctctttcttgaaagagctaacaaagaaagagcattagaatatttatgttatgtcctaaagtgtgaatgttatttgctgtttctccacctatccttattttatataggtcacattaaagtggtagttttagtttagaccttagaaagcttggagttatttccaaagattccatacattttgttgatgtttttctctaatataaaataccataatctagtaggacttgagcactcaactcagaatgaaagttctaagtgctcttgctcaagcaaggtcttgattggtcaggtgatagattgaattacagcacttccttttagattctccatccaatatttcttgaagactaaagccacaatgttctttaattacaaaaaccaatttggggctaaaaatgtcaagccaaatcaccaaataataaggtcatttcaaataagatttttcttggccttctcaatcagccacattgcatcacctctagagagtattattagatttttatcatattcctgagagattgtactctagggagtcaccatatgaagcaaagcattttgaaaccaatccccacacatggccacaaacaaagttagagtaccactgctattaatttaaaggacatcagttctccacaactaagcataacaatgtttcattaaccaaataagaataatagtgaccctctttggtgttggtatgagaccttttaaagtagaaatctgagaaattattagtttatctaattaatgctgagcctccattattaagataatgactgaatttcctttcttctccctcattggcattaaagtgacactcagaatgccttagcttcagtcattcatttgtaatcaaatatttattaaaaactttttaggtgtcacacatgagagttacatatcccaaggatgattcaaacaatggtagacgataaaaatcttatttgtttatatatctggaaatataaacttctgttgttttagtgacaaacatgttagtacagtagaactgtacattagaatcggacaagagtgaaaaattcagtggatctattttactatttactatttattttactgtcgtttgtgaaaagtactttataaggagatatgtattcattccatgttccttgccacttatagaatttaaagctgaccatgatgaattgaacccatttattatttaacaaataaaaactcttggtcaggtctgatttagatatataggtccagccacaataactttaagtccaataaacttgaatcctttcaaaacaagaacaatcatcttcataacaaaatgtatattaaattgttaacatgtgcattatgccctaggagcctgcagtttattgtgtagttctcaaatttcttgttatgtaaacaattattgtgatgacagttaaattgttcatgtccatcaggaataaataacttttagcattataatattaattttatataaaactaaatagtataattttatccatattatatctctatcagttttatctgctgcctatatacatttttaatgtaagatcattttttaaatgattttttaaagaaaatagcaaataacaaattctgtttgtcctttttatgtatatcctgagtcctttttctattgtgggcataagtaattgttttatctccaactatacttgtcaaagaaaaggaaatctaagggatgttgttgcttgtttgtcttttccttgggggaaaaatgcaaccgttaaccttagatgtaccactatgtgttgctggtttagtctaagtacaatcaagaggaagctacattttccaaaattccataaatcagaattccaaagaggaagatttgaaatgagacatgaaagggcatgaaataataatagcagaggctttgtaaaatagagagcataggaaaaggtttcagtataaaatatgtcatagacaaaaagatagcatgggagtgaagacactgaattttggagttaatggcctaggatttatattcgctattctgccactccaagctgtgtgacctggcctaatgacataagtttgcaaagctcagtttcttcatttgtaaactgtgggtaatcataatacccacctataggattatcaggagaattaaatgagaccaactttgtaaagtattttgcacagaacctggcattcaataattaatagcttaaaagacactaataagattacctaacaacatagttaattatcatgttcaccatatggtgcttggtgctttacaaagcactttaccatgtggtatccaacatggtaaatagcattttcatcttaattcctaaatgaggaaactgagttattcagtgtgggccctaccttagttcccatagcttgggttaaagctaggagatgagccaaggccttctaaccccacaaagctgagctcccagtctgcctgactgcctcacacaacaaggggcagttcctccaggtgactgtcctgtcttcttaaggaaaataaaatgatgagatgaaggccagcttcagatagatcagcacagtttatgctgggcaggtggagctctgtgtttctttgaagggtgggttgtttggataattttgcatgtatcgtgtttccagaaatgtgtagtctaacattaggaagttaaatacagattttttcaaaaattatatattttcaattgattggggtggtaaattataaagttgctatggatgttgccaagctgtattctgtttacagtggataattgtgtctttctctaggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaaggtaagaaatgctttaaacactgtcttaaatcatcagctcaaacttaattgacttcatagctatgtgaatacaattgttgtacttggccattgtatcttatacaacaccagcaaatatataaactctgaaaaacaaatctttttggcataaaactaaaagataagaataaccgtggactgcattttaatgaagcattaaaaaaccctttcttgtgtatgtattaaaacgtagcaaatgtgggacacaaattatccattaaagaggatccgcgtcatgcattatcttgctgatgttatacatttccccggacatgttacctaaatgtgctcattataagataaaacataagagctgtgaaagtaaatgcatcaattgtatctccgttcttccttgtaatacttggaattttgtatctgggtatggtcatctctaagctaatttgtaaatggaactagatatctgccaccttaggaacatattagcttctaaatgtaatttaatagagaataacagatcatcttttctaaagcaagcctgttgcaaacaaagaacactaagacccagaaaggttaagtgattgacaagtgacaaaatagtggcagaataataaagactagagtgcagcttttttatgtcccttcagtagtttctacttcaaataataacacaggcaaaatgctcaagacttgaattattcatagctccagtcactagaaacagcaaaatatttatccttcaacatgttgttaaaacatttagaattttttttcctgaaagatgatctgaatgcaaatatgaacaaacataaagcaataggatagtctttatttggttgtaatataggctttcatgggtcatctccatctaagtaataatatgtttccattgaaatttttctgactttttcaacaaaaatttaactgcagcccaacttatgcatatgttcacgttcatacaagtttactaacctcattattgtgttttgtacaataattaagcaagcccagcataaaattgaatggaagcccgcttcaatgaacagtgtgtttacaaaagcaaagttctttcatctgcttctttaattagttttagaaagggagaaataagcttttatcacttctttttttttaataaaactaatctagtgtgaccttttgctttcaacaattactgtgtttgccatttgaaagattccatttggtttttcttgatgataacaaaggtttatgtgcaaatagttttacactcacagaaactctatttttctgttcctgtatctatgatgaagggattagagataaacggttctttatctacccttccaagcacagtctttatggaagagaaaacttctctttccataaattaaatacccattattcaacatcctacaaaattgttggaccaagaaaaacataatttggcatcatcctcggcctgtcaatggtattcccaacatggcgaaagggtcttctagagactggcaaaaaacactttattttcttgcctatatatggaataactctttctctaacaagtgtatagcacctgccacgtgacagaatagtaatctagtgggagcagtggcaattcagggagattattttagtatcatggttcaatattttttcatacttcatttttcttatgtatgagaggaaagcaaaggcataagagaatatttgttgtgtcagcaatctaactctttatcaatacgttaagttgatcacattaaaacttctacctctcagccaggcacggtagctcatacctgtaatcccagcactttgggaggccaaggcgggtgaatcacttgagatcaggagttcaagaccagcctggccaaaatggtgaaaccccatctccactaaaaatacaaaaattagctgggcatggtggtgggtgcctgtaatcccagctactcaggaggctgagggacggaggtgacctgagtcctgaaggcggaggttgcagtgagccaagatggcaccactgcactccagcctgggagacagagcaaaaaaaaaaaaaaaaaaaaaaccacgtacttcatcaatgaaagtgttctggagagaatcatgtgtttagaatgagatatgctctttattgccaggaagatttcatgctcctcatgcagccatgcatgcaagagttcctagggtgaaaagagattgtgatcattccctgccctagttgtgagagtccctcaattcatagtaagcccagtgactacaccatgggcaaaagggcgagccaggtttggatgagggaacacaataggggtcaagcataagtcacccctcagaatgaatcctaagccccatggatggagaaggaagtttttggccaaggcttcaagtcccccaagagcagtcgtagacagtggtcatcaaaagtaggtacctctttgtgggtatacatgactccccaaatgcctctatcaacaacagctcatgtttgtatggaattttacagttgacactgtactttggcatattttatttcatttgagtctcatgtggacccatgaggttgggaggtcagtgatgattatccccatttatagataggtaaacaaaggtttaggaagattagctgatttgtcttgggtcacccaggaagcaaagagcagaactggggctcacactcaggcttcttgattccaaatttggtcttctgtcactgcatacactaaattacagtatttcttatattaactctcatttaatgtatactaaaataccattatagagacacttttctatcatatgctatttatatatctatgcagttctttagagggaatagctcttaactttttataaatatctaaaaatttattctgtttaaagaaactctgtatttctccctgagtgtcttatttctgactttttatgcatgagcatatcttatgaaaagtagaaaagtattctgtttcatgctggaacaaggactgcctgacattgccttgggggtttatcttattctgcagcatataggaacatatgagaataaagatgcttcaaatgttcaatctggagaagtcaggtcaaacaggaaaaagaagcacaggaagatgagccagggcagggagcggggacttggtctatgacactgtcatcacaggaacaaatgctgagagctcaggaggaggtgaagcatcagtgtgtgggcattggaaggatcaaaaaggaagcatggttttgaaccatcctaatccacctgctgcccagagccagccagatgttgtccttctccctttgaataatttatgtgcaactctacccctcaatctcagtcaaaaccaccatgaactcagttctgagtccagacaggataaaagtgaagggttcttttttcagaggttatttggcccagtgtcgaaacctgttcttattaatggtgctcaacgcttactctcaaactagtatttctttgtgctgcccaggttaatgggcattctgcaaaatatatatatattctttttccagggcagtttcatagtatctaataataaagatagtaaaaaatatattcctgtggtttcatggtacctagtagtaaaggtccccaactagccagcaaagccaccagtttaattttggtttgcccagcttttcccaaatggccagggaagttttccccaaaatgcctattaacatctggtggaactcagttctgaagctgtctgtgaggttcgttgcttggttcctaagttgagggacttgtgtcctctatgtgaagtgtaaatctcaccccctcaccaccacctcactaatttcctactgctgatctccctggactttggaccctcagcctggctgagtcctgctgccaaactgtactgacttgcccagacccagcctgtggccacctgggtgtatgaaaacttgaaggaccctcctctcatagtgttatttttcagatcctacccacttccactcccatctgctcggttctgtaaccatctcagacatgagtccccgggtgtgaatactcaatagaaacatgtcacacctggccagggttggagaggaaagagacatggtacatcctgatatagcacattgggagtaattagttttcatttttgaaatggatccattttgacattgcagtgagaggaagaaatccttactcatctttatattctcagtgactagaactgtgtctaacacacagtagacggtaagtagattttgtgtcaaatggaatttgatttgcttcatgatctagcccctttctggataatagttctccatatgtaaagcagaaatgacaataatacctacttcagggggagtatctttgcaggataatatgagatgattataactaaattgctctatgtctgttggagattaaagatcagaaagctctctctcttttgttgctttatttttaaacccacatattaccattttagtgactgaaatcaccctgaagcagttgaatgacttttatttaataatagttaatattcaataataaatattaatataattaatagtaaaatttctaaatataagttttttagcatctcaataaagctatgtttactttcttttattttaaatgacaaaaattagcctataccttttaaaatttttccttttttgggccccattgttatatagaagtgagctaccagtatcacttttgtaatatctgggactttacgcttctaatatgcatatatatatatatgtgtgtgtgtgtgtgtgtgtgtgtgtgtgtgtatacatatgtgtgtgtgtgtatatatatatatatataactgatagtagttgcttatataagtcactacttaccatgtgtcctttggtatctacatataaaatgagacacagtggatgtgtgatctgtttttgttttagagaagcctttatgcaacaaccagggagatcctaagcctgaaaccataagtattggaaacacaaatgttgtacattcatcccttcccccaaccttagttattatctaagcaagcaagacacattttagaccttttctcataaatcaaatcctacagctctttaatctcttttctttgtcattccctgaattccctccaatatgtggataagggttttatcccccttcagacctagccaacaagttgtcgtttgaagccctaaagtcatctcttagattgctgagcttctgtgttgtgttggcctgtgtggctgacctggttcaatggactacacatactgcttctagaagtatcataaggatagggtttgtctatatccattttatctgaaactccaacatcaggttataaagaagtattttcttcccacttcttttcctagaataataactgcctgaccaatcaatctattgagatccgtatgagaccatgtatgtgaatggagtttgccgagtattaaagattatataaaacaaaggagcagcattttagctattatgggctgctctttgttagtaagaagaatagtaatatgctttgatatatgtcacctcaaaataatagcttgctcaataaataactgtactcattaagtcttgatatgagaaattatacctaggtttgcacttctttcgcaaggctaattattggtttctcaaacaaaacgttgatatttttaaaatgcctgatggtaacttcagttaactaaatatgccacattaactaatttttaaaaaatttttgtgtaactatgtaattgttcaaaataatggaattgtgctctcaaattataatagtcatacagcatctcacataaatttcttttaaaatgaattcacttatgtataggactcaagtgtgcaagaaggatgaaagtaaactacccaactcaaacaaaaaaagaatgtattaatattaacataacataatacagtgttaatacattaacaactatttaacatcagatctctggagatgagacccggacatcagtattttttaaagttttcacggtgattccaaaagcaaagtcaaggctgagaatctctgcattgggcagtgttagatagtgcaacaactgaatctctacattgcgtcttttttgccaaacattgataccccctgaggacaatggtgaggtgatgataggtaagacatcattccacatttaaggatgtgaagcaagaacctctttccttttctttaaggtccaatttgatgcaaaagctatatgctataattcctaactaacacatgccctgaaatggtcatgctcccctttagccatcccaattcccatgaaaattagtatcatagaatcgtgtgccttggcaaacaacatggcctgtgtttgcagtatatttatattcctttgccattgttagcattcctgcagaactgtgaagtgttaacaacctttttttttttttttcctttcagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagaggtgggattcctgcattcctctcatgatgtaaataaggaagccagtgtaattatgttattctcaggcttaaaataaatcattaaagctcatttatgtgtgggttttggctcatcaactcagcctgcattcctagttgttattttagaaatagtgagctttttgccacattgtctccttccccaagcctgggaggtagatctcaaaagttctttctacccacactgcttctccatcacgccacactcttcccaaaatttgctgtaattctcagaagaaataaggatgcatccaagagtgtccttctactgcctcccaccaccccaggaggccagagccagtgttccactgccaaccactgtgatcactaatgcatagagtcccataaataaaggaagatgcatgcatcaaacaaagtaaaataaagattaaactactttacagtaacttttttcgtgtagacaactgaatcaaacaagctagaaccaaagcgagtgatctttttcattctttttttagcagctttattgtgatgtaattcacataccatgcaattcacccattgaaagtgcacagttcaatgggtttcagtatattatattgtcaatttctttgaattgaggtaaaatatacataatgtaatgtttgccattttgaccatttttaaatgtacaattaagttgcattaatttcattcacagtgttgtataaccatcagcattacctaattccagaactttttcgtcaccccaaacagatactctataaccaataagcagcagctccacatacccttctctcccccggctcctgataacttccaatctactctttctctctagaatttgcctattctagatatttcatgtgagtggaatcatacaatatttgtctttttatgtgtggcctattttacttaacataatgtttatccacgtggatgaacataagattcatccacgttgtagcctgtgtcggtacttcattcctttttgtggatgaataatattccattgtatatatcccacatttatccaagagtaagtgatttttaaagggttcctgaagtcttctgaagttataaaatggaaaaacacacaaaaattagaaaatcaaaggctgaatcatgagatcagagttggaatttcagaaggaccataaatcctaaaaatcataaaatgttagagccagaagggacttcaaagatttctgctgtgtatcaaaactgaagtaaaaatattctgagactttattgttccatcataacagtacaattatttacctcttatgggaagtcttctctgccctccaccccaccgtccaggacagaattaatgtcccattgtctctgttgattactgtttagtcatacttctatggtacataccacactgtactggaatcatttatttatatgtctgtctccccttctatacttcagttcctgttttttgtacatctttttatccctaatacctagttacaaatacaaacagctaagtaccacataagtacttaagggatcagtgtcccctaattatttgaacactggagcataattgaggaatctcttattatcctgaaggcagttatgccatttgtagaatggtaataaccagttggtatttgggacccaaagtgctacaacctgtgtagtacaaatatctatcatggctaaatgctgacttttctttatttgtcatttttagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaaggtgcatttttgttactgttcatttttagaagttaccttaagaacacagtcattacagtttaagattgtcgtcgattcttgtgtgctgtcttatatgtagtccataaaacccatgagttctgggcactgggtcaaagtctcctggggcccatgatagccgtctttaacaagctctttctttctctctgttttaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaaggtatatttcagtttattgttctgagaaatacctatacatatacctcagtgggttgtgacattgttgtttatttttggttttgcatttatatttttataaaaacctaaaggaagtatttacctctgccaagtaagtatttgacacaaaattacatggctcttaattttaaaagaacccatgtatatattacattatgattttagagtccataagctctcatttcacaaaaaggttaatttgagcaaaagtaatttgtttatcatctaagtgcaatagtaagaaattgcgaagctctcttttacaatccaggaagagttaagttacaaaatatacttatttaaatgtaagttggaactgctacattttttacctgttgaagcccaaacattgaaattatactgttagtaattcttcgaagtgttttcaatgaactgttagtacacagcctttttcccaccatattctaggacttgaatgtattttgagacttagccaaggaaaaccttcaattatgccatgaaaaaaaggaggggtcaatatcatcagctttgtaaaacactatgcctagtaatgttcaggttaatcagagttttcatgttgttttatttaaatctcctggtaaaagcaaaaggtctgtattgtatcagctccattatctttagaagttacaggatgtgagtcaagtacaagcatttccttggttgaatatttaccattggacaaataaaatgagtcacagatcattgaggatactggaaaagttagaagttgctcatccaaacaagttcaagagcaatgaagcacttaacattttaacattttcaacacttactacctcttatgttttgaagtttatgttatttctatggagatacacatagtaaacattgtctttgccctgattccattcacctttaaaaatccattcgtttaaccgtgtggaaaaatcaaacctagtttattgttttgaaatttagatctatttagtattttatgtgcacatttagtgcatctatttagtattttatatgcacatttcatagttctaatctgagatcattaaaatttacaaattttctttgaaaaaaaaacttacctaatcttctttgaacctccttactcaccaaagctctgtcatcattgctaagaaggttgagtttcacactcttttctccattgagcctgctccttggagacatgaaaagaaaacaggtaaaagagggtcatttagagagaatgagaaaataggtgcacagccaaaacctaatgaagaggcaactgcagagctttcctctctacatctggtggggacagcattctcatcagactttttcacggagacctagagtgctatgtggtgtgacatcagggtggcacactgatggtttcaattggtttctgcacatgttggaatttagctgaagagtcacgttttcatgccaaagggcttttatccatgtctcaccaaggatttccctcaatctgtgcacccttaagcatttagagccctgatctccagatgcaaaggctttaggaagtgagaatgaaagacctgagtttagagaggctgattggcattcccaatcccctggggaaggtttagagaccctgactccttggaattaagggagcaagtacccagctaggctccttccttcctcactcacccaacatttcaggtacttcactgatgttccacatccttctttaaaggttgctcttgtcttttttctggctagtgtctactataactgtaattgatgcccaacgcttttctggaaccacttttggccaagttcatttattattaatcaaactgtccactgtagaaaatactaaaaatgctcaagtgggattaggaatagtcaaggtactaacagcattctttttatgcccttctctcagattctgattctcctgcttatttgcaaacaaatgatacattttggtgctaatgaggaacccccacataaccttctccctgtgttacatactaatacatttcaatactatgcctagtttatcttcatgtcagttgctgtggctatgatgccccctccttgatatgtgtgaattcccagtggaaagagaaagggaaagtggaaatgccctatttggcattaagaaattgactatcagcaccatttcttcccctgaaataaaaaaaaaaattctccttgcaaaagggaactttgcctgaggttcttacagagctttggttataaagatcaacttataaagaatgcttacccctttcatagtgtccttaactaaacaacaaggatggtccactaaccgagatctaacctgccttctctaaacaacagtaacactaaatccagtgccatcactgcacagtggagaatttaccactaatgtgaaaagctttcagttttgggaatatagccattatttatttctaatcatatgtgtatttttcccttggccaggaatccataggttttgcacaatagtaattaattccattaacaaatagtagtgtctcaaaaggcatctttttcattttcttatatttgagctggatttttgtgagacgaggcaattgctcaactacctttgctgctaccactgcttccattcttaaggacatagtatattcaaaaataaaccataagcatggctttttgctattgataaagagagaaatgtctaaggaaatgagggtaaaaagctttcaaaattaatacttagtctacttaaatgaaaatctgtaaacatctaatgaaatgcttgtatatataacttagtatcttttcccaatttattatcatttttatcaaactaattccattataaaagctcttcctgtttcagtccccattaaatgaggttttactgttgttctttaataattttccttcatcttacagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagaggtaagtatttccactcagctttttgttaaatacgattttccagtaagcattttatctttggcctttgcagattaggaacttagacaatggtgaaagcaactgacagagcagtgataacaagtgtacttgatttctgttctatagaaatgtagccctgtaaatcatatccgtggggatttgcccttgtgcatggaagcaattggataatcccccaaatatattagaactaaatcacaattcgtcctcgtcctgtgtgtactagcaattatagtttcttcaaaggtgccatttactttcttctaaaactcagggccaggcgcagtggctcacacgtgtaatcccagcactttgggaggccgaggcaggtggatcacctgaggtcaggagttcaaaaccatcctggccaacatggcaaaaccccgtctctactaaaaaaatacaaaaattagccaggcgtggtggcgggtgcctttaatcccaactactggggaggctgaagcaaggagaattgcttgaacccaggaggtggaagttgcagtgagccaaggttgtgccacagcactccagcctgggcagcagagcgagactccatgtcaaaaaaataaatacttataaataaataaatatcactcctttaattttgagtatttttattcaatctctctccagtctttctttaccctgagaacagtgacaaactctatgaagcctggtttatagcagtttgtacactgctggacagcatcagaagacagagaatttatagcattctcctgatctaaagcaacatatatcatctctacaatgcactccaatttctttatacaaagataaatgaatatttgtaataagctagccaaagcagcaataacagctagcataaacagtatttgtggaaatatttagcaggaaaagaaaccaatcaaaaaccgggaaatgaacttcattcttcttgttgtttttttttttctaaaaagcttttacccttaatactaaatggcctctgatcccttttattctatatgtgctgcaagaggttgtacaggcatctgccagtgtgatacaagagaagctgatggcgtgatttcccttatatgaacacaaggccttctcactttcctgtggtagcatccacacattcttctgtcaaacaccccagagcgtaatcctttgtgtgctccttcttccccaagagtggcttcactgttaacaaacatctttccatttctcttcagagtaatatatagttctgtcataggcctataaatcccagtaattgcatcaattttagagtgtgtggactcactaattgtgttctaattctacacatttggaaaactagaattttttatcatgaaaggtactaaaatggcaattatttctcttttgaagttataatcattaacagctctataaatattagctactatgtatttatatgtttttctgcaggagaataggagcactcaaaagcataagttttattttattcttctttgcattagtagagggcagcctaatgcctgacactcacatactaggcactcatggtgtcttggccagctggatgaattaattagtgaatgacttacacagctatcagacatttggcacctctgggggaaattactgccactggataaaaggctaccattgggaaaatgatgtggttaaagccagagagaactggatgaagtgagtcagggtgaatttgcttcatctgggcaactgcctttcagtttctgccaacctggattacgtattaaccagtgactaatggggaaatccttattctataatactaatcctatttttaatggtaacatttttatttcatttcagcttattagaatatagagaacttattttattatagttcttcatgtgggttaactttattttcatattttaaaatactatgtcatcctttaaaaaaatttatttgatgaggccgatgttactcaccttttcagtggttccactgtggttgaatattttattaggttaggctttaatatgagtcatatcatctacaacttattcatgaattaaataatcacattgcttatatccttgggtgaaatgtgttgcatctacatatatatttacaaacacacctacgtacctatagtggtattgttaaaagtattttttaaatgtactcttttgctgtatagaaagaagaaagaataaaatgaagctcataaagggtttgataaataattatttcataattaaatgttacgcagtgctaaccaagttctttcttttgcacagggcattttggttgtgtatatcatgggactttgttggacaatgatggcaagaaaattcactgtgctgtgaaatccttgaacagtaagtggcattttatttaaccatggagtatacttttgtggtttgcaacctaataaatagcttataataaaacgttgatttacactttccccttgtggaaaaatcagctaccactgaaattatgggcctaatcctgaaaatttgttttgttctagacttttattgaactacttcccctgaaatgatccctcagagccctcattagtaagggggtaggagaaatgaggttcttggatgaactgagtatcatttaactataactatgtttggtttataatatttgttttgcaagtgacatttctggaaactattggaagcatgttggcacctacagtagtaatgactcattttacccagaggcattactataattattttttaaccacaacttccattaaaaagataaaaaatgaaataagacaaacaggagaaaactacgctggccaaaaattgaaaaatcataagtatggtaatacctcatttatccacatttttggagagtgaggcattccacatacatgaacttcctaaataaatgaaacctacccctttttaatgctggaacattacttaaaattttagctgttattgagaaaatctttttaagatgaaatgcatactctgtttaagggaatgcttccaaatacaaactaagtctttattggtgaccccaagccataattacagccataaattactatattacacaaacagtgtactccacatacatagtgttcctggctccgcctgtgttgacaggtctcacatgcttgcgttttctactcccatttctcattttctgcttgcaaattgcagcagcctgaaaaatgttaaccagctctactacaaactttatatgggacttaataagctttaagtgcacaaatgaaagattttcctgcaagatactttactgtcacaattatttcagtctttttaaaatataaatcaacatgctaagtagtgttctacatggttaattttgttggaagtctgaccatgagggaaataaatggacagtctttatgaaacctaagtataacctttgcactaagtttataggagacaaactggtggctggttggactctatcttgcaaaagtgggcataggtggtgactggaaggcacagtgcacggtggcatcattcactcagatgtgatgtaaaaagaacactctgcagtcaaaccctcaggacaagatgctaactgtgtggtttaccatttcattgctcttcctatctaaatttgacaaaagtattcactgttccataatgaagttaatgtctccaccactggatttctcaggaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcatgtaagttgactgccaagcttactaactggcaaactagctgtaagccagccatcccttcaaaataggcctgctctgagtctttaaaaagctagtagccaaagatgcacatttaaaatgttagcatcattcaaatgcacctcaaagtcttctatcctggtgggaaatagtgacacctggaagggtttcctggagcaatgattcttacttgctctgcaagcaaccttgctctaccttccctctgatagggacatttagtcatctttgcatgtctactatgtgccagaaactgtgcacagcacaggagaagtggaagcagagcaagcctcagcccatatggaatgttaactctacaaggcattgaaaaattaactccagatgcgttccttgctgttccttgtccttgccatccactctcacacctcaggaactttgcacttgtgctccctcagcctggaacactctccccgcaaatagccacgtatctcacttcctcatcttcttcagcttttggccgtaatgccatcttcaacataagccttccctaatctgtttaaaattgcaactgaccacccaccctcatggcttcagactcctcttccctgctctattttcccccatcacacttaactgtcatctgatacatgcatgaagctgcctgaagctgcccaatactatggccatgagccacatgtaaaaggaggctagttcgaactgaaatgtgctgtacggtgtagaatacatcccagattctgaatacttagtattaaaaaaaaaagaaggtgaaatatctcactagtagttgtttatattgattacatgctgaaatattttggattttgggggttgaaaaatacattgtgaaaattaatttcacctgtttctttttacttttgagtatggctactagaaaattttatattacatgtgtgtcttgctttatatttctattgaatagcactgtagtagataataaacaaataaacaatagctatatagatgtatatgtatgcatatatatgtacacacaccctcatcccattagaatggaagctcatgagggtaggatttttgtgtattttgttcactgctgtggctccaacacctaaaacagtgtttagcacatagactcgcagtaaataattgttgaatgaatcagctaagggttacaaaaaaaggttcttagcctcttgcaagtggtagatttttttcttgacatttatgccaggacctaaaagtcaccaggccaggaccagggagggtgggaataagaatctcaagaactgaattcatagaaggcctcaagctccgtctcggttcctgctctccaagtctctgtgggaggtaatgaagttgatcaaaagcaactttataaatatggggtcaaattatcagagaaaataagctctaggagagtaatgagatattactcagccaaaagaataaaacattccctggcagtgaacttttgcagataaggcgaattgaccttacaaagcacacagctgccctgacagaccccactttcccacttcaacttttgttattaccctgatggattaatgtggctggaggtgctaccttctctagggtactgttaccccaggattaaagcatgatagagatttcctgttatccagaacggaatagtgccatggccttttttaatccaaggagctgatactgagagcaaccacaaacccagatgtgtcttaaagagaaacctaaaaccaggaactggcctttctctatgctgtgtgcattgagtggggctacagcccttttgcagggtccccactgactacatcttgcactgacaaactcctcagtgactgttgaaggggaataccccattcctgattgccagccagtgacatcaccagacttgacagctgagtggtttggggtgatttctttctgagcctcctctattcactgtgcttctgatgttctaacatcttgggccttactaaccctggaggaactgtccctcccaaggctagctaattcctgcaaatagtaaacagcttgccttcaaagcatacctgtcatgtgcaaaccaaccaatccagagcccttatctaacctcctcctttatcaggctcttacactttgggctactatccacctgccctaatcaccccagggcccagttccagacaactagaactatcctcggagcctgctgaaatactccagattggccagctccaaacctgcttaccctgccttaccagtttcttcccagggaaactgcaatgaaggctcttgctcatgtttttcccctctctctctctgcctctagagcccagggcttcccccatgtgaccctgcatgacagggtgtgcctcctcctcttgcaaactgtgaatagcaaactatcttttcaatggcagttgtctcctgttctgttggcctcatcatacctggaaaataataaaactacattttaaaacacctccattttcccatctggaaaatggagcctgtaacacctgcctgacagaagtgtagaagtagctgtaatttatgaaaacaattagcctggtgtgttgcatacaataaatacttaacaaatggttgatctgtcaatggggcacactttttgttgttgttgttttgttttttgtttttggagacaaggtctctgtcacccaggctggagtgcagtggcacagtcatagtgcactgcagtatccaactcctgggctcaagcaatcctccttcctcagactcctaagcagctgggactataggtgcacaccaccacaccaggctaatttttttgtgggcggtggatgggagtaaagacaggatctcactgtgttgcccaggctgatctcaaactcctggcctcaagccatcctctcgccttggcctctcaaagttctgggattacaggcttgagccattaagaccaaactaatttttgagacaagataattttttataaataaatatttcagaattctaaggtcaaaattagaacagtagatgcttagtttatgcttttctaactctctttgactgcagaatccaactgtaaaagatcttattggctttggtcttcaagtagccaaaggcatgaaatatcttgcaagcaaaaagtttgtccacagagacttggctgcaagaaactgtatgtaagtatcagaatctctgtgccacaatccaaattaagtgacaaggaggaatctgtttcccactgttcaatgctagttaagctgttttctcttcttatgcaaaagtcctttatttctgttacaatcttaaatcgatgtgtaagccctggggatgtgggtgggactttcagactttatccaacagagaatttaaaaggattctccatagggggtcttaaacagctgttgtgtacttttgcttttctcagtccttccctccagtagctctcaatgttgtggtttcacactgcattagtgttggggagggagaatttgatcttcagcatttgacagtgaaaaggagagggctgggaacacaaataccaacatattgcaacttcccaagagtggatttgaagccagcctgcagaagccctaccaaaaatggtatttggcaatgaatatacaaagaactttatttgtgtctggctgcctggctatgtaatacaacagtcaacagtttgtaattgagttcatgttttcccttgcatagcactgattcatgacttatggtatgtgtgaatgaaaaagggtgtgctattaatttcctaccttggttttggtcactgtaacaacataaaagccagcttaaacagaggatgcatagccccagatagcggaaattgatttttgttgaacttcgctgtttttcttagatgctttactgtgtatcctagttctctattacctcagtggtgggatatatgagttttgtgtgctaacctagctcatttaagaatgaaaaagtaaagtatcagtcccctgtcatgctctcccataaaactgagtatcgctaatcagttgacaagcgaagattggtgattgcttgggtagttaattagcatacttcatttagcaaccaaagtaaacccacaggggagacagccttactactgcagatctacattaaagcaaaaaggactttcttatgccatacaattcatgatctctttcctcagcctgttgaattggcaatgtcaatgtcaagcatttttattcaagaattctgttgtaatttagtgttagtcaatagaggccagatgaaatacttccttcagaagttatggatttcaaatactgaagccacttgtttaatctgtagatattcagcatcattgtaaattattctatttcagccacgggtaataatttttgtcctttctgtaggctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtggtaatgtattggttatctctgagtttctcctcttttactttcatatccaactttttttgaagttttatcactacttaattttttaaaaaaattcaacaccaccaattccagttttcttcatatgtaaaaatggacttgtctgatacgtacacattgtatattttcataaattcactcatttgttcaaaaatatttgttgagtggggcaacataccagctccttaggaagcccagagctgaaccaggcatgaaccctgtcggccaagaactttggctcagaagggaagagatgagatggtcaacaatgactgtgacacaggtggcctggaatgggccctgattctcatagccccaggcgagcaagaattccacatcaagaaatctggaagctgtaactgaggcagtctagcagtgagggcatgatccctgggcctagctagtaaagtgccttcccttatctgcaaaggccatccttcttgcgcagaacaagctctcaaaaggcatgcacctgagtgctgaggctgggagaaatactcacctgggcagccagattcaccacattccccttccaccatatggagaagtggcatttgaattgggttaaaggacagcaggtttggagttgggcagctgggcaatggaaataccgatccaggtgtggcagaagagcaggaaagtataagcacctgtaaagttataaggaaacagtacttagttatttggcaagaacagaacacagagagggaagttatgagaataaatggagaaaaatatacttatactaggtcatagagttccttgaaaactgaactagagagtatggaatttattctctggtaatgtggaaacaaaaaagtaatcagattagactgcaatctttcatcattgtattagtccgttctcacactgctataaagaaatactgagcctgggtaacttataaaaagagatttaattggctcacagttctgcagactctacaggaagcatggctggagaggcctcagggagcttttacccatagcagaaggcaaaataggagcaggcattttacatggcaggagcaggaccaacggggctgtgggaagtgccatgcacttttaaacaaccagatctcctgagaactctatcacaagaacagcaccaaaggaagaaatctgcccccatgatccaatcacctccaaccacgcccctccctcagcattggggattacaattttacatgagagttgggtgggaacacagagtcaaaccatatcattccgccctagttcctcccaaatctcacgtccttctcacatttcaaaacacaatcatgccttcccaacagtcccccaaaatcttaactcattccaacatcagctaaaaagtccaagtccaaagtctcatctgagataaggcaagtcccttctgcctatgagcctgtaaaataaaaaaacaagttagttgcttacaagatacaacgggggtacaggcattgggtgaatgctcccattccaaacgggagaaattggccaaagcaaaggggctccaggccctacacaagtccgaggccctatgcaagtccaaaacccagcaaggcagttattaaatcttaaagctccaaaataatttttttgactccatgtctcatatccagggcacgctgatgcaagggatgggctcccaaggccttgggcagctctgctcctgtggctctacagggctcagccccatggctgctttcatcggctggcattgagtgcctgcagcttttccaggcacacggtgcaaactgtcagtggatctacctttctggggtctagaggatggtggccctcttctcacagccccacctggcaaagccccagcactaaggggaggtctcagggagctttttacccatggcagaaggcaaagcaggagcaggcatcttgcatggcaggagcaggaccaagtggggggagggggagcatcttatatggcaggagcaggaccaaggtggtgacaagctttcaccaaggggagaggtgccacacacttttaaacaaccagatctccgtagaattctatcacgagaacagcaccaaagggagaaatctacctccatgatgcagtcacctcccaccaggcctcagctcccacactggggattataattcaacatgagatttgaatggggacacaaatccaaaccatatcaatcattctccaagacaacttgaaaggagtagaagcaggaagatgaagtgagaagtggaacttgaaataagacacaatgagaatggaaaggaagagatgaaaggaggagcatctcagaggtagaatcagaagtatttaccaaggaattgataaaaagtcaaagattagcaaagatatatgctcatgcaataacacatatatgaagcacagaagcaaaagctggactcagaacaaaaatagcaagttgagccttaaacacactgagtttgccttgggagtagaatgtccaggcagagaagtccatcaggcaattgaaaatgtgaatctgcaacttgtaaaaaatgtattattcagcctgggctgtcatacaatagaccacagactggttggcttaaacaacaaaaatgtatttctaaccattctgaaggctagaagtccaagatcaggatgtcagcatggttgggctctattgagggctctcttcctggcctatagatggccaccttcttgctgtgtcctcacatggctaaaagaataagagtcagttctccagtatctcttcttagaagggcactaatcccagcatgaatgcccaccctcatgaccttgtctaaactgaattacctctaaatggccccatcattaaacattgtcacagtggggcttagagcttcaacatatgaatttccggggaacacaattcagtccatagcaggggtcaaggctgggaatatgcttttgagagtccaaaagcaattattcagtagtccaaaagcaattattcaactacatatataaagtgaaagagaaaagcagtgaggtaagggacccagaagcaaagaccaccatgaaagtcagagtaagagaaagtttcaaggagaaattggatgctcaacagagtccactgctactcagtacaccagaagggtcttggaagctgagtaacttgagtgatttggaggtctagagtgtgcttaggagcacaggtgttgaatggaatggagagtacacttattctattcacatgttgtaagtcagaggactgtgatgtctgaagatagagaaacatttgatgtttcagtccttaaggatgacaactaaaaaaggaaaatgtgcaaacaaagtagtcagaaaataatgttcatgggggacatgcacttgaagagaaagggttggtagcttttgagagatgatgggtcagagatctgagtgtggcatgggaagcaagaagtcatctcatccacctctctgtgaatcagcaagagggagaggtgtgacccctattggcaagagttgcaaagaaattgtgacttcaactgaaagctgagtttcagttcctgtgaggaggtaggggaactattagagaataagacgaggtgactgggagtttgttttcaatgagtaagtaggtcataggtcatggtggaggaccaggacttcagcatgcatgagattggtaagagaaagtgatagtgccatgtagagcttaatgcctgggattttgatcctgaaagattctgaaagaggtgaaagaagtgggtgctagagagggagactggggacatgttagtgacagtggcaggtgaaggcaaaagatagggagaattaacccatcctccaagaacatactgttcattcagacttgagggttagtctgccattaagaagccagagccaacccttacaactcaataataagactgtcttagtcgttttgtgctgctataacacaataccacaaattgggggatttataatgaacagaaatgtatttggcccacagttctggaggccaggaagtccaagatcaaggggccacatgtgctgaaggtcttcttgctgtgtcataacatggtggaaggcatcacatgggtgtgagagagtgcaagagagagcaagaggtgaacagattctctaacaaacccccttccacaataatgaactgactcccaagataatgacattaattcacccatgagagtagagcctcatgacctaattacctcttaaagatccctcctctgaacactgttgcattgggaggggattaagtgtccaacacatgaactttgggggacacattcaaaccatagcaaaggcaatattactcaatttttttaagtaagcagaagatttgaatagacattttaccaaagagacgtaagaatagctagctaatgagcacatgaaatgaaacatatgcccacatgaagatttgtacatgaatgatcacagtagttttcttcataatagccaaaaaccagaagcaatcttaatgtccatcaacgggtgaatggataaaaaaaaaatgtggtgtgtccatacaatggactaaaccattcatcaacataaaggaattactgatgcctactacagcatgataaacctcagaaacattatgttaagtgaaaaaaaggcagataaaaaaattacatgttgaatggttccatttatatgaaatttctagaaagaggcagaactacagagtcagaaaacaaatcagtggttgcctggggccaagagaaggagtgaagataaaccacaaatggacatgagggaattttctggaatgttgagatgatctaaaactggactgtgatgatatgatagctgcacgtctatataaatttactaaacatcatttaatcactttaatttactaaacatcaccaatcacttaaaattggtgagttttatgatctataaattatacctcaacaaagctgatttataaaaaaagagcctgatgaaattttggatgtttagggcaagtgttgggattctaagcttcttgacagccacatacatgcaacaatacccccacctccccaacaaacacacacagacagcacagaggccaaggcttccaccatagccacagtcactcagatacttgactggaaatgtacatagatttctgcagataggatggtgctatttctttctcactctcatcgaaagacactattttgtgctacataaaggctgaacctgaataatctgtacataatgctgctttgggaaatggttactgattgcatggataaatttgcacagtgttttacttccaggacagcgcaatcttgaatgttgacatggaacatttccaaaagcatgcaatgagctatgtgtatgttgaaacctgcgaccaaaaacttgcctgcttgtagattgggttttctttctagaaaatgcccaaatggagtttggctaaaatctgaatactctttaagtccattcaaacaaaatcggagtgtcactacactggaaatcactcacaccctcctctgaacccttttgcaatgggtgttgtaattgtattatacgttgtttcacacttaatacaagttcttccattaaactgtgtattgacttccttgttctcagcccttatctgcctcatctttctgaagtgtttaacattattgtaaccctcatttttcttgaaatttcctcttcctttggtttctgggacactgaaacttccagttttcctcctgcttctaggttgttttctttatcctcaatggcttctcttccttctgtcttccttctctcagatgtagctgtctcccaggatttttgtctttaggggtcatcctccaccaacagttggaaccattcccatcaataaccacctttgattctctctacctggatgtcatcatcagtgtcacaaatttaccatgttcagaatcaaactctttcctgccaaaccctcaatttctcacctcctggctttgattaatggcatcaccattgtgtaatttacccactcctcattcttttcagtgttcggtttttcaggttttgacaaatgcatgcagttgtgtaaccaccaccccaacaatcaggacatagaacagttctatcatctcagaaaatttccttatgctcctttgtagtcaacctctaccctatccccaggacctggaaatcagaaaaccagatttattttctgtctctagagttttactttttctaaaatgtcatataaatggaatcatgcagtcagtagtcttatgagtctgtctccttttacttcgcatattacatttgagagccatccatgttgtcgtatcagtagtagtaacgtatcagtaattcattcctttcttattgtggcaaaaaaatacataaaatttaccatctgaacgatttttattttattttaagttccagggtacatgtgcaagatgtgcagatttgttacgtaggtaaacgtgtgccatggtggtttgctgcacctatcaacccatcacctgggtattaagctcggcatgcattagctgcttttcctgatgctcctcccctccctcgataggccccagtgtgtgttgttcccttccctgtgttcatgtgctctcattgttcagctcccacttagtgagaacttgcggtatttggttttctgttcctgcgttagtttgctaaggataacagcttccagcttcatccatgtccctgcaaaagacatgatcttgttcctttttatggctgcatacaaccatttttaaatacacagtacagtattgttaactatgtgaacattgttgtgcaatagattcctagaactttttcatcttagcaaaactgaaactctatatccattaaacaattctctctctcccccaggccctggcaaccacaattctactttgtctaagagtttgactacttcagatacctcatataagtggaatcatgcagtatttgtctttttaggaccgacttatttcatttagcaaaatattctcaagcttcatccatgttctagtatatgacaagatttccttctttttaaaggcagaataatattccattgtacatatatgccacattttctttatccattcatctgtcaatggacatttaggtttcttatacctcttggctattatgaatagtgccgcagtggccatggatgtaaaaattctctttgagatcctttttttcaattcttttgtatatacacacagagacaggattgctggatcatatggtaattttattttcaaatttttggggacctctctactgttttccacagcagagtagttcatctctttttatttttgagtagtattccatcgtacagatgtaccacattttatttatccattcaccagttaaagaacatttggggccaggagaggtggctcacgcctgtaatcccagcactttgggaggccgaggagggcagatcacttgatgttaggagttcgagaccagcctagccaacatggtaaaaccccatctccactaaaaatacaaaaaattagccgggagtggtggcacatgcctgtaatcccaactattcaggaggctgcggcgggacagttgcttgaaccctggatgcagaggttgcagtgagctgagatcatgccactgtactccagcctggatgacagagtgagacccgtctcaaaaataataataataaagaacatttgagttctttccattttcaggcaattacttatacataattgtaatggctatgacatttgcttgaaggtttttctgtgaacgtaatttttatttctcttgggtgaatatctaggtgtaagagtaactaactgggttgtaagataagtgtacattcaactttatgagaaactgccaactatttttcaaagtggctgtatcattttatgtccccaccagcgatccataagagttccagttgttcagcatcctctcccgcacttgacattgtcagctttctgattgttagtcattctaattggttgtagtgctgtctcattttctttttaatctttatttcccaatggctagtgatgtcgagcctcttttcatgagcttatttgccatccttatatcacctttagtaaagtgtctactcaaatcttttgcctatttttaagtatttattaataatattaatttagttagggtttattttattggcttgtttttgtttcttattgaattgttcgagttctctgtatattgtggatacaagcatatcttatgcgatacacttttgccaatgcatttttttttcttttgggacgaagtctcactctgtcacccagcctgaagtgcagtggtgcaatcttggctcactgctacctctgcttcttgggttcaagtgattcttttacctcagcctcgccagtagctgggattgcaggcatgagccaccatgcccagctaatttttgtatttttagtagagacagggtttcaccatgttggccaggctcctgacttcaagtgatccgcctgccttggcctcccaaagtgctgggatcacaggcatgagccaccggtgacacttggcccacaaatgcatttttctagtctgtggattaccttttcatttatttaatggtatccttcaaaaagcaaaagtttttgattttgttgaaaattttatcagtttaccaattgataaaactttatcaatttattttttttcttttatcaatcctggtgttgatgttgtatctccatgcatctactcttgaatgctcagatttgcctatcatccttccttgctcacttacctcagtagcaaccctgtctatcacttttcatagcttacaaccatctttcacatttaatcatttctttgatcatcaccttcagtaaagttaggccagatattctccagatgagcttattgctggtgctcaaatgctcaaaatggcttgaccaatgccatacagtaagcacggatgatagcgctctcatggcttgaaactaaaactgacttgtttcctaatgcacatgaattgtacacctccctcccctcacccccgaccccccctcaaccgacagacacacacacacacacacacacacacacacacacacacacacacaccagcttctctcttcttggtcatcatcctaatcagcatcacctcctctttcactgtccctcccctcaccctgctgtcagccccacaatgctttcaggggagtgtggagtgcagacaatacaatgctcttcctggaaaccttcttcctcttacctccctgtcccgtgagtcctccagctattttctgatacccagttattgcccacgtcctttaattccttggaaaattacccaactccatcccccttttatgtgactttgtctccagacaaatctacatgtagcgtagactgtcagatagggagacctgatcacagaactttggcttcctcatcctaaaataaaaccaattacatcacaggattgtaaccaagtacaatccattataaggattaaataagatgttttgtaaaggatataatgcctatgcatgaatcattatatgacaaatacactctttcactaccttaattccagagaaaagcctcataggcttccgtattgtaggtatgcaggagtgtccctcacctattcttattcagaaacctcctaactggcctccatattgtgaatcagcttctcctttctgttctaagcttggcgcttacagatgccatctccctgagcacaactcagaactcagccatgtcccattgatttcagtctaacgcactttctttttttttttttttgagacggagtctcactctatcgcccaagctggagtgcaggggcgcgatctcagctcactgcaacttccacctcccaggttcaagcgattgtcctgcttcagcctcccaagtagctgggattacaggtgcacaccaccatgcctggctaatttttgtatttttagtagagacagggtttcaccatgttggccaggctggtcccgaactcttgacctcaagtgatctgcccacccccgcctcccaaagtgctgggattacagatgtgaaccaccttgtcccgtcctgtctaacccactttcaacatttaaaaacctccacagcacagtcccatttcaatcttatgggtccctaatcccttcccctactccaacatgtcaagcaacgtgaactattatactttatggtttaataagaacacatatgcagccaggcgccgtggctcatgcctgtaatcccagcactttgggaggccaaggagggtggatcacctgaggtcaggagttagagaccagcctggccaacatggagaaaccccgtctctactaaaaatacaaaaattagcctggcatggtggcaggcgcctataatcccagctactcaggaggctgaggcaggagaatcgcttgaacccgggaggaagaggttgcagtacaccaagattgcaccacttcactccagcctgggcaaaagagcgaaactccatctcaaaaaataaaaaaggaaagaaagaacacatgtgtactgttactcctggccccaccccctccacccaaaactctccctctgccctcatattacctgcacctataaaacaaagtctccctgttcctcaagacccaccttactgtcactctcttcctgcagcctttctcagtaccctactattatctctttgacttttggcaacctttgtacctctttgatattactgctctatattacagctattatcttattgtcctgtgtggcagttatctgctcaattctcttaaccctgttcattcagccctgggacctatctagtaacttgaacagtaacctactcgtatgtgatcaagggtcaattgatacttgttaaattgattttaaatgttaatgcatattctgggacttgaaagttaacacgatgatgttgtcagaagtgattgttgattgttaagattttcagactttgaaaacttctactttgcaaagctgaattagacagcaaagttctgtagctccctcctggcaaggggtttgagttttctgttgggatcaaggcagtcagcagccatcaagggttcttgcacttgggcaaagaagtcattaatggtaatttgtatcagcaattacagcatctacctcatttctttctttcagtcgcagcgttcaaaggcaggctttattctccttcttgctgggtactgcaagctacacttgcctctcagttttatgtcttcctactccagctgtctggtgtggattttccttctgctccaagcttccttcatttcttcctccttatgcttcctactcttagagtggcctggaagtgttgctgggccagaactgcccccctgggtcctgtccacaggggcggcctctgcccatgctgactctcctcgtgtcattcttgcatgggcacatgtccagggggagataatatgtatgacctggtctatcctgagcacagtgttttaaatcaagaaattgcatgtttattgaagttcagtagaccaaacaagacctaagggtcaggaactcttaaatgtttatcccagtgtggactcagatgtattggggaattttagcaagtcacttaacctctccgtgtccctgtgatcttcctatatagtactgatacggctattttatatgaatctagtactttcacatcttcatgtgacagttttattgaaattaattttcaatagagaaacttgttgccttgcagttttttttatttctgatttttaatatgtatttttacttatgttgatttagaccttcccatttaatagtaacctttcaatgtggttacatttcttaaagagtatttatgttcagtttgaaaccacacaaatttaaattttgggaggctttcttcttcttttacaagtaatgtaaaattgtagtgaagctattggaaaagaaaaggatagaaacatgttagtgctttgacacagcgggagagaattttggaagagatattctaccaactacagatggaatcttcatcatcatgtagacttcagatattcttttagaaaactttacatttacttataatctaaaccttacttgtttaaacaagtcatgaaatgtatagcttaataattgcctttaagaaaattgttgcccaaaacagaaaccgtattgagtatgtaaagccaagtttagttaccaagacctactgatttcctttcatatatgtatggtcacatctctcacctcatctgtcctgtttcttgttttactagtggtcctttggcgtgctcctctgggagctgatgacaagaggagccccaccttatcctgacgtaaacacctttgatataactgtttacttgttgcaagggagaagactcctacaacccgaatactgcccagaccccttgtaagtagtctttctgtacctcttacgttctttacttttacagaaatgcctgccttcaaagggtctcttacagcatgtctttctttttggaacagatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgta

SEQ ID NO: 77 - DNA, 76220 bp, Homo sapiens
agcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtgagctgggccccggggcgccctctcctccttcccgcgctaatttcacactcactgtcttgggtcacttttccccgcggggtttcgtggtcagagaggcgtctcctccatccagaagttgggccaccgcacagcgtggcgcgaggagagcggtccagcggctccgagtgcccgcccgaggcggagagggcgcgcccttgcgagtctgggaccccatccgcggccccccgagggcgactcgccccggctcgggaattaggactgagggagaggagccgctggagcctgggatctcggctctgagggcgcggtttagccacctacgccgaggtgacgcgcgaaacatcccttacccgggaaactcccgcgcctgaactagacggctcttcactggggaagcttccaggcccccggggggaggcccgggctctgctcagggctctcggggccgctcacacagagagtgggtgcgagtcagcgactgggctacgggggagatttgtgggcctctccatttggttttcttgagggaaggagactcaaaatgaggaccggagggtgggcgctccgtgaatgtgagcatgagtgtgtggatgtgtgtgtgagagcgcacacactgcgccgctcctcagactcgggcgagcctgacggcggcgtgctgtgacaggttccaacaacctcgggccgcgtctccgctgtcactcagccggtcctcccgcgctccggggccgctccggtgtgtgagagacactgggtctgtcgggagggtgtgctcggtccccctcacctctgtgcaattacagactaggctcgtcccgggtgcagatggctgctgcgaaaagaggttttactctggcgcacaccgtcgcccggtcgccttccttcagcgacctctgcccccacccctccgtgtaggtccctgcctagtcctaaagaaagatgccgcacctgttttacctttaatcttggaacgaatcaattccacaattgattcgctttcttgtacccggaggcgaacggaggggaaccagtggagcgccaagaaaaagcacagctgcttgttcactacctggtcggaggaaatagaaagttcggggttattttgtactttgggcctgggggtagaaaggcaggtaaaagaaaaggggaattgaaaaagataaggagactttaagaaaacgtgatagcagccagagtgtagacctttttattttatttttaaaagcaattctgtgctcacatttgggtatgttatgcatttcttgcacacatatttgcaacaagaaacccatcacaagatatgcatatgatgtgaatgcatatagctttttgtaactttaaaaagatgtctaaaacagcaaattaaaatgttgatacccagaggaaaaaagtcatttaggtgtgactctaaacaaggaaacaatttagcaaataatgtgtcaacgtgtaatcaggtggataaatctgtatcctgaaattactttctttaggcattatttacattagagaggaaaatactatgaattgttgatctaagcacgtttcaaaccacaaggatacttgagatatcagctacactttaaactctccttggttttatttagacttttttctagtacttttttgttttttttgtttctgccacagttatgtctcaaaaagagctctgttacacttgatttttgagaaacctttctgctccttcccccatccaccttttatatgaggcagaaattttttctgctttgacatgtcttacttaatacttttcagtttatggtgaatcagtcaaacctggctttcaccccagtaacaggtgtgggtctttgaggaatctgttttatttcaagcttcagaaactatcctgtgagtggcagccttgagaattgttggtgttagctggtgctatttctacttaagaaagcatctttccctcccgttttttctcctacccttgtgtgttgggggatggggtatttaactgtctgaaatttgacattagatcatagcagaactatttctgtgaaggtgttttaaccttaaatttctgcaggcataaaagagtttgtagaaaattgttgggtgtggttgacattttttctgaagtaataatacagaggaaattacctttcttctcaaaagtgtccttatttattttgaatctttttttttggtaggtggcccaggcaaatagtgtcatcgattggcctatgtcgttatggtgggaggattgactgctgctggggctgggctcgccagtcttggggacagtgtcagcgtgagtatcaagcctggggacttcagttccctgggaggtgtggctttccaccttgttcatggcttcaccccacatatcagagggttcattactgagcaaggcttggccttgcaggtctgacttggggattttcaggtacagtccagactccttattctgcttcttttcagctttagccacctgtattacggcccagctttgtcattcacagagagccaccttaaatgtttcttttagcatttttccccccaaatctgcatctccttcctgttttcttaccaggtttatttctctctctctctctctctctgtctctctctctctctgtctctctctctctctctctctctctctctctctctctctctctctctctctcgctgactcgcttgctccaggctgggagatggggataagataatgagtctagaccgtatttacactggggataagataatgagtctagaccgtatttacacaaaataaactctgaaccttagagtacttatataatcctcaccatagctgttgtgtaaagtggcccatttgtaaatccttttttggactggggttgtattgacagtgttttaaatggaccacccagtataatgaaacaaagccactgaaacaacattatttgtaagttctataagtaaccaacctcatgtaataagtaccaaatcagaaagctgattttcaccttttctgtgaccacaaatggatattttaatggtaaaatttagagctacatcaaaagagtttgagaaatttaggaaatttgtccccagcattttatcgcgatcttaaaattgtatctcactcctactgcaaaaaaatagtcttcaaatgatcaagtacctttccagagcacccttagagtgcttggggcgggggtagggggcacttctggtaagatgatgggaactaagttgggttctacattgggatatatattttattgctaatgaggaggaggcttagaggaagagagaagggcagttacgaaggctagagctggcaatggagaagcctgccttagagatgggttgctagtgtgaggagtcaggcaaatttaagttcaggaaagttaggagttccctctgctattttaatttttgaggatgcttgcaatgtcttccttaattttgtgaaagagggacagtgacagtcacagattgactctaattgcacataaagaccacaatctctggttgggaatagaaaggtaaaggaaatgaatgtttgcctacctggtatggaatttgagaaccaacagattctaataaccaaaatgtgaagaaaggacccttctgttggcccaacacacctacacataaccctcctgagtgaaaaatgagtagttctatacctgcagtctccagctgtgcaaatacttctgatactacagaagactaaattccaccaggcaccattcttcttttttgatcatcttcccttaaaacaatattgaatagactaaccagtgagtgtacagcagctttgcctacttcttttgtttactggaaactggagttaccaccatctccctttaacagaatgtaattgaccccccgtgcaaagggtctagccaagcagctcgcacatagcagttaggcaaacattcgtttgcttcaccttttatgtttatacttccaaaatcaaagtagttccaaggttttctatgttacagtgaaataaaatccctttcaattaaaaaggcacaaatggttctttactattaacattgaagttggtgaggttgtaaaaattagctcaaaggtgaatgtttccttctgtgtattttatttttccagcatcttagatggcgcaaatgtctcttgtcagttcagagttctgcctgtctttgttttgatataagcaggtagaggaatgtggggctgagaagtaagcttgaaggggcagaacaaaccaaaaagaggctgatcagattgaatgaaatatctctgaaaactcttgattattttaaagaaagtctttatgaaattaaaagttttgtcactacgtttgttcaagaaaatgccttgctattgtataacaattcaatctaatatgattccttataaagattccaaagaacttctagcgaatttaatgtgagaaatgtttttgccttttcgacctttagataatcatgtagttctttcccataaggaagggctattctcccttcctcatcagaggtgctctggttctcttcttttctgaatgattcactttggaattttccttcaaaacagcatagcaaaacaaaaagaaactattcccattactgcatagatcttcccaacttatcccatagaaggtgtgtttgtaggtagggaaaggtggtggtaccctcattatattatttaacagaccttatgccttagtgcagtgaccctttggtgagtgtttattccgtttggttgagcatttgtgagatgtttgacttaatattcatgtgagtcaaatgtacgtatctgtacaaaacatgctgcccttcattttcacttgctatcttcctatccatggtcttgtttggagaaaccgactaatgttgcaggatgctaaagctggtagacctctccttctggctcactatgtctaagcagagccagatatagctgggaaactttatatccttccctctaggactcaggaaggaaggatcagagatgctactcaaatgggcatagaacctgtcctgctgcttcctgcctgtaccacccaacattctatcccaacattcctgcctgctagggaaagcatgacccgttccagaaataggcaggttgtgttttcatagttcttttgtaggtcatacccttggttgttttttttttttttttttttgattctttgttttgtgttcttgactcttaaacagatctctagcatattgaaaattcaacatttgattttctaactgtcatgggctttacttttattgactattgatgtggctgtttattgtcaggtgaaaattttttaatatgttcacacactgatgattgcatatttgcagcacacagcatcttaaaccactcagaggtttgtcacaaaatgtgtgtttcttgctctgtaatttttttgtcattttgatggcatattttaattatgcttttatttctctccttctaccaagtggagacctctgtaacaaagatttttcagggttgcatatttcatctttaaaagctgtgtacactgtggaaacaattgttaaccaaaagcactagataatttaggataactgagttcaagttctgacttttgtacctgaataggtgtctaacatttctcagctacagttttcttattacacaagcatatttccaaggtatgttgaagctctaaactgcaactgaaaacttccttaatgtagaaaaactatataggatctaaatattgtatttttgtatggttgtccttctgtttactcggagatttgactgtatatgtggcttatgacaatagcatttttgttaaaagcattttatagaagtgtgaagaaaaactaaaaatacaaccagttccaaggtttaacaaaactattccgtttctgagttctttggctgtcattgagcaacttgtggtttctgaaggaaattatgtgaattaggatggttttgtatcatttatccttaagaacagggaaaattgagatgttttcttatgtttctgctggagattttggaaagatgtgaaacctacacctacagattgaccttgcttagttagctctgaacctcctgctgcctcttccacgtaaagtgaaaattttggattcttatcggcttcagataaacttacaggttagtgaaacatagggactgagatatagtaattcattctgaagctgttttggagtggtcaaataattttagttggataatatatattactggctaatgattgtggatattggaagtgatgaaaaaattattgaattatttctttctgcatttcaaatgaaaaggctattagtttgagcagagaattttgatttagtaaacaaaatatttaaatttcatgtttcatttctttctcctatctgggttcagatactcagtcttataaatggaacatgatttatttttgctccctaaactggttattaacttcctgtccataatcacaaaactatatagattatatatttctttgattatttggattttgaatactctctttaaaataatcaagagaaaattagagctgttagaatgttagaatttgttttgaaggccacacatagtgttccctccacagagaggttatactagtaaatgcctttctatttgaggtcaacaactatgacaacttccattgaacatgagttagtattttaaacgtaaagcaatttttatacctgtatgcacccaaaaagtaacaggggctctcaaaaggggtggggattgtactgtttacatgtatattgaagattgctagcagaattctggggccagcttggtggagcggagtacacttcattgtccttagtgtagtagcttcctcctctaattttgaggtgagaatgcagaatctgttttttgtttgtttgcttttaggtaggaataaaagcaaggcaaggaataattttgattacttgcaacattaaacttgaatccacaaatccttaggaagtgaagtttttgattaagattatttaactgccactttccttgaaaggttgtttaagaacatcatgtacctttgggtaacttcaagtggtcttggaatgcagattccaaagtaagatcagcgttgaagaatcttgaccttttcaaacaggtaatttgttagtatgtgtagtcttcaaagttaagtttcagagaaattgctttgctcttttattcttttccccaatcagaactgatctttatgtaatactattaagatctactaatttcctgaaatcccttcataagcttaatctggccaggtcttaacctttatggattagaaattttagtacttcttaagctagaaggccaggccaactaaagggaagcactctcctctctgccagttcagcaactagatctgtcctcaaatacctgccacagggatatgctgcttgaagttgcccacgcatgtacacactgggaccaagaaggcacttctggtgccagaaacaacactgtgtttgctttgtggaaatttttgatatgctttaaaaaatgtaggtgtcttctccctcacctcctgtgtgtaacttccagcatttctttttgttgctttttatctacagaattcatgttctttgcattttgagttagttgaatccactgtatgctttccagatgataattagtgaagctcaatgattctatgcagtgtctttcagtgggtaagggaagatattcatcacaggggtgggccttcatcacaggggagatggaagggcaagggagagggattctgatggcctaaccctcattattgccccccactgccacatgcagacactcttgccgctttcccattgattttgtgcaatattttaaatttttccaccaatctttggaaaatattaatttattttgtaggagaaaatgtattcatttccttaaatatccctcctcagagcaacaagcatgattagtttttggtatactttaaaaaatattttacctacttatgggtaaattgcaatagatctctcccctatcacccacttgttttgtacaaatgaaagcatactatatacactgctttgtatgctgctgctttttcttaactgtacatgttgaaaggttttatttatagaccttcttactttttttttttttttttttgagatagggtcttgctctgtcgcccaggttggagtgcagtggcataatcttggctcactagaacccttacctcctgggctcaagccatcctcccacctcagcctcctgagtagttgggaccacaggtgtgagcgaccacacctggataatttttgtattttttgtagtgactgggttttgccatgttgctcaggctggtctccagctctgagctcaactgatctgcccacctcagcctcccaaagtgctgggattataagcgtgagccatcttgcccagctgcctccttacttttttatgcactcagcattccattgtatggctatactgtaatttattagcaagtctcttactgatgaacatttatgttgattctaattttttgctaacacaagcaattctaaaaaaactttgaacatatgttaaagatgttgttttgcatgttcttagtgtttctgcaaaataaatttttatatgtggtcaaatggcagatacatttgtaatttttatcaattgcccaatgacttcttactcagtagagaagatagtttaaggggaaagactgaatggcgatgctgacccaaaggctccaacaatcccatatccagagtctgatctttccttgattttaggattctttgatcccttttctttcccaagaaatccctctgacaactcagtgaatgtccatctgctcccatcatctgtttcccatcagaccagaggcaatgggctgaagctaggagaatggagtgagatgtgtccatttgccagggtctcccagtggcttcctgcctatcatttacttgtaagaaagagccacgcattcctttaggaattgcttaattcattgatcttttattatctttgtagtttagccataattttttttttctttgagacggggtctcactctgttgcccaggctggagtgctgtggcaggatctcggctcactgcaacctccgcctcctgggttcaagcaattctgcctcactctctctcgagtagttgggattacaggtgtacaccaccacacctagctaatttttgtaatcaactgatggagttgatatccagagacaagatacagagattctgtatcttgatttttagtagagacagagtttcatcgtgttggtctggctggtcttgaactcctgacttcaggtaatccacccaccttggtctcccaaagtgctgggattacaggcatgagacaccgcgcccggccattagccataatttttatacctttgtgtatagtatgggctttttttttttctagacttataacctattaaggaggaatatgtagaattctgagatctgaataccattttggggacaccgtttatgataaaaagattttcaggaaatattaagacatttttgtaccaaaatactttttgtagtgtccttaaaaccataggggcatatattttctaatagttattctaatccttattccaattatatacttaaattgtctccttttagaaaagtaagaaatgcatgattaggtgaaaaattaaaagacacatactaagagcaagacagcagtgaaggtaagtatttctaactttcctgttttcctgacacctagttccaccttcccacaggctaccactgtttcctattgatccttgtagagatttcttaacattttcaaaatttccctttttcataaatgatggcatgaagtacaaacggttctgtatcttgatttttttttcatgtaacactacgttttggaaagcagtcctcattagtttatttaaacctgactcattcttttaaatggctatacagtatgccattacatgaatgaatgtactataattaatttaaaaatcccctatttatgtacctttgagtggttttcaatattttgtttttacataacatgctgcaatcaatatttgcatatatcatcatcactgttgtatacctttagatatggaggacatatctaaagacatttgatttctgtattagtatagtaattgaagaggtttcattttattgctacaaattttcttatgtttaatctgtaatgtaaaggagagtaaatcatggctaatattacagagtagaaaccttctgttcagtcatcttctatttttgattccttagaagataccttaaaagataaattaaattgatttctttatttctatttgtttatgccctatcttgtttgggaaagtatataaagtggcttccaggaattcacacaattaaaataaggaaataggggctacatggaggaaaatgggggtaaaataaaaatattaggaggagggtttttcaaatgcagatatgtaagccataggatcctacatatgtcctacaatttggctactagcttctggtagccaaaggtaaaagatgttattgctgatttaatttgtgttgtttgtcagggaaaaagcaaacaagttatgtgggaggaattatggttttactgcatgtagttctgaacgaagactttcacgtggccctttacggagtgggagtgaatgatgggatggaaggggccacagcaacattcctatcatgaagccagtggtggtttttgaaaagctgtttcatagaagatccgtcaacataagatgaggcccttactctaaaagtacagttcacggaaagctgttctatacatagtttaagaagcattatgtgcatagctttctgacgttcagctagatacagcccagaatatctagctgtgatggatgaactgtatagggttttggatggacagctctggattagacaagatagtttcaggttagaatcactaacaatgttctgaagtttgctgtattatttaacagattaaaggccagttcattttgtctttcttttttaagtcgatatattttgaagatcagtaatcaactaatggagttgatatccagagacattgtgaatagagcagggatagggccccgcctaggctccagtaaaaggaggatctgcaaagaaattagtgggagattttttaatatcaattttgtatccattggatagcaatatataaattcaccaccattttgctatatacatattcatttccatgccagttatggcttggaataaggaggaaaggcatgaacattgttcccaggcatcatttaccctactgatgctgatacatggatatgggccagtgagcccaggaacaacagaatccctgaccagtgcttatttccccaaagttcctgattgctataggtgttccggggagtcaaagtaacctcaactgttttcttaattcacctggatttataagggttgatttatataagttgcttagacctgaacagactcaaagcagagtctgtaggaaatactctgcatatcaacatcccgtacccaaacctaagtcatcttttcactggggtgtgcggaagggctgattctcatgtactcttgaagccctaggcaatagaacctgaaatcctgatgcacatataccctaggataatttctctctcaaaaaaaagcaaatagtgattttaaaaattatgactcaatgcatattctgagagtgcagcaatccagtaagtgtcacatctccttgggaggaacaaagagaaggtcttcaaacgccttttctgcagagactagcgtgaaccaagaatctccctgtctgaattgtcaccgtatatcaacgtggcagcgagctgagaaagttagcattgccagggccgaggttttctgtcttcacggtaacaaacaaatgatcagtcctcaaagatagtaaaatgtagccaagataatttggcttgaaaaaaattcaaagtgatgtcaataaccagctacaaccatagaaaaatactagtagcatattgatggtgcatccctgggaacatgccagggcaaattggggtgcaaaatacaccagttatttaaaaattggtatgttataaggtaaagaattcattaagtaatatcaaatacaaataaactttttattttgattcactaaaacttctttttaagttttctgattttattacttaattactactgatacataattaaagaattatggccataatagaattcctaataaaatttctaataaagccagaatgaaggagtatattacaggccagacatgataaagcattatgatgtgtggtaaaatagtgacatctattttttcattctgtattattttataaattttctggagaatttcagtttaaacagcctgctgaaatactgttaaatcaacctgttattcttaactctgatgggaggaaacagatatgaataataaaaatgatttcttagctttagaatatagttgttgctttggagaacaaaccgttttattccaattattttttattaggagacttcattttctgccatacattagctttggtagatactagatgccaggggagtgcaaatttgagaataaggatttggcatgggttatttgcatgttgagagtcaagatttaactaaattttaaaaccaaacacttcatttgatcaatatctttttaaccattctgtagattaataatataaattctccagagctgacattactttgctataacatcatcagatcacaagattagggttgccttttgtagatgttattcacttactctgaaatgttaggaaatatgtcatcacagtttaaatttgtagtaatatatacaaaaggaaaacacaactaggaattttggatttatgcttactttgccaaaaaccatgttgattttcaaaaacctttagccttttttttttttgagacggagtcttcctctgtcacccaggctggagtgtagtggtgcaatctcggctcactgcaacctctgcctcctgggttcaagcgattctcctgcctcagcctcccgagtagctaggactataggcacccgcccaccacaccaactaattttttgtatttttagcagagacagggttttaccatgttaggcaggatggtctcgatctcctgacctcgtgatctgcccgcctcagccttccaaagtactggcattacaggtgtgagccaccgtgcctggactaaccttattttcgtaaatcaaagttcctaaattcagtttctaaggaaagcccctaagtggtcaaaggtgtgtgttgctgaatttcagaaacaaactccatggatggactttccagacataaacttcccaccaaaatattgttccaaagtgtttagtgcctcctattttattttagtgttaagattttgtaggtacttggtaattatcagcagaatatttacataccaacaaatagcaaagccattgataattaatagaaaaacaaaatcatagcttatgtttagttgtattttttagtgtatttcagtgtttagagttgattttatattgcatatactaactgtggtaatagtttctactggatagattatttcaagttcacatgattatagaagtattttatgaagtttgacatagataatggtggtttcagggtcccttgtctcttgggttgagtttttacatcattgaagaattaaaagattgtgtcttggtgtctatgtatggccaagaattaagacattctgatgtacagtttcattttctaactaaggcaaaaatgttttttgaaacaattactttttaggataaaagtataaaattatgaagaaataatgtgtaggtttgctaaatgttgtgttcttaaatcttgtgttgaggtctgatgaatttttttatatctttaatagttctaaagtagtgtactgaaagttaggatcatccatgttgctacttaacttgttgtccatagggtctgttgtcctggatgttggtgttataaatgtacagagttaggtagttttctgtgaagagtttgcaggctaatatcactgtttttgacaatgaaaaatatagcatgaaaattaaggttggggtatggagaactttctagagctattgctttttctagctgatgattaaggttgagaggcagaagtacattgtgtcagggaggacctttcccttttatgcatgcacctggcatttatcacctttaacaaagtgtgtgtgtcatgctgtgctgcttgcttaaggggctgtatgcctccagtctgagtcacatggtaactgcatcagcagtcttagcctgtagcattttattatttcttttcaaagtttacacttggcctaatacttagacattttataattctttacagtaaatgaaactatacatgagaagatgggcatacctttggattaaaaaaaaaaaaggctcagttctttaaagtttcttatccttgattttcctaacacggtccaaagttcaggactggctccaaacccataaacctgtgtttagcaagcaagaaacataatccccagatagtttagtttctctggtttatgagtcacaatttcataaaatcatcagagtgcttattaattccaaccacgtatagtaaagaaccttcagatgaactgaagcaagggttcttaggcaagttgccggagagagttctagaattctaaactacctgagtagctttgctgaaatgttgcttgtatttgctactgtggccattttatgatggccatagagcaacagattatcaagagaaaatgagacagatttttctgtattatgtgctatgaatgaatcctattttagtgaatgttttaatggggtttataccgcaaaaaaaaaaaattgtatgtaaggcatttatttctggcaactttcataaaaattgttgtgatggttgcatataaaaatttccttatccttcaatagaggatagttcccagaaacttcctagaagtaatctattccagatttaacattgctttgacataaaatgcagttttgtgtagttttaaaatgcaaattaaaaaatataggacattggctaaaattttatcttgaagtcgggtatatattgataccataaaacttactagatctatgtatttcaaggctaatttatgccaagtaggaaaaatatgacccaaccttaagatattacaaggataaaatagactatacaaaactgtttggctatttggtactaatacaactagttagaacataatgatgtttgctattctttattaagttgttttacctttgcttacaataatttaaagtatttttcctgataaatttgatgactcaaaattggcaattaaagaatattaaagaaacggtatccttttatattttttctgtctcatatataaccatagtcataacttgtgtgatccagaatgtaatttgctatttacactttgatttcagctgtttgcttagattgtacctgatgtattttattattctatttaaggaatgtgtcaacatcaagatatggtgagttcttttcaaaataacagtagaaacctgaccaatatgaaaaaaaaaagtctagcaagcaaatgtaatttgtgtctttaaaaatacatagcaatcattctggatcaatagttaaattattgcttcaattaaatcaaattggacttagaatttttttcttcttatattacccaaaggaaggccccattcacctaattttaaattatacaaattatacaaataaatatacaattgtaaattacagtggatatttaatcctttaaaggcattaatttagcagagaagaataaaattatcccttttcttacctctaaaatctctaggttgatcaaacactgaccattattagtaccatttcaagtttcttccctttactttcatcaaactgggttatttatgtatgttcaagtgaaatggctgtgctttcatggtaattcttgttgctattgacaaccaaagcagccatgcaagaagaaaatgctgtggaagggaagaaaaaaattatatttcctccccaaagttggagagagaagggaacatacagtatgtaagaaacaggtaagtaaaaatatatcaattttaaaactattagcctttcttactaattgatcaaaagtttaaattttttcagatgtgttttccaactccaatttaaataaaaggatactgtctctaggaatcagaaattaatattctggaaatgaaaaattggatttgaaaatacagcatcacaaaaggtctgaaatatttaaatttagaatttggactatagaagaatagcataacttcaattattggttaatatttttgttatgaaatgtttttttataacaaaatggtgactaaaatattactattttaaacatgtcctagatttttttttgtttcagaaaagcactgaaagttgaatatgtgtaagtctccgggaatgtaacaagttgataaatacccaagtccagcctccttacagagaaaagatctggaatttctttttttggacatttgttttgcagctttctacgtcttaaggcagagaatagccaggataaggtgccagctcaaaggttagatgaacatatttcttgaaataattttggctaatctatgtcttgaaaggcataccttctaaataattttacaaagctgtaaacaaaacattagttgtgtttttgaattgcttctttttaggaaaactatatttcttagagatgtgcttattctatacataattatagtaagttaattttaattccattattacattaaacttttccgtttcagttgattattcctttcttctgttttatgaatctaataaattgacctccattctaagctaaaggacagtttatgtttttaatacttaaggaagcaaatataaaaacaaagtccaccaaatgaaattactaacaccagcctatcattaacctgagggagttgtatttcatattcattaattctccatggaacaattcaggtaagaaatatttttattgtatgaaatatgttatcagttataatagcacttacgggcatttatgctcttgttttaggtacataaagggttccttgtttaagatatttttggcagtaaataatgtcacttatcaccctatgacactttagtggaaaacgttggtgaaatatgtggaattgtaatgtttaatggaattgattctaagaagacaatgttctttttgtttgtttgtttgaaacagagccttgctctgttgcccaaggtggagtgcgctggtgtgatcttggcttactgcaaactccgcctcttaggttcaagtgattctccagcctcaggctcctgagtagctgggattacaggcgcccaccacaatgcccggctaattttttatttttagtagagatggggttttgccatgttggccaggctggtcttgaactcctgacctcaggtgatctgccggcctcggcctcccaaagtgctgggattacaggtgtgagctactgcacccggcctgagaatgttctttaaactgattgaagaaactatcacatgtcatgaaaaatgtttttaaggcagaattttaataaaaaaaatatttgggaacaaaattgatagtactagaaatagaagttcagaaatttctttgttcagggagacttaaagcatatgtattttaaagttactagcagttataggattgactagtagagctatggcttacattagggaggcaatgccaaggaaagaatagaatgtgtggttggccaccaacatctgggttcaggaactgttcctatgacttaccacctgtaagaaactagacattttaacttttctgagctgcaatgttgtaatctttaaatctaactttgcaagattcttactggttataaggaggtggcttccacagttcttgacagatgtttgctattattagtgtgttctcaatatatacaatacaaatggagaactctgagccgagttttactaggatccatcctaggacagatggtacagcacattttcaaatggttttgtttaccataatcatcttttggaaataatcaattggaagtagaacaattcttcagttattcatttctaaaatcaaaactttcatgggatagttttctgtgcttctgaaccgtttttcccatttctctaataatatccatccataaacctccgagtggaacagttttggttgtctaacagtgtttgtgcttgggaaatgaattgaagggagatggaattgaattgttgaatgtgagcatttagagttcctgtaatttatccgtataattatttgagagcttactagaggtaaagagctaagttaggtgctgggaagatacaaaggtgaataaaacagggacccttactttcaagcaactcaatttgtaagatgattggctcttattccttctatgattcttaaataggaaaaagttagggataaagatttgagggagttcagggaaagaatcatttcctgctgaagaggatcaaggaagacttcatgaactcaatggtattcagttgatactatatatatatatattatcagtatatctagtatatagtatcagtatatactgatagtgagtgacatgaatgcctagagcttcattttactgggatgatatctgcagtagttggtcctggatcatgcaggtaatagctggctctctctctccattctctctctctctctctctctatatatataatatataaaaataatataatatatattatatattataatatatatattatataaatattacatatacataatataatatataatatattatatatatagagagagagataatggagagagagagccagctattacctgcatgatccaggaccaactactgcagatatcattctagtaaaatgaagctctaggcattcacgtcactcactatcagtattgaaagcccacagaggaaggcaatactgggtaagaggcatgttttagtataggattctgtgagagcatatcttaaggggcagtagcccagaccagcagtgatggagtggtgatggcccagctgaatcccgagggataaatcagtcaagtgaagagtatcctgggcacacagaaaaatgcatttaaagctcagtagccagagggaggagcacattccgagaactgttaagaatctcaacccagcatatgtggggtatatgtttgaagggcatctgatgagagacgcagtgggagaagtgggaaaggactcctggaaggcttttgatatcatattaaatacatttgccttaatcacaaagttgtagaggaacactgtaaagattttaagcagagaaattaatattttagaggatagctggtggtaatggatcagatctagcactcaggtgaatttagttttgcttggagtgtttgtagttgtcagtgtctcacaggagacacggatataagggttggttcaaaaatcggtaggtctgcattgctgcgaggagtctatcagctggggcctcttaagtagctggcccatttggaagaagtatgtgcctcatttccctgtggagctcacttcctttagtgcaaatgcctgggacctgtaggaagtcaacctggtgagaaattaggcttcattttaagtagtggtggtgggaacaaagagaaggagagggattgaaagatactgaaaagaaaggatggagaggcacacagtgttagggcagtggcgggggggcacatgggcttggcagacagacttgctgcaactacaaattgtgtttttgagaaacttacctaaacagtctgagctacagcttcttttttgataaaatgtagataacagtcctatctagtaggactttttatgaggatcaaatgaggaaacccaaagcgtttgactcagcaactggcttatattcacattcagtaacatggtggctgcagtatttgtaatgctggttgtgaaaggtgaagaagatgtaatcaagattactcccaagtctctaggacatcatttggtgagctagagaacacaggagaaggtgcagataatgatttcaattttggatatgttcagtttgaagcgcttgtgagactttgaagtagagaaacttgatatgtgcttggattgcagggtgagatctgaacagaacacaggctatgatttcatttctttccactattctactcaaaccttccttccttttccttcgtcaacttcagtcaacattgattattgccacaactatctccacggaggaacagctttaaacagtagaaaaagaatgtgggataggtaaaaatctgtgttccacatctgctaaatgttatctaatagttgtaagttcttgaaaaaaaatctttccagtttaccgttttggcaaagcattgtaagcaactaataattcaacatttgtttatatcaagggctgaaaaaaagtcatcctctacaaacatattttctttttttccctcttttggttgcctttttttgttttacatcaccaccactcctaactctaagaaaatatttgactaaaagtgaatcattgttagtagtgaattcgtacttttttttttttctatgagacatagtctcattctgtcacctaggctggagtgcaatggtgcgagctctgctcactgcagcctctgcctgccaggttcaatggactctcctgcctcagccacccaagtggctgggattataggcatacaccaccatgcccatataattttttttttttttttcagtagagacgggtttgccatattgcccaggctggtcttgaactcctgagctcaagcaatccacgcaccttggccttccaaagtactgagattacaggcctgggccactgtacccagccaagcacatttattttttaagtttatattctgtcctaatacaatgtattaaaaatgagccctgcctcaagtcctagcctaaatgccactttctccagtctgctttcctgattttcacagcaggaagtcttctgtacttcctctacatataacacttgcatgaagcatatctcacattgccctacattgtggttatttatggatctatattatttgttctgctagactattagtttcatgaaggtggaggcagtgtcttatacatctttacgccagtataacagcttctgcaatgcctcgtccagttcagttcagtacacttttgaaggtgtaagagctagtcatttctatttattaataaaagggatttaaaaaaaagatggacaagatgtaatcttaataaacatattgtggttttcaggaaacagtttaatgagaaaatgaatatatttgtctccctaccttatgaccttattacatatcatagatcttcactcttgctttagattctaaacagaaatcaatttatgtgcttgaaatcacataaaggtaatctgattgtgtcatctactgcttacagtccattggctgttcacaattatgggtagaatcttgattatttgagtagaagccttttcaggctgacattgccttatcagtggaggactgtttcttgttgtaggcccagtcgcagtggacggcccttgggtttccagacttctgctgcttcatgcctgttggcttttcttatgctgctcagtctgagtcaaaggcccttcacccattcccatggtgaatttctacttatcctttaaaattcagctcacatttcctcttgaaagtttttcctggtatctttcctattcctgcctccctgcagagaaatgccttcttctgtattcttttaacaccttgtacacctgtcatgtctatctttgtcaggagactgtacactacagagcaagtactgtgtatttaaagagctcaaagtctagtgaaggagctagataagaaaaacaactctgaaaatatggtataagatatatatatttaaaagtaaacctgtatatacatataatttatgatagaagtatgcacagaggcttatgaaagcactgaagagggtatgaactcagcatgaggcgtgaaaatcttgggggtgatataatggtcaaactgacaggtgaagcctgtctagatattagtgtagcagacaagagggggaatggcattccatgtgaaagtgtggaggtactcgagagtgtatttctaagaactgcaattaactgctatatttgtgaatgtgattggaaatgaggccaatgggataggcaagggtcatatcatgaaatatggtactgaatgccatgctgagtgtttgaaatagtataatgatctacatgaacatgatgaggagccagtgaatgagtataaggagcagaatggcatgctgaaatcatgggttagggaggtccctctaacaatagttcaggcctggattgaagtccatgatgttggacacagaaagactgttgtgccatcacttacatgaccaatctcttattgatggacatttaagttgttttcaaatttctgtttaaggttcttcaacagataaatttggaataattatcattttctttagaaaacaaataagcaaactaaaaacacctgaaggtcaaaatgacaaatctctgacatcatattagtcgaggcccagtaacaaaattgatttaattttaaaaataattaatgtatacttcaactcatgtatcagtgactcttttaaacatagagattttggttgctaaaaaaggtgatgatggttacattaaaattttctggccttttgtgatgattctttagcaaacctgctcaaaattacagtatcagatgttttaaaaaatgataattttcaactgaaagaaatactgtaatgtatttcatcatattctatgaattcttacattatgaaagatatcttttatgtttcagatatctattatatttcctttttgaaagaattttttctagcactacatcttttccaaacctttttgactttcctaagcctgtgtaattaatcactgcctgttctgtgtccttaacatgcatctgttatcaggacatctctgcttacttctgtttctccttactagacttacctgctggaggatgagaacttgctctcctattcatttttatatccccaatttttaatatagtgtcttagacactggggcgtttcctccttgtcatacttataatcctcatcataattagcattttattgagctcttattaatgagatgggtactgttctaagtactttatttgggttttctcatttagtcctccaataaacctatgagtaagatctctaatgaatcttgtgagtttactggtttttaaataaaaaatggcaatgagagcagagagaagctaggtaatctgtataggttgcacatttcccgagtggtagagctgggatcccagcagtctaactgcagcatctatgcttgtaaacctttctctaaattacattgaaaagttaacaactactcacaagttaaataatagttgtctgtgtattcatgttattgtactcctttttatatatttcttccatgttttgtattaaaaaaattttaaatccacagaagagttgaagcaataggaacagtaaatacccatatatccttattgttaacgttttacacatttttttttctctcttccttcccgcctcacccttctctctttctccctcaaccatttttaagtaacttacagacctaatgacacttcgtgcctaaacacttcagcattcatctccagagagcaaggacatttacttacaaaccacagtatcatttcacacttaaaaaatttagtattgatataataatgctatgtaataaacaatccatatttagatttccctaattgtcccaataatggtttttatggattttttctttttgatccagatccaattaagaatcaaacactgcatttagttgacattcctctttaatttaattgctttaaaacaattctaccacttttgtttgtttatttgcttctcgacaatgatatttttgaagagtccatatcaattgcttggtagaatctaccacagtttaaatttgtctgttgtttctgcatcattagattagaactaaatttatttgtaagaatattatatatagatgatcatctgttatgatattccttgtgcacatatgttggtttgtcctactattggtgatattaagtttgatcacttgatgaagtggtatccatcagatttctctactgaaaggcacctttttttctttgtaattagtaagtaacctgtggggtaatacattcacactgttttgataccctgttccccaacaaactttcacttggtgaaagttttaacatctatggataatctttcctcaaattaattatttcaatgatgattgtaaagttctgtttttcaaatttcgccgttccttctacatgttagtaggcattgttctttaaagaggagctcagtcttcttcctatttagaatcacttcgtaaccatagattctttttttattcaattgttatcaataactaccgttattcttcttgatgctcaaacaatcccaaatctagtcagtggaactcctccaagccagcttctattcttttcacatgtctctaccattctttgagtgcttaattgctttttgcaacagaaaacttattctagcctccctcccctagccctcattccttttattatttattttctttagaaaacaaattagggaatgaaatatttagaaacaaagatccaggtgctagctgtgggcattgctactgttactctactaaaaaaaaaaaaaaaaaaaaaaaacttcacatttccaaataaatagtaacactttttaatgtgttcttaacgttttatttggcattaatctaaattcccctctagcacaatgaaaacagaaagagaaagttaaaatttcaagtaaactgaaaacaacaatagtgctcagaggatttttttttaagtgaaaagggatagtgcttaattatgacaaataaaagctaacttgagatgcacatatacagatgcagccacttattttggcgggggacacttcaggaattaaaatttaaatagcgagagatcaaatagatacttggtaaatgtgtctgaattggatgttcccagacacaaaaataaaatgagttattgacagctcttgggagacaacattataaagactagacacgttatttattttaactctatgttctaaattaccattgagtaattgacattcgtatttgactatggtttgtggttaagttcttaattgcaataatgttaaataaaatgtgaagcccaaagcaaacaacaacaaaaattatagcaatacttcaacagaggtaataataatatgctgcatcaatggttcagaatccagcatctacataaaacaagcaacagggtaatgaaattattttcttttcaaatattctggcagagctactttagttttcttaagttatagattgtggtcttaactgcaacttttcgctccttttaagaagtatttaagttatttaaatgttacttaaatacttttatgtttttaatcattattaacattctctacccctctcatcctttcctgcttagtattttgttataatctcactctccccacttccaaatgcactcaaaaatgctggactttctggtctttttctgaccaccagaagaagtagtggattgagcatggaactgggataagacatttttcctgaaattggtcaagtcacttaatcttttgcatttttacttgtttacttgtaaaatgaagatagtgtctgcctctctcctgccttatatggatatcatgaggataaattcagtcagtcatatgaaatggttttgagttctgtattcatgagggcatttaatgtgtcttatagtgataacaatcagaggcattattattcagtttttactgcagcaggagtttagatttgaccatcagataattgacactatagtacagggtattaggaaagctggaaagatgctttcccctggagatcttggacagtaggattcttctaggttttgttctgctcatgatatgcaatggctcagggcacttttcagaggaccactgtacaatctccctccattccacccaggtcctattaatatagtagtgagttgtttcatattgccttcagtgactttcccttttccaaggccaattaccatttgaaaaagtcattccctgtcatattttcttgttctgctcaaatgaatttgtccatatctgaattctgtgaagcttgttgggtgtaaaaacagcttttcaaagtcttccagtttcatatctatttgttcttctgccctacccttgcatgtttctctgtccccttttcttctgtgagcataacctggaggacaaggttttttgttctgcttttagtggtgccatgtctgcataataacatgatgtagattgaaaaaattacaaatgattcttggaattctaaagataatcttatttctattgagaaaatccttctcaagttactaactaccattgagattggattggcttttgccttattacttttcagagcctccatctgcttgggtatctcaacatatccttagttttcaaatgttggcactttactcccagcatgattaccttacataagaaacattataggactgatgtgggagtttacttttctcataacttatttgataattcactgcttatgttagagttagaaactattgtccaactctcagagacccagttacatcacttaagatggatattttttttttttttttgagatcaagtctcactctgtcgcccaagctggagtgcagtggcgcagtctcagctcactgcaacctctgcctcccaggttgaaatgattctgcctcagcctcccaagtagctgggattacaggtgcccaccaccacacctggctagtttttttgtagagatagggttttaccatgttggccaggctggtcacaaactcctaggatggatttttaagactaaaattttagattgcaatcaaacagaagaggcttggacatgtgacattaaagagctatgtttgttttgccagttgaaacttgtttctttttctagttaaaacaatgatttagaggttattttgagggcactttgaagattatgctacaggaatgctagagagcaaattttgagagtgattgcccatttggacttaattctggcaactgattttggggtaaaatgtctatcattcgttgattatctgtgatttttacctggactttacttaagctttattaagttgctaaaccatatttggatgctagtgatagcagaccatcaaatacggcccaaacttcttgttctgatccacacgaaggtcagagaagcaatgctgccttttctgatagccagtagcaccagcaggcacgttgtttactccaaacaagaattttaatatttttgaagaccactgaaaatggatcatttatacttttttatttttttgataaggaagggatgacctactattcacagagtaatgcagtttgctgaaaaggttggtttttgctgacctctgagagctcacattacagtggagtgtgttattggaaggtgagccagtttatacagaggttgggaattatttttctctagttttgaaatggttatgcactttctaatctagttatttagatgtagaaataaagttttttttttacattcccctgagtatatggtattgtaggtataaaataaatttgatgagttttatttctgtactaggatctactcataactcttctatcctaaatttgtatcaaaaggaaacctttgctgtcttgataataaacacagactaagtccagattccacagtctagtgatcaaggaaattcaggaattgtatttagctacaagtaacgtgacacaaagaacagtgccctaaattgctaggatggtgatttagggttaatattatgacttcttgctctaccctctttccattctcaagatcgcctcatggtcataaagaggccactgtggttgagtcatgacatgcacgttctaggcgagaacacagaacaagccgtgctcttcagcccccttcttacacagcattccaaagccccaccccatcacttctgctttcatcccatttagccagaacttagtcatttggctgcccatatctgctaaggagaatagggaacatagttttccattactaacccatcccccactcaaaaaaataaaaattttaaaagccattctatattaaagcagaagggaaagagatattggtaagaatccagctggccttttgtgatctgtgtcagcctttcttttgatctcatctgctgttttaagcactttacactgtagccccacgagaacactttgcactcactaagaagcagtcccctttgctgcgccccccccccaccactttgcttatattctgaaagtcttttgtttcctattccactgctcttacctctaacacactgcctctaacacaccaacctgcagttgtagttattacacaccctccttggttctttcatctctctatcacagcccttgttgtggtttagccaatatattttagttccacagctaaattttcataccctctatgactctctaatcccctgccacacttgcctactataatacattatatatataacaaatgtttgatacgtatttattgaattccattccagaactaatgccagcaagataactttgtgctatataggagaatatctttttgtgcaacagtttccaaagggttttctttttctaagaagaaagaaattgattgtatcaactttatgagtatcctaccgcatttaatagccattggctaatctaagggttcctggttacttcactgaatagcctatcagatgggagtgcaaacaacagtttgttttgaaataggactccctaaacatggaagaaacattaacagtgttggcctgttggaatgtgtgcatttgatgtgctcaagattagggcactctgcttgagaacaaataacaaaaaagggagaggaaacaataaaaactttggtcctataaagcacctgaaagtactataaattgatggttctcaagctggtcagggggtccaaaggctacagcctgggggcctcaagtttaattgttttataaagtgtcctaaataaattttttatgtttttaagtggtatttttaaaactactttttcatgctttgagagagttttccaaattccaattattttaaggggttatttcctggacttgcacttaacgattttgagatgtttacatttttttcaatatggcattctgtgtgcctcagtgatacatggttatccaggttgcatgcatatataaatgttaagatttatggaaggtcatctttttagattaaaaagaatttttttaagctggtatttcttggtgatagggcctagaaattatgtagagtggcttacttctggaacttattttaaactgcatataaaccatccgcctagtgtacagttggctaaagagtaatattagaaggccctcctggacagtttatttcatttcatggatatgaacacaattgtttccctttgaatttaatgccatgtttaaaatcagattttaagaattttccaagggcatttccctatcatttacactctgcttgtgttttctttctgtagtcttttacattaaatacctcctacagagcactgcctaaggatttgtggtggtacagggtccagttgggatgacaaacaggcaaggaaggcctggaagtaaaattagcaaagaggccctgtggaatggaaggtgagggaagggttagtgacagttgggggaggaaaggtagaaaaaaaaataacatgcacatcagtttcgcaggagtattagagtcttaaaggaaacaatgtttgataattatcagagaggaaactgggagcatagagcatatcccagaatggagaacagcatgggttaaaatgggtaggaacaggtgtcaggagcttcaaaattcgggatcattgttgagtccattccccttggtcttcaaggactgtctgctcttcactcaatgattattgaagctcatttcttcctgtcaccaacacaaatcataccttcttcacgtcagacctaaactatttcgctggccttgcaactgttctctctgcctctaaactctttccagtccatcctacataccatcaccagagctttgataagattcccagagctttgatttttatcaggcagttatgatgataaatgtatggaaacttcccatttcctagagctaaagtgcatgtttctcattctgaaatgtagggaacataatcatctgataccactcacctgattgtttctcactcttcctccaccatttacccatctctttagcttaatgagtcccctgtgtatctcccaactaaacagcggcttacttgcctgtgaaatattcttctcttgggtagtctgctcccttctctgtctactcatgcttcaagattcaacataagcctcctctatgaggctttctgcacgtatgtatatggatttgcttgtgtaatgatttcttcacagatttcatattgctgataaataaatattgttttgaataagaaacgtggttttgtatttttatctcaattgtagactccttgagaccagtaccatgctatacaattatttttcatctattatagtgtctggcatagggacatgcacatatttggtacagaacaaggtttccgagtctggcacgatgacattttgggctggataatttgttgtggcgggttgtctgaacattttaggatgtttagcagcatccttggcgcctatccactagataccagtagtatcctctccctagtgtgacaaccaaaaatgtctccagacatttccaaatttccacaggggtaaaaagtgccccccagttgagaatcactgatagagaataaacggaataaattccaattaaacagtgaaaatatttgagtgatgatttacagaattttaaagtcttgagaaagtggaactcagttgatggaaaagagtgaatgtcaaactgagaacgtcctatttgctatgttagggcatagaaaggccattatagattgaaaagcagttgtaatgaatcttagggttaagaaagatcaagatacagaaatatccttgaattgaagttccaaaacaatgttgttttggtttttgtttcattttgaatcctttcatacttaggaataccatttctagtaaaataaatattttatgtttagttagaaatttatctgtatttcatacatacttagtacttttggactaagaactgctatttgaagtatatttgagggaatgagtttgaaattttgggtgcaggacattataaagttgtaactatgaataaatatcagttatgcttatgcatagttttacctagttttatttgtctatttgagtattgtccttgaatttaaaatttttttcagccccaactgatacacacacatatacatacataacacatgtgtgtgtgtgtagcttacagagtgtttataggaaactgattttgtatactttggctactttgttgtaagttctagttttttttcttttattattaaactagtgcacgacatcaatgctatatgattggtgtttcgttgacctagaaataatgcatgccatcttcttttcacagctgtgtgccaaccacgatgcaaacatggtgaatgtatcgggccaaacaagtgcaagtgtcatcctggttatgctggaaaaacctgtaatcaaggtaggaaaacagtctgacataaatacacaatcgaagacacctctatcactcccaaattaaaaatattcttatctcaaactactttccatggctatttttccaaaatatgtgagctgccattttgctgataaataaaaatatattaatgataaatattgtaaaatttcttttatcaaaggacaattaaacaaattgtatcctcttattctctgatactaattaaaatgtattttgaagaaaagaatccctgcatcagtaatttagaagccttctggtactccttgtttttccactaactagttggaaatccttggccaaataattaaccacctcagaccccaggtactgcttccctttaatgccaaagtcaagtaggggatttgatttgaaatttggagtttcctcctaactctgagcccttcgattcgtgattaaatctcccttcaactactgaccagtttggaatgtttccatgataaataaaaatgattaatttagcaagcactttttaaaaaaatcagcatcagttgtttaaagcaaatatttattcaacactcatagtgccccaggtattttatatatataatccatttttatctttacaacaacattaggaagtagagcattatttattataattaaggtataatctattaattattagtccattttttatttggagagacagaggcataggaatattaagtgtcttgctcaggttcacagagttagtaaaagagctagcatgtcaacttagagctatggcatatataatccatattttttctactatactagttttggataaaaaaatatatttggaaatgtgatcctcgaactcatgctacaaagtcagacaaggcttgtcttgttaattaaattcagttaaaaatttccattattggcctggcgtggtggctcacacctgtaatcccagcactttgggaagctgaggcgagtggatcacctgaggttgggagttcaagaccagcctgaccaacatggagaaaccccatctctactaaaaatacgaaattagctgcgtgtggtggctcatgcttgtaatcccagctactcaagaagctgaggcaggagaatcacttgaacccaggaggcggatgttgcggtgagccaagattgcaccattgcactccagcctaggcaacaagagcgaaactctgtctcaaaaaaaaaaaaaaaaagaaaaaaaaatcattattaggaattaaactaaagaaagattagggttagatttcactaaatagataagtgtcaaaaataaaaaagataagtcaatttttacttattttttaaattatactccctatcatcttaaatgtcaggtgaaataatcatatggtgtctaactatcccttacatacttacttgacctcatctgatatagaaatgatattgctgaaatactactgttcttcagtgtctgatacttattccaagatactccttgaggtatgtcatgtaaactaatgatttatagacacagttttttttcactatttatttttatttttttaattttactttaagttctgggatacatgtggaaaacatgaagctttgttacaaaggtatacatgtgccttggtgatttgctgcacctatcaaaccatcatctaggtttcaagccctgcatgcattaggtatttgtcctaatgctctccctccccttacccctaacccccaacagttcccctccctgtgtccgtgtgttctcattgttcaactcccacttatgaatgaaaacatgcagtgtttagttttctgttcctgtgttaagacaccgtttttacaatcatccagaacattgatttttgaaaacatactcaaaatggtggttcatgaaccatcagatgaaattattcatgaaccatcagatgaaatccacactagcaaaaatgacatgtcccaatggtagaagctgctattctaaagtgtgttcttgtattatctgctatttgatttagaactgattttcccaatgcttgttttctctctaatactctttttaacttgaaatttaccaaacatacctgcataatctttttaaataagtgatgctcttattatctcagtttgctccttaaaaaactccacttgatttttcttccccagcataagtttgcaggtagcagtgttctggttattggatgccaatgttcatcttagaatctcagtatactttttttaaagtggtgaacataagccctcagaggtttcattaatatatcagcacggtaaaatattgttgtccaaatgtgaggatataaaatataaagaagacgattaaaataagtcacttttgagattgcagagaaattcatttaaatttctttgcagaagctgcatcaactttaacatgctttaaagacatgctaaaagtattattgaaacaaaagttcatcactgggtagctcctattttcagaaaaccagtttaacatgtacttttttttcctgtaacacatacctatttctctaaagaaaaaatcgaatgtatcaagttaagatcttgctccccaaaaccatattccttaaagagaagaggatttgattagtagcaaaatgggattttacacctgcaaaaatagtgctgacactgaaaatgtaatttcaagtccagttttgaaaataaaactacagcttaaaataaacttaggtgttttaatcatctcttattttgccctcctcacaaaaaagcagtgtggcaggttcctgatggcaaggtttatgctccttgagagcagaaatcctttttgttgtctctctgatttctaagttcctgaaaactattattaaagtgacttgcacatggtaaatgcacactaaatatgttaaataaatgacagtttcatctaatggttcttagtcctgaacactgtggaagcttgaaagggttccaccagttcttggtacagcatcttagagagtctctgcatccatagacttgagggccctgtcaggatcagggaagctgccatgtgtggcctggttgagtgtgagagctgcctagagacttccataaaagttgttagagaaaattgttgatagtgcctacatagcagattaacttaaactgttttcattcaggcccacacattttaataaagtagaaaatatgcttcacagataagggaaatcaaacaggctccttttttctggaggagagaaatgtcaaaaagaattaaatttgaaataactttacagaactggaaattagcttttgattaaaagtagcttttggtatatgacaagtattcactgagaattttgtagcgagttatatactttaagaaataacccccagaaacttgcatcatggtgtaaacagcttgaataaacaagtgcttaaccagtgcctttagagctgcctgggaaacagccagaataccagggcaagctgcattttggaactggtttaatttagtagccttgccacaggcttagtgtgatctgcttttggtggcttgatcttccccactaagtcattttctggatttgttacacctagaactgttaggaaattacaggcttgggctgatcattaacatactgtactctacaaggcacacgttacctttcaaagcagatgaaattctaacctgaattctggcaagattctttgatcatttgcttcctttacttttacttttatttatgcatatttccctcctccttgagtttctgtaccaacacaaacctctttttcccccagccagaaaaaaaatattattatagataataatctttttataacttttccattggggaatgatttttagtatgtaaatatatcactgcatattctcagaaatgaaagacattcttaggaatttacagtgtactttataataatttcagaagaaaatatttataaatgtcaattcctaatgttttagcatggtttatgtttcatatgttgaattctttatcataaggaaagaattggagtcttttaggtcagaaccagatactaattttgtggactagttacatctgaaagttgactgctttgctaagcacaaaaatctaagggctttaactctaatattaaggtggttacctacagccgtaggttttgaaagatgtatggttccagccgggcgccgtggctctaccctgtaatcccagcactttggaaggccgaggcgggcggatcacgaggtcaggatatcgagaccatcctggctaacacggtgaaaccccatctctactaaaaatacaaaaaaaaaaaaaaaaaaaaaattagccaggcatggtggcaggtgcctgtagttccagctactcgggaggctgtggcaggagaatggtgtgaacgtgggaggcggagcttgcagtgagccaagatcgagcggctgcactccagcctgggcaacagagcaagactccatctaaaaaaaaaggaagttgtatgctttcaactcccaaaaccaatgttcatttgatttggacatttaactggctattaataacataatggtgttgaaacagaacgtgattgttaagtctcaactctcttctttgagtctcacccatcttatattttggtaagctaataatggcaacagttaacatttttttgcataaagcttctcatgtatgttccagaagcataatttcttacatttaaatgataatattgacgatctattatgctgttatttaaataaaatctttatgtaaatcatacatttgtgcataattttggagtattttaaactactattgtacaacgtgatagtgtagggaaaaaaatcttaagttggtcgtttacaacttcagtgtccttaaatagagcaggtggattataatcaatatttgtataatttgttttttgttttcttccttctgtgtatgactaaataatacttttaaaaatgatgatctcttgtttggaattttttaaaaaattgtatgacgatggattgttcatttataatgtgtgtgttgtccttgggaaacaagatgacagtgatacatttttaagaaaattaaaggaaaagagaaaccagaagaaccagaaactattgtttataaagtatctaatgcattctttttaaactctaccaactgtatgtaattgtttaatatatacttgcaaagatttttagggctaaaattgacatcagttcaaagttgactcttattaccttcttcctggtgtgaagacgagcacatcccagctcctcttgaccaaggcagtgaacagcctcttttccaacccctggatcaccaagccacaagtttgccttcaaggggtgagcgtgcattgtcccaggtggtctgctcttcccacctgcatggcttcctgcagttatgtcacttcttgcaaatgttctgaagactagcccaggagtgtccagccttcagccctgagcatgagcaagcagcaggaattgccacctggtgctgattctctgtgctctgaaaagcatggagccctactgtccttttaatgcatcgagtatcattgcttttctttctcttttctgaattttgaaatatgttctaaaaacagatagcaaaacaacttttttcatatgtaggcaaattcaggagttccaaagcaactgaaattgggggtttgatgccttttgccaaggagattttagaaatcaagtcctcttccccactcttgaggtatagagttttaggttatctgaaaatcaaagcatacattagtgaccttcttttggtatacattgtgtaacatcagatagcctaagttctggttccaagagagcacttagttgctatttgattataagcaagtcattaaccaatcagtaacagggagacagtaattcctgccctatttgcctgtggggttggcgtgagaatagaaacaccaaaaatattaatgtcttcgtcatgctggaaagctttgtaggaaaataatgtggtagcataattttacagttcctcttttaggtcattttatctctaacccattcataggtttaagaacttagaataactgaattaaaatagttgaaattattaatcattgtctctgctgagaagaaatttgatgcatttgtatattttctacacaaggaattagggcaaaagaattaatttcggtccttaataattaaaaaattaaaattttggtagttgacatattgacatctgtttgcctatgacattgcccgatttaagcaccaaagcggggagaaagtctaaatgtgttaaaacaaatgaaagtttatttttaaaaaatccagtaagttagttatctcccgatttttcaagctacttttcagtgtctgcatgctaataaaatttctgatttttttcctgaagtttaataataatgctgtgcagcttgcatttccattctggaccagttcccttctccctctccttctcccatccaagctcctgaatccaccaacctactgaaatgtattcctgacaatagtagatgcactttaagacttgtatacataataactgaagcatttgaatgtaagtggtttattgtaaagttctatcctttagtataagataagcacatgaaataattcattaaattttttattttcctattttatagattttccttatatatattataaacctccagagaaaaaggaagataagtaaatttaaaataaaaacaccaaagttttatttctaggttcttttatcaacttttaagatttatttgagacagtatgatcaatgacttcattttgttctgcttattattgtaggagtatttactataatttggaagtaatttatttttgaatttattgcttaattgaatgatctccaatagattgtgataatgaacacagcatttatagaaagcagcacatattaacttacttaatatggcactaggtcaatgagaaaagaaggtaacataattgaagacaagaaactcttaagaaaactgaggacaaaaaggcttctcaccaggatgccagatgcatttaatcttttgaagctctgtactttaggaaaagtctgatatttggcaaattttgataaacatggatgactatggaatcctattttatagtatctgaagtggctttcataagggtcattgtgaagtttttaggagacacctgcctgtggcagatgggacaatgatggcagtcactagggatattaacaccagtcagctgtcagggaatatcatccagaccatcagcagctggtagagtacagctttctcaattgctttccatgttttggatacttatatgcccgttaataacaggtaaaatagccagtacatcatttccacatttacccattgaatgttgcatgttttcttcctttcacatattcatacagtccagatttttttttggactcatgacagcacattggcttttctttcctttcagtttcatgattcttaaccccaaagtgcttttgccatgggaacggaaggataaatttcggtcgaagccattctctaaaaccaccagcagctccagtccagattatgaatactaccatagcaatcctaaggggccctttattggcccagactggagccaaattgtagaagagctgccccaactgggcttcaggtttagttcagggacatagtgtctgaagaaatttccatcagcataaatactccttgtttatgagctgcctgaaactgtaaacaccgaatccattcccatcaggaactcacaaaagtttctgttatgctttgaaaataaacctagggatacttaactgacatgtaaagaaaaatccatcagtatccttttctcgagatataggttttgattttactgtgttatgttgtggttttgttctgtttttgtttagtgcagaaaaatacttaaaacacaaagcctttctctaacaccatatttggttttaaatgctatttgctataatatcaagaagatttatcaaagacaggtgtgactctgcaggaccatattaggaacagtcattaactcctcttagaagatgagaaaagtttccctctcatttttagtaaattctgaaatacaaagtagaagaatatgggaagggtagaaaatttctcagtcattcttccttgatttttgcttcaattaacagagggagaaaacatttttgatactgtaatctgcatggcgctttctgtgaggaaattttttttgaaatatttaaaatgtgattttgttttaaaaacccttaactagtcaagagacaataaagtagaaaattgaagaacgcataggagatgacaaaagtatttggtttatttatttaacctttccgggatttgcccagctcggggtctgcttacagttgcattcagggcagataaaagacctacttggaaaatcagtaagatatgaaaatttttttagatgtaataattatttggtggttttaaaacataatggaacttggtgatttagttaaatgaaatatacagatttctaataaatgagcagatcagattgaaatagattagatttgaaaacaattttgtcactagacatattatctatattttttattcaatgacatggattaatagataattaaattatgctaaatgggtacttatgctggtggttccagacaaacatgtggtcacatttctttttaatgaagcatatattttgggcattactatttcaatgtttatttgtcattatgagttttatgttcacttgaggcagtgtttaatttaggttaaaaccttttcataatgtaaaatttgttgattcatttcatattgatacttaaaccaataaacctgaaatacatgacagtctattacattttgtccattagtgtttccatatgccttttttaactgcggaataaatgaaaatatgttggtaggttttttaaagttcattttgtgacttgaatgcattactaaagtaggaaactgaagtttcttctttaatctgaaatcatataaaatctaccagattgaacaagaaaaactacaatattgatcactcttaatttatttcgttcttatcctctgaaaatatagcctatgtagccttcctttgggaaggtcaaagcagtcaaatgttttaaaatctgtatacttcctgtaaagtaaaatattctcaaagtccaagccttaaggaggccaatgccttatccatttaaagtaaaatattctcatgtaatatgttctttaaacagagaaaggaagacattgaacgaatagggttacattgtcaggattggatctagcaatagaacccaaatattttgagaatattggcaaacagttgttagctgatagagcatctctgcccatgaggacgttagtatgctgctgtttctagggttgataaggtaggcacctgttgttgagaattttcctaactggcctttataaacagagatccataaaggtcatggcgactcctggttgcccctagtgtaacgtaccttcaaattaatattgcatgaacaggatctatctcttatgtaaatgacagttactgtagcttgacctatttttctctttcattttttaatatagaaaagaattttagatggcttacattagtgctgaggttttgtaatttttctgcttcaacccacattgttttcagatctaaatgagtgtggcctgaagccccggccctgtaagcacaggtgcatgaacacttacggcagctacaagtgctactgtctcaacggatatatgctcatgccggatggttcctgctcaagtatgtcaagaatcttaactgttttataagtgctttgggcttgtttctgttgtgctctgagagcttgcttttgtgaaaatggcctccggggttctcctaaacaagatgtgtgcgtgtgtttatacttttgcctgaggaattgaaaatcaaaataagaggcaccattttcgatgtataatactcttctatcacgggtgccaatattaaattgattaggaaatggtgtttagaataagaattacaaaactaagtatgttttctaattttttttttaaacatgtttacccatgtcttctatctgggcatagaagaatgattccaggctaaaaaaaaaaaaaaaagaacactactgactatttagggactgctcagacagaatccatcaggtctgttttgtaattttaaatcattcataaatattttcttcatttttatatttcattataaaagcctttaggcttttatagaattttagactctaataatagtctaagacttctaaaaaacaatttcaaataaaaaataaatgaatatgataccagaaaagtaggattcatgtttataaggaagaaatgcatgttttcaccatcatttggatgtaaaaaatggactatgccctaaaattctctataggctgactcctgaattgtggtattcatatgatatctgacaattaatgacttgatttttatttttactgaattatcatttaactgagttgcataaaataaagttagctaattttatttaacattgcataagtatagcatggaactttttggaattaggtgaatacatgtttaacattgtgcaactcaatgggaaatctgctgttcccctagagaaatttcatgggcatttgagacagttacttggatgattagttaagaatagcgtttagcttgagtaatctggaaaaatacctcaattcttcactttccttggccactggaaaaatttccagataatctatatatgatagttttatatttgtcttttaatgctttctttccttcccccttttattttctttagatgtttgatagttaaggcctctttgtcttcattgttgttcagtgtcactgatttcaggacaagtgaaaaaacatagctatttccattacagattttgttttctacctgtctgagtcagccagtcactctctttccaggtgccctgacctgctccatggcaaactgtcagtatggctgtgatgttgttaaaggacaaatacggtgccagtgcccatcccctggcctgcagctggctcctgatgggaggacctgtgtaggtgagttgtaaaatcaagcatctctgtcagcagcctctgtaggataaagggagaaagtgaaaggtgatgggaataaggaaaaaaaaggcaattacttacatcagataattagctatcgttcagaagatatcagatgtctcagaagaggacatctctgtgaatggataatgggagcgttgttttttaaaaaatgagaaataggaggaggcctcaggcagagggaaccctatgtgcaaagacactgcagttcagaggagcacaatgtttagggaaacgagaagagctcagtattcctagaatgtaagcggcaagggtgagcaatgagtgatgaagctgaatagctagattgtatgtgttgttcttcaggcctcagatttttttctggtaaattaggaaggcagtgtaggattgagagtctggactttggttttaaacctggctcttccatgtactagatatgtaaccttaggcaagagactttgttgctttgagcttgggtcttcttatctttaaaatggaaataataccacatagaactggtaggaagattgaatgagatcatggatgcaaagagcttagcacaatacctagcatgtaataagccttgaatgaatggaagtgtttggtgattagagttatttactgagtaatttctatactccagacactgtgctgagtgctaggatatatagcagtggcctaagcacacaagattttgatccccacaaagctgacatgctaatgggggagacagaaaagaaacaaataccccataaaattacagacaatgccaagtgttaacatgaggtactgagagaaaaacagaatgtgtctattagccttaaggtaagacctgtatcattagccatgtgaagaaacagccaagcagctgaagacattgcagggcactgcggtgagagagaggttggcctgtgtgaggtttttcaaggaagaaggtccatgtagctcaagtacagggtgtgagtatgaggggtggtggctggagatataatgggtgaagtaggtgagggtgatttgttgcagggccttcaaggacacaggggaggaatgtggatttaattcaaagtgcaagtagaaatagttaaaagattttgagcacagtaatgatttgattgtatgttttaatggaatcattttgacagttgggttggatatgctttggagggggtaagtaacagcaaaaggaactgttttgaggcttttgtaacagtctaacccaagagatggtggcttcaaatagggtagtggtggtggattaagagaaaagtagacagattcaaatacttttttttagaggtagaattaactggacttgatgatatgggagttaaaggaaagagggttgtttctaattcaagaatgactcatgtttctagtttaagcaacttggtagatacaggtgcagtatgtgctaatatatagagtgcaagaaaataataacttggcttagaaggctgggttgaaatttggatatgtggaatttatgttgcctgtagggacaaccagctagataccgtttatgatgagccactatatgctaggcaaccatttgtagtcagttatttattttgaaacccactctgtcttaacatacccttgctcttcctaaaatgctattgacttatgtttctagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatggtaatgaaacccaaccattgctttgtgttgtttcttcctagagcactgaaaggtctcgtaattgtggtgatggctggaatgtcaggggcaggggagagtactggcgttaagttaaaccaacagacatccagtttaaccactggtagttctcagtctacatgtagtttatttcttctgtttatctgccaatattatgtagatcatcacattgccaaaaaaaatcatttttgaaactgtatatattttttatgtcatcatatttatctcctaaataagtctcttcttttcctactttctgatgcagacatagacgaatgctcacttggtcagtatcagtgcagcagctttgctcgatgttataacatacgtgggtcctacaagtgcaaatgtaaagaaggataccagggtgatggactgacttgtgtgtgtgagtagcacttgtctctcagctttaaattctagcaggaaatacaggattacacaaaggccattgctagggaaaataaggaataagattatcaaagaagtataattgtcataattggttatatttgtctttgatttccacaaacaataaaatcacttgctcaggtacttgtaaaaactaaggactcagtaatacactataatcttaagagtattttaatctcttcactgaaatctctcaatattttctttttagctaaaaagaaattattgagtcctccctgagaatttgcttttgttaaaattagaaatcatgtttgccattagcgttagattttgatggtgggataatctggatatattctacatttttttccctctgttttattgctcctaactctgctattaaaaaatcattcccggccaggcacagtggctcatgcctgtaatcctagcactttcggaggccatagcagcaggattgtttgagggtaggagttcaagagcagcctgggcaacataatgagaccctgtctctacaaaaaaaaatttagaaattagccagctgcagtgcgcatacctgtagtcccagctactcaggaggatgaggtgctaggatcacttgagcctgggatcttaagactgccatgagcccagtgagctctgaccatgccactgcactccagcttgggcaagagagcgagacctgtctcaaaagaaaaaaaaagccattcccatatttatttcctctacattcagaactgttttgcttttaaaatttttataagttttatttggagtagtggttatgtaatagataaacatgaaaaaaacccaaaagtcataatttaacatacatttcatgtaacagaagataattttttaaatttcctccgtaaaatatttactgaaaaccatggtgcataaaatcatgaggattaaagggtttttaaagagtcatgtagtcattcccagtctggaatgtatcattcaggcagattaaatattgattctttttgatgaagattatcaaggaaaaagatttcacagatgatctttgcaacctctgaaaatgtctatttaaaagcagttgtatctatcagtaaagggaaataaaaaccgaccataaaacaatatgtagaacatttactcaagctgtatttatgcaaattgaatttatataaagtgtggataagaaaagtatttgtctttagacaattctgaacacaattttataatatacacgtagcatagggatacaacgtagattctaactatgcatttcttatattaaaaaaacttagaatgtctctgcattttaaaaattctcattggttgttgtctgtttgcactgcacaaatatttaaaatgtttttatgttgcaaataatacatataaattatttaaacacaccaatatatttgttacatacatccaaaggatgaatatatgaatatatatgtgtgtgtctgtgtgtgtgtatatatatatatatatatatacacacatatatatttgttatttggaaaatagtatgacttacagtaggtaatattctaaatgtgaaaaatgataccagttgtcattagatgtttttatgtctgtcagtgtaatgcttcactttttagggaggaatggttacatactgatttaagtctttgactctttcagatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcagtaagtctaataaatgttagcacattttcaataggctctttataatgacttttcaaccacaggccatgccttgaataagaatgaaactcgtaagaagaactagctatgtaaagtcgtatgtccctattgacaaatattataaagagctacataaagagtcagtctaattgggcaagtaagaaagaatgtatgtagcaatggaaggaatattcacaaagtcatatggtagatgacagctcttagccagtatgggaattctgacatagttggatttacttgaaaactctcagaggtgggaacttaactgtattccatgctatgttacttttaatctaacccttcattcattcagtcagtgaacatttttgaatgtctttagagtgtcaagaaggccttgtattagttattgggttcatgtaaagataaaacagaaaaggtcacagtctggtgggaaagatggttactcagaagataccagtggtagtatgttagtgaaagagatctgtgtaggacactatgagaggagaatgaagggatacctcgtcagtctttgggtagggaatattcagggagggcttcccgagtgaaacggagcaaagtggatgaggaaaggaagatattatagttaacagggacagcccaacaaatgcaaagaagtaggaagcagtgtaataggcagtagactgccagtaaattggagggtcatgtcagggacagatgagagaagctggacagctaccccttggattgctgtaaactgatagttagacctacactggggctggattagatcaaagactcccagattcttagcaggtgactaggtaaagggtagcaccaccaatggagatagaggattcaggaagagaagcaagttctgaaggaggaaaaggttgttaatttattaccagaccaaaatttgcatgttataactttcatctgttcctcatatttatctgcttgtcctgtgtcacttcgcttattcttaattacctttgcattcactcttcctgtctcctcctttatacattaccagtttgttttgttccttttctcattcctctatgatgaagctaaagtttgtgccttttatattgaatacctttataactttttatcaggtgaaaaaaatactgacatttattattctttaaaggggaaaattgggaggctgaggcagaccgatcgcttgagcctaggaggttgaggctgcagtaagctgtgactgtgccactgcactgcagcctgggtgacagggtgggacaccatctcaaaaaaatgaataaataaataaactaataaaggggatatcagagccgcattttgcttgtatgtgactctcaattaaattttctcctctgggtaattgtccatttaaagaaagatggaaattctctaattctgatatagtcatgtatgttttggataatcaatataatttttaggggaattagatggtagctctcaaaatatacattttatatgtgcataactattttctgaaatttatgtttttgtaattttctcctcaccccctctctccatctcagatactgtctttttctccctattactctcctttttaaattctcatcattgtgatcatacaatgggatttttaatttatgagtgcttaagtaattatggtatttacattattttgctgccttaggataacagggaaatttggctatttaatgtaagatgatacgctaaatatttttttcattatgatgaaagaatacatctttctgagaattttaaaaaatcctttctctttttaaaatgtttctctttatttccagtattcctctctatgccaatacatatatgaattaaaaatgacattgaagttcaccaataaaatttagtgcaataaaattggggaaatacagagttccaatgatgtttgggagcattcattataagagagtgtgatcttaaagacatgctctgggaaagcattgccttgatcaaatgccaaggctgttgcatgccacagatagcattgctgcctttagaaactcctgccaaaaattaaattccactctcatttcatcttcagcgatagctgcttattaagtctagcatgtgtgagaatgctttagatgctttttgacttgctgtcttgtggttatagcatatattctaaataaggcaaaggctctaagtttttaattcaggacaaataaccagtgtctattcactgtgaaaacattaaggaaccttagcactatttcagttcaacaccatttctttactgaatattttcttcacttctggcataacttcttaaatcatccttattctccgagacaggtctgagaatagaatttagctcacctcatttcataaatttttaggtgatgttaattatggccactatttggcagtctccttcaaatagccctccactttgtgtttttctttacattgaaagatatttttaaattgatttttaattgacagataataacaatatatttatggggtatgaaagatttcttttaatggaagaggttgtgaaagagagcttttccttataatgtatgtgcgttgttgccctgagaaaagactgtaaagatattctaaaagaaaatcaaggaagaaaaatattataacaagaacacatcttcagcccagacctctcccccaaactctagacctggatgtcagctgactgcttaacctatccagttggatgaaaatagacgtctcaaactcaacatgtatagaattgttccttttcttcccttaaacatcctctactctcagcctttcttatcccaggtaatgggacctctatcacctgttgctaaggtctaataatgtggattcatccttaattactcttcatacatacagtcaatatgtaaggaaatcctgttagctgtaccttcaaattatatttaagtgtgaccttttctcaccaactccagtgctaccaccctggcccaagccatctctcccctggaatacaggcccaaaatcctttatccaaataacttatggaatatagcattttttagattttagaaaatcagtaaggtacacatactatatagtacacactgaagtagtgaaacatactgattttcctctagtgcttttactgtgaacatatcaatgttaaggaaaggaaaatgatattaactcagagatgatgtctcacagcatatatttactagcttgcacaaattttttaatgttagcaagatttaaggcaaattttttacttatattttaattggatcctatgatgattattaaagaaaaaagtagttatctctagaaagtataaattgagctcttggcaaatgtgagcaaaaccagaaatcagatttttttaaagttacgtgtacatttgtctatagagttataattaaaagtattgtgctcatagccagtctgtgatctggggcatattattatatcttcctatgccttaaaacaatgtttcctgtaagtataaacaaagtaccattgacactgcagtttttgtccatttgctacttccaaaagaaaggggtacaaaacagaaaagttatttaaactttaagcagttggttagatatggtagttataatgagctttggtattttaatatggggcttaaaaattttcatctaaaccaacattaattatctaagtgtgatatccttaggaggtctttgttaagtcctcccaattatatccagcatctccaaaggtgactgaagtcccttctaataactcatctatcaggggaacccgcccccaatattttaacataggttctttctattttccataagtgtccgctggctgagaaataaagagaaagagtacgaagagaggaattttacagctgggtctacggggatgacatcacatatcagtaggaccgtgatgcctacctgacctgcaaaaccagcaagttttattaaggatttcaaaagggtagggggtacaagaacagggagtgggtcgcaagatcacatgcttcaaagggcaaaaaggagaacaaagatcacatgcttctgaggaaacaggacaagggcaaaatcacaaactcctgataagggtccagcaaagatcacaaggcaaagggcaaaagcagaattactgataagggtctatgtttagtggtgcacgtattgtcttgataaacatcttaaacaacagaaaacaggttcgagagcagagaactggtctgacctcaaacctaccaaggtggagtttcccaatcctagtaagcctgagggtactgcaagagaccagggcatatttcagtcattatctcaaccgcatgagacagacactcccagagcagctgtttatagacctccaccaggaatgcattcctttcccagggtattaattattattattccttgctaggaaaagaatttagcaatattatcctacttgcacatctgtttataggctctttgcaagaagaaaaatatggctgtattttgcctgatcccgcaggcagtcagaccttatggttgtcttcccttgttccctaaaatcgctgttattgtgttctttttcaaggtgtactgatttcatattgttcaaacacacgttttacaaccaatttgtacagttaacacaattatagtggtcctgaggtgacatacatcctcagtttaagaagataatacgattaagagattaaagtaagactggtataagaaattataagagtattatttgggaactgataaatgtccatgaaatcttcacaatttatgttcctctgctgcagctccagctggtccctccattcggggtccctgacttcccacaacactcatcccaccactggagcatttttccttatatttaacctaaatttatgaaactacagtttatgcatttttaatattgtcagatactcagggttaatggacacagttgttcattgtctccagatcccatactccatgtactcaaagacactttcaggagatgactcactcttcgctgggcccaataatttatattttattaatcttttcttagaaatgctttttttcaacccacttagcaatcttgttgactggtcctttgaacattctttattttccaaatctgtcacaaatgatcgagtcaaagatatataatagtcaaatctgacccaatactgatcacgggggggtttcttttaacatgttttgtaatctaaatcatttctctttgttgcaaagtagagatttatgggcagctatttaatctccagatgttttttcctcaaatggccacatagtgggcagtcaaaaatatttgttgaatggaatgaaatggaattttatattggatttaatttttttcattctaagtaatccttcatatgcttaactagctaaattttacttgttggttctgatattccttccccaaataatcaaagttaattcagattatggttttttttcttatcctgatacagcttaatatagccattgaaaatattctctagaaaattctaagtctaatatacttctaaattttaagcatgacactgaaaaatagtgaaaagcatagaaaaggaatatgaaaatagcattgaaacatttggaattaaggggttttaaccactactaaagatagaatatactgaaccagaaaacctagtcttgatttctacctctatttatgaggtacatgactttggactagtatgagtatttatgaggtacatcactttggaagagttactgtgctttccacctcaattttttcatctgtaaaattgagggaatattcccagctatcctttctcactgagtagcttcaaagatcagagataagggatctagtgtttgtgaattctgagttactatgaaatgtaaaagattaatgtgttttgtttatcactgtaaataaccttgatggggagaacttatgtgatttaaggttgcaactttttatgtgtgatgtgaaatattaaacttatttttaaaataatttttttgagacagagtctcactctgtcacccaggctgctgcagcttcaatctctcaggctcaagcaatcctcctgcctcagcctcccaagtagctgggtggctatttatttttattttttgtggatacaaattcttactgtgttgcccaggctggtctccaactcctgagctcaaggaatcctcccaccttggcctccccaagtgctgggattctaggcatgaaccactgcacccagcctaaaaacaattttagcttgagggaccctaggtttttttaggttatatgactagaaatataataagatgtatttacagggctaatccggtgggcatgatttgagcaacactaaagttatctgatgtagcgtaaaattcttgttgtttcattaatgagacagacttgtgcttctcaaagtgtgttttatagagcattatttctctgaaatattacacagttgtatgtgttaaaaagttcttaggtcaaatacatttaagaactcctaggtttagctaagttaaataggtttcttaactgtaggacttctcaatactccaatgtgctaacaatattgcaaatctctaagagaggcatgtaatgtatcttttcccaagttgttttaaccatgggattatttgaatcttgggattagagtttactggaatcaactttaggtcaggctgggctaaactaggaagtatggagaccatactccacaaaacccagtatccctcactagttagctctcgttgcctggtttttgagactaatgggttgatcttggatttaggaatgagggttggggagggcagaaaggtgctgcacaaacttagccagaaaagcagctataagtggtggtatgcctgtatggacaccataggtttgctgcaggggattgttaaaaagccacttttcaaagacaaaactctggtgtcacaggggtaggagcaatcccagggcaaagaaactcagaaaaactttctgcagaacccaaagtaaaggaagttagggggacatgctttctgttctagcaatatataatgaaatcttatataactattaaacatgttttatggaaaatatttaataattttggaaaatacccatgttacaaaaatgttacctgaaaagtacaaagctgtacctgccatttgactccaattagatataaaatacatgtctgcatatgtctggatgtgtgtaaaagtctgaaagaaaaaagaccaaaatagtaaccatgagtatatcctgtttatgatattttgggcgattttcattgtctttttgttgtctttatccagtaatttttaaactgttcaactgtactatcgttgataacagtaattcattatatcattaattccttcagagagggggcagagtaacagaaccccactcttctcagcaggaaagtgaggattctgattcttaatcatgtttattttattttggacatactgagttttaaaaattcattgaaggttttattaacttctatttttaacctttcagattttcctttacaattgaatgtgatagctatgtccaattttagctaggaaatttgtattacgagagggaatataacatcacttggaccaggaaacagattttttttccccagtgttgtcagaagcccattttaactaaaataacataggatgtttattaactaaaataacatagttattttatgcttatcttaagatgtagattcctaatccttatgacacatttactaaatcagacttactagggaaagtatctctcagtctttatctttatttatttattatttatttatttattttttgagacacaggctcactcttttacccagactggagtgcagtggcacaatcttggctcactgcaacctaagtgattattgtgcctcagtctcctgagtagctgggattacaggcgtgcaccaccacacccagctaattttttttgtaattttaatagagacagggattcacatctgagtaggcacacttagtccccaacactcaaccttttattcaaccagcggtgagctggatgtgaacatgacagacccagtagggttccaatgcctgacaacctgcacctgtcaggaagagccccctcctttcctgctcccctgcaacacatggttattttaatagagacagggtttcaccatgttgcccaggctggtcttgaatttctggcctcaagcgatctgcctgcctcagccaccgaaagtgctgcgattacaggcgtgaggcactgtgcctggctgttctcagtctttaatgtgtacacaaattacaaggggatctcgttaaattgaagactgactgagtgtgtctggagtaggaccagagactctgcatttctaacaaacacaggtaatgtttctgatctgcagtccccactttggatagcagggctctttctaaagcataatggcagctccaacccagcagaaccatattctggatggagtcagaactagccaaatgtaggctatttaaaatatagcaattgtgcctaggcatgtgtccacctgactcatgtaaaataaaaagaaaaggcgttaatagaagccagattatagaacataatgttattaatatgtatcaggtgctcttatgagtggccatatcagagaaccagcctcattgttgctgttattacgcaacatgagactgtgctgcaattccaagtaccaagcagtaagaagaaaattgttttcttttactgattgctgcgtgttgtcctgaggtttttcccctcatctctcttctacagattttacagagtctgtggctagttcagtcacattgttcttagtcatggaaatattatggtctttctgattctgtgtagtgataagtaaaaagattgtttctgctgaggggtgaaaaggtcttcaaagtagtttgctttcttgtaaacagtaagacctgcagagaccctgagaagatgcctgatatctccttgaaaattaaatttctgctagtgttttgaaggagcgaattgtcacttctcacaggttaggatctgctgctgtgaattctgaaagttttcaagatttttgatttatattttaattagatcctatggtagctagtaaagaaaatatcattctctccaaaacgtataaatgggcccttggtgattgtgaccaaagtcagaagtcagatttttttttgaagttacatgcacatttgtcaatagagttataatttacaagtattgtcctcattgccagtctgtaatttggggcgtatcattaaattttcctgtgcctttgttttcttatctgtaagtcagggatagtaatagtatctacctcattgggctgttgtgagaattaggtgcagaggtacctataaaacttttactgtagtgcttggcatgtagtaataacttaatacatattagctattactgctactattgatgttgaattcatttatatagtaatgataacatttcctacttaattcataaaaagacagcctatgctgttttcttgttctgagtttatatgtttctcatgctttttattatggttcattacaattttaatgttatttttaactaactagatccttttgaaacaaattggtttgcaagtgtgagctgttaggtgcacagagaaaaatgaaaatagaaacttgcgattttattctaggcttgttaccaaatatttagaatactgtgttttatttaggtgtttatagtctcattagacagttgtgattttaaaatagagaccacatcatctcaacttctttactgtgaaaataatgacaatagtcttttcagagatgaatctgtctagatgggaaatttacatgattgatctgatgagtgcatccagcctgggcagcagagcgagactctatctccaaaataaaataaaataaacaaaataatctgacaagtagtttccccagaaaatctgatttagtaaatgtaccaaaaggatttagaaatctacatcataaataaacattctatgttattttagttcagaccctattttaattcagacttcctatgggataaaaacttccattctttctttaaatagattcttttggcttgagtgcatttacacctgtccccaacagctggtgggcttctgctcaccctagacggtgttcatgctgcactcagtccaagcagcccttatcagagagtcttcttaccacttgcattctggtgcgaaggactcattcctggcagagcctaaccttcatgggaaccattggcttagaagagaggagaaggggaggccgaggcaggtggatcactaggtcaggagttcaagaccagcctggccaacatggtgaaaccctgtctctactaaaaatataaaaattagccaggggtggtggtgcacacctggaatcccagctactcgagaggctgagacaggagaattgcttgaacccgggaggcagagattgtagtgagccaagatcgtgcctctgcactccagcctgggtgacacagcaagactctgtctcaaaagaaaaaaaattatcctgtctccgggcagtgtctctgagtctttctaaaactttattaaaagttcctacaatacataaaggagaaataggtatgtcacaaaaattgggctcattgttgattagcaatgtctatgctccacctttcaccagagatttaacttttttgccaattttgctctttactgtcagcccaaaggtgtctgtggaactttgtagattcttcctatgggatgaaagctttgacaaacaaggtcttatttctgtgagtccaacaacccttttcttttggcttataatgaatagatggctaaaacttttctctaacatggttaaagaaatttcagaaactaatttccagcccttttatttgcttttctctctgatcacttaaaattgtgatgcatatgtcctgcatctgtagagagaatagggggagagagagacagggagaggaggagagaccatctcataaaactcttgtcattcatccctacgctccaatctgtgtctctaaaagcctctaggttttgccaccagaaacagccttcagaatattggaataattacatatgtaccattctcttcaatgaactaaactcctaagcatagaagtaatttaagacagtgttatttttaatcatttagtccaacaacaaatgccagaactggcctgggtaatgccataggaaccaccttgtttcctatgaaacaggaagagaatttgcaaacctacctttactaaataatgcttacattttgctatagttactcttggcaagaagttgagcagtgggaggtgtatatgataatatttacatttacttctctgtgcttactgttaatgttttctgggtaaaaatatgcaattgactatttgggaaacttcatttgtgaacacaggttatatatgatcacatccctggggaaaatacatatttagtagaaagtgcctggccagcatttcttacaagaactttcctgctcctttttgtggctgattttacccctgactccagggcccagtagccattagaaagtactgtgctcctcagcccagtccaaccatgcctttatccagctgtcacttgcttcagtacctgtacattccctttcttttagtttatgcagaaggctgtaagaagcaacaggcaagacatatcttttggtgggtaaaacatggaccaatggtataaagattctggggacattttctaaaaatatatgaacattcatggttgatgttaattttagtcataattcccctatgacacccactctcaccttcttcctgttcattctccaagctactaccagaatggtcatttcagcatgcaaacctgatcttggcaatcctctgttaatccttcagaggccgccagtttccaccaggataacgtccaaaatatttacaaggctttaaaagctcctgcacactctgcctctatctccaattccatttgatgcccttcctcctgcaccttcttgctgcctccctccccctgtaaggtctacagcaattctgatgtttcagtcccctctcttttcattctccagagccatagctcatagtacttcttcttatgtcatagagaaagcatcacttctcagagatttttatgacgtgtatcctccccagcctagcttagccagtccctcactccccactcccgtactcactagcatcctctgcttctttaaagcacacattacctggggaaattgttaaaaatctgccttcacttctagaatgtagatcccatgaaggcaagagtatgcccaatgctttataacaagctcttagcccatgctttgtatagctgatgctcagtttcttgactgactgcataaatgagtggatggagtagaaggaggcaggatgcatggacagatggtggaggaattgtattgctagcacttctctgattcttttttagtttctaaatttataccattctaattctaagaattaatggttcaactgcagagaatagcaggtatgcatttgtttttatgaaatatatatattgtgtatttaagttgaatattagccaaagtatcaagcagggaaagaacaattagaaaaatcatgtaccaatgtctatcctggttatagttcatttttgggcaaggctagtcattcattttaattaacattttctgcattgatcaaaatagctcccttgaaatcaaagaaaagtgtttgaatttcacaaacatatttcaatttcatagccttgcgttcaacaagtatcaagcctattctaagttctctttgagtaaccaaaatacaaataacagacatataattgctatttatatgtgatctaacagaaccctcttttatttagatgtcttaggtaagttttttattcatatttatattttttctttttacaatcctaaaaacatagaattacaaaaaaagtgaaccaatacaaatgaaaaaaaaaatttcatttctaatacttagattaccagtattagcatattggcatattggtgtatttatccctctttagtcctttttttttggtttgtttttcttgtacatgattgtgataataacataatactgcttgaatgatttgttctgctacttatttcacttaatattttcacataaactctaaagtgtatcgggggtgggtagttttttttctcttgaaacttcagtgggatgctcttagtaatcccatactggtatgtgtgaggaaggaaaattagttaaataatttggtatggttatagagtagagcacacaaaattgtaagaaccaatagcttctgagcacttctggtctctaaattccttggaatgtttcccagtggattgtaatgaaggtatacatgatcatctgctgctaaattaaatggttcttagaaaccaagaaccatttaatttaatattaataatttatattaataaaccatctgacattttacaagttgttacttgactaattctttgtgttgccatcttctaactgtatgatctaatctcttcctttctcttcaacctcatcccatgccgctttcttcatttctcaacatcctccagccattgtgaactcctttctttaaattttccaagcactttctttgtgcttgctgcctgaaaccctccctcttccccaaccccaatgctatgctttttgcttggaaagtttcattcttcccctttcagtttaaactgtgcttcctcagagaggacctcttgatctccctttttataaaacaggctcccggtgccaggaaacctttacatcaacactcgatttgccatttgatagtccttcatctgggaggaaaaaaaaagacggaggggagcttgaaaaactgtcataatgtccctggaatatggtacttttaagagttgagcctattccattttggagatgatttatataagttacaacaaaagaaggggacaaaaacatgattgttctatggagtttttataactttctgtcacaagaaagcacgcttgtctacaattttgtaatatttctagtaaataaaagaggcactccccgtctcagagcaccaaataaggaaagtgtaattggatgtcattgctgtcagtcagctgggctataaaagagagagtggggttgcctcatcccctgggtatccacagtcagctgtgtccctagagcttcttttctttcattgctgcccagctgggtatattgcaagtatggattataagaggggaagggacttcactgttttaacgtttgaaacaaaaaggaaaaaactcagaagtagtaagctaaaaacaacttgtgcaaacgttctgggattattacttaattttaagaatttttgctaaaaacaataggaacatcgttgaaaaaagaacccctttgagtgatgactgtttcatagtgttctacatctcctactccctgccttataaaaataaagctaattaattgaagttctggcaaagagaagggagtattccttggcctttgaccaagaattcccctcaccaccatgaacattcccacgcatttccccaccagttactctccatgatgtcttccttcctaactcttaccaaaatctcaaattacagcactcgtttatctccatatttaaagtctgcttctcccattagaattcaagccatgtaagatccagaccctcagtcttgtctaccccgttcaccctgtctccttagtgcccgccacagtggtcggcatctgcttggccatcaaatatacactgattgaataaataaatcaatgatttaaagaaatcaattatttttttaaagtagattcttatgctttgtcccacttgtgtcctttgaggaaaagtgtgaaatactacctggggttctaacaggatctttgcattcacttagtaaacacttattgagtgcctgtcaccaggtcaagccctggaaatgccacccaaataagacatgattgatgccctccaggacctcagagactagcagagggacagacacatgtgtgtaaatagctgcaattctttatgaaagtgtgtaataggggcttataagcatgaactcttgaggtacaagagggaagaatttgattctgcctggggcagaatcactccacagaggccgtgatatttatgctgggccttgaaggaagaagagatttttggcaggttaattagcaggaaagagagcattgggtctgagacgtgaaaatgaatggcatgtttggacagcattgtgtattttggtggggtagattgtaaactctggcccaagaagtttgagtttgatcttaaaggagccagggaaactgtttaagcaagggaggccatggtaggaaatgtatattagagtgcaacaatgtgcggagttcactgggggtggggagtacatgctgtgattagaaaccaaaccattcgcttccatcataggtattttcagttaaaacaaccttgatttaaagatcataataatgtatctttcgtagagatgaactttagaatttcatagagatgaatagttggctagaaattggttgctctattaaaatgtattttccagataaagactttttaagttatttttgttgaattttagaaacttttgaaaatcatttttaaaaaatgtacccagatcaaggttgcagtataaatcactgcagaacaaaattcgtgaatcttcatgtgatatataattaaatattttggattcatccagatgaataaaatgactaggccttttcctcctgcccttgttaaaggtaatgcctctttatcaatacttcacacacacacacacacaaaaactcaaaacctttctcttgcagttccacggcaaccttcaaatgacttgtttgaaatatttgaaatagaaagaggagtcagtgcagacgatgaagcaaaggatgatccaggtgacacttacactcttagtgccatcataatgacattttattgtttctctccatgaaaataacttttaaatgtagatcgtttggaccatttgggaaaattacacctgttttctttaacaactcagattttctttgtagttaaatcagttgagcaaaaataattatgaatcattttcttttttaaaaaaattttaaagtagtacttaaactgtaaaaaggaaatcatattttataagtgatgatgtaacattgttataatttggcaacacttgtgtgttctatttttacagatgatgcactattgtgctgagaaaagattaatgtaatttccctttggtcttatggaaagaagctctggttatatggataggagagaacacttgttgtctagatacccctagttcatagattcatttgttgttttttgttgattttctgatccactcatctttctgattatttccttgtaggtgttctggtacacagttgtaattttgaccatggactttgtggatggatcagggagaaagacaatgacttgcactgggaaccaatcagggacccagcaggtaaaaccatttcatttaactttttctggtacacatttcaatgtgatactatctgaagactccactgctgctaatcaagtctactgtaacacatctctgtgtttacttgataaagatggtcaaaaaggaccatgcctagcatttatatttcatttctttgaaagagttaaatttgttagctatcaactagcactatattatgggagacaagtagttaattaaaaggtcaactaatttctctcaaaaagcttgataaataaaatatttagattaattcttgcaaataattcttaagttatttgtagcacccattcccaggaataaaagaagtaatatagtggtatatcagccatggtaataggcattccccagttgttttttctttgtttttcttttcttttttttttttttttaagatttgagtggtagtagaagaacacagtggaaatttctataaagttgtgattatcctctgaaaaaatttcactctaacttgggtgctgaaggaaatggttacgaatcaccaccactcattttataacaaaaggtagatttagacatagttccttggaactcaaaggagttttaaattgcacaattcctattaatctaaagttttagtactcataagacatcttttcttctagattcaagatagcttttctcccctcagtagttaaatcttttttttttttttttttgagatggagtcttgctctgttgcccaggctagagtgcagtggcgcgatctcggctcactgcaacctctgcctcctgggttcaatgaattctcctgcctcagcctcccaagtagctgggactacaggcatgtgccaccatgcccggctaattttttgtaatttttagtagagactaggtttcaccctgttagccaggatggtctcgatctcctgacctcgtgatctgcccgccttggcctcccaaagtgctgggattacaggcgtgagccaccgcgcccagccagaagttaaatcttttatggataaggcctacttaatggaagggtgaggagtttggtttcattttttttcctttttatactcctgattctagattttaagaagatacagaatgtgaaggaaaagcttgttatttcatttattttaaaagcctagttcttgaataccatactggataagagcaccaaacacagaaaagttaacttgagagagctcatgatatcttaaaccagctcttctcaaacttcactgtgattgcagagcagctgagggcctcattaaaatacagattttcatgcatttctagcaggctccctgaagatctctatggtggtcctcaacgcacattttgagtaacaaggtattaaaaaattagtccaaaaatatattcattacatcccctaaggttgaaatagagatttacttaaaaattaaaatgtgaattaaattccttaaaataggaatattcaataaattcaaattggttcatacatttcttttcattgtaaaagacaatatcatttagtgcctcacacacagtactctcagtcattcttgcattactgtcttactcatttaaagttaactctgagcaggacagcattatcattaatgtcacagattctgtgaataagagagaaaccaacatatctacgtgtgtgtgtgtgtgtgtgtgtatacaatataaaatacctatgacagtcctagcttatttaaaatctcatcaattttatttaattgtagcaattaaaataaatttatttcattgctacagagttgtagcaatttacactcctaccaacagtatttgaaaaccatccccaacagatattataaaagtatttttttaaatctctaccaatcttataggtgaaaaggaatctcttttaattttactttgcatttcttctattgtgaaaagttgatcatgttttatcattcactcgaggagcaaataatattgtctttatttcacaaaggaaatattgacacccagagaagttacctgtttcctaaggccacagagctagagagtggtggaattaagtccaaaccactctgtactactcatgcaggctcctagacagtccaatactcagaacatctgcagcattattgtgtttttgactgtaccacaggctggcctcagtaggtgtgcatgtggtagtgtgcatgatctgattagcagatcacagacctgtagattagactgactgaccactgacctggagtagtttgctacagaaggagggatctttggcagtcatgtatgacagaatggtgaataatatttatggtcataatgaatgattccttcaagtaagttacactggggagagtaattcatgctaaactcaggagaattcactgcacttctatgtaaacaatctatgtaaaatacttgagttttagaatttaaatactgtattttagaaccaatttagtccttttcaacatttttttattattcattatatttgtaaatgtttaaatttgttgtgacccaaatctccctttctctctgatggaaaaatgagaagagggttagaaattagaatggtagacaaagaaatttgaaatcgttattggaccgtgttagtacagagcaaattgaaaggaagagatgcctgcttgagtgattggataactcgtgatgattggctacggtccctggaggatgcttttctagaattggtccaagtttttaccaagaacttagataaataggacattgaacttaatattgaagataaactgaccaaactacggttgactcaaatctggagaggaaagtgactatgtgtgctgatacaaccagcattcgaaaaattagattaatgggtcacaattaagaaggtgaaatgtaatggggttgagtcgaagttatggctcatagtcgagaaaccagtcacacatctgagtgagggggaagacctgacatatcactaagggtagaagactttagagttttagtgtgtaatgaaatcaatctaagcgaaccttgtgatgttgctgccagaaatatggaccatctctatagaaatatgctatgtttcaagaatgaaaatccactttggttaagtggtgaatccacttttgagaattctttttttctaatatgagaagaatagagttggtcacttagaagaggatgacctgcatggaaaggtatctccaagcttgtgaaaaacaggcaaaggaaccataacgtttagcctggagaagaaatgatgcatcagggttccttttcaaataattgactagggttagagttgttctctgtgaccgaaaggggatgagaataggattgatgggtaaaaaatacagggagattcattttggctcactgtcatctaaaaagagaacaggctgacatggaaagagtgagttatcttggtggaagcatttgactgggtgacatatggcaagatactgttaaaaggttttgagcatcagatgaaagttggattagaaaacctctaaaccagctctgagagcctgattcagaatggaatgtggaaatagtcccaagaaattcagtgagcaggattctagcttggaaagaaggatgggaagaccaaaagatggcagagagttggaaggcaggatatgtgaggatggaattgcagaatatatttttagaatatgttgagagaattataacccagcactgatgggaaaatactaataaagcttaccttttcatggttttttattctaggaaattcaggtggatggagtgtatgtgtgtgtgtgtgtgtgtatgtgtgtgtgtgtatgtatgtgtatgtgtgtgtgtatcacatgtgaaggccagagaagaatataaaaaatcggctagacacagtggctcacccctgtaatcccagcactttgggaggctgaggtgggtggatcacctgaggtcaggagttcaagaccagcctggccaacatagtgaaaccccgtctttactaaaaatacaaaaattagccaggcgtggtggcaggcacctgtagtcccagctactcagtaggctgaggcaggagaatcgcttgagcctgggaggcagagcttgcagtgagccgagatcacgccactgtactccagcctaggtgacaaagcaagactccgtcaaaaaaaaataataaataataatttctgtgtattattctaattaccaagctaattatttacctatttctatctagattataccacttataaaagaatatgtgtttggatatccaattatggatgattttaatgatgtgcagttctaatccaagatccagatttgtaaatattcttatatgctaatatttctaagaaaactctcaaaactcaaaaccttaagaaatagctgcaaaataagtgcatttgctagctgcctttcatggtgctattaggttttatcacattcagtcacagtgagatgtgaaattaacaatgcctctaagaaatggaaaattgtgctgctgacagacatggtgatgcgctgcaggtatgtagctgtggccctggggacacacccttctcctgtgtgtgtcaaagctagaactaaggcccttttcctggaaccttgatctctggagaacaaggattaagggcaactgactcagcactctgtctgccactgatagctacaaggaatttgcttacatatgtatcaagtatgccagcatgtacatacaagtatgtctatttcagcattaaaacattattttaaaatacacataaatgtaaaataaatcaacaatataagtgaaagctttctaccatccctgactcccattcaccacccagcaagatgcagccagtttcttgattatgttctcagagagatatttttggatacaatggcattctcttctgtgccttgcctttgtcacttatcgatactaccttaagagttaacaggaagaacatggactttgaagccagaatacctggtctggaacccagcaccaccacatactagctttgaccttgagcaagttacttaaatggggataataagtactatccactaaacatatgtaaggcatttcaagcagtgcctcgcccagagttaccactaaaatagtattagccattgtggctgaagcatgtcccctgtcagtacatacagaacaccctcattcttatttatggctggctgctattccattactcatcagatgtaccacaatgtatttagccagccctccacagaggaacataagttgtttcaagactttaggtagttcagacagtagtgcagtgaataaccctatacattcattatttaatatatgttagactatatccatagaataaattcctaaatgtggaattgctatgtcaaaagagaatttgtattttgaattttgatagattttattaaattgccctttataaaggttgtagcaatttacacttcttcctacaatatttgaaaaccattcccaatatattataaaagtattttcaaaatctttgccaatcttataggttaaaaggaatctcttttaattttactttgcatttcttttattgtgaaaagttgatcacattttcatatatttgtcattttttctctgatgttctttatttttctttagtatttttattgatttatggaagttttctatacaaaaagaaaaattatccttttttaatttgttgcaaatatttaaaaacatttttgtttgtctattttatggtatttttatcttaacatgcaaatttggaaacttaaatgttcttcagtaagaaattggctaaatggttattggcatacttgcagcaatgcaaagtgtatttgctaccatagaaaaatggttatacaagaagcaacttacaacactgcaaatatagtattcctttttttaaaaaaagttcatattcatgtgcatttatgtgaatgtattacataagaaaagttcagaagtcaaaaccttcacaaatacctctagattttgtgaattgaaaatttaaaggcaccaaccactacagaattaaaaataaataaactaacattttataacccaactttctggtcaagttttgcagcatctattatttaccctccctccccaaaattcttgagatattgtgatactgtaaactgaatgaatgtttaatataattgtacatttatcaccagaattatgaaatcagaagtgaaaattttaataggtaacttgcttgacactgaatcaatttttcccttagttaatgttccaacttgtatcatttcctttattacaaagggaacgaattcttcatggccaaaaaaaaaaaaaaaaacggcaaaagcaaaacctggtgcgcacagagtagctctacagaggaagaacaatcataacctcatttatcatgttgtaaattttagagttttaaatgcatatgcaaagaataccttggtgtgttaggttgtcttgtttgcaggtagcgtctggcagaatggtatcagtgtacattccacagggacttaatccttgttttctcgaaacttgcaggttaactgtaataaccttatatcttagtcttaaccagagtacctgtgatgattcaaaagctgacttatagtgagacatgtaaatattttggcccaaaatattgtttggattagtttgtggaggaaggggacaagggaagtgggagaaagattcttaagacattatgtatttttagtgattcaagtacgtgaatcaaggatctatttccctgcagttttttgctgtatccttggaacatcattcgttgattcaaacatccttaaacacctgctgcctgctagcagggtaacacagaggtttgggggaaactttggttcagacttttaagttgttcacaacctgctggggagcccttagcacagaggctggcacacagtaagtgcacagaaatcacctgtgacctatagagctccgacgggacttgttagagaagacactggaataaaaagttaataccaaattttatcatgtcctgtataaattaagcataagaaagagatgatagtttatatctgttaactgaaaactaaatgggattactaccaaaatagatacacatgttcaacattccaaccatttttctatggaaaaaccagtgttgaaacatacagtgtgttttcagttgactgagataaaatagcctgagggaatgtcatttgtacatggatcaagtttcaaaatactacttgcaactttctctctcttgagaagcagcaccccccacttcactgctgcttaaccattttttttctaatgcagtttccttaacaacagagggaagaaaactctgtagccctagggatctgagaacatcatcaaagtggtctatctaaagtgaaagtttttattaatatttgtgttcatgtatatataataggacatatttatagaatagatatgatatagatttgttttactataaaaatgttttaaatggcttacctccaaataaaattgaagctccaggaagacggggagggtttcctgaatacctctgtatcttcctggtgttagatttacaccagtgtgagaagctctgccaactctgattttttttttaaagaacctttacgtttagagattttttttttttaagttgggggaggagagaataagcagatatagggccctttaaatcaccatctgctttactgttcagaggttaattatccaccagaaaattctccctagaaatttagggtcagttttaccaaaccaccaagccagatcgccaggggtgttggacaacgttatcataaactggtgagggtcacaaggtggtgaatgtgtatatgttgttgtatgcctatatgtctgatcatattccactggaaatattcatagtgtttggttactaattattgtgtgtctctggcattacttgtactttccatgagcaaagtaagtgaatgttttctgtaaacacataccatagaacttaagacaggcatacaaataagtcatatttttcttcttcaaaaatctggaattctttacaaagaaaagaaaaaaaaaaaaaaactaaaactcctgtccatgctgcttgttctagaaagggatattggcacatacacacagccctgcttttcccattccaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtaagtagatccacaaaggaggcaggacctgggacgttttcctttcataggagaactctgggatctgaatttgaagaagccttgctgtgtgaattcaggctcagataaaggtttgggtttttttctgggcctgatgactccattcagtgtctctttctgaaaccactttctgcttcttcatccttcttcattgcaacctgtgatcaccacctctccctaaccctggtaaagatccatttttttttaatggaaaaaaaaatctaggaatagaaaagtttttttggttttttttaaagttgatcaacagaaacttccaagggtggggtggtgagcttaattgttcctgctttccctttccttttaattccttagatttcaaacttttactaccataaattacccaggagatggttcttttttcttttttgaaatgtttctttcaagttcaaatttttttctttgtttcagagatcacagttaagcagcgtagggtgggaactcagaactacaattggaaagcactattctattcaggacaggatgtgggaagtgctttgatggaatatataaatttgatcttaagtaatcaagacataggtagcaaaaaaatggtctagggcatcccaacaaaattatgaatgcatttgggaaaatgtcatcattttgctggtgcttatgaaacttgctgttgggagatacctatgcctgtatgtaggtatagtttataagaaaccattttagaaagaaaagatagattccattaatacagtttttatcagagtacttggattttgtttaattcttacatattttttcttaaaacttttctcagtatttttattgtttagagaaataaaacaagataatcattttaaatcatagcacttaggttttctcttgttttataaggagcaaggatgctctatagaaaatataatgtaagaataataaaagtttttggtttttacataggtaaagcaacagtgtgattggattatggtgtttgattctattccattttcagcaagaaagcgatgttaaccacaaaggaactaagaaacatttaagataggctgtgtgattatgatctttcagatctttggctcctaatatctgttcctttatattctatcacactcttctaactttggtaatccttgacaaaagtgtgcactttataaacaatcctaaatcgaattggtctatagcttagaatggctttttaaagaataattgattctgagtaatgtggtctgatgaacagtttgatgacttcagtttctactgaaagagaagcttcagtgatactggcaactatattctgtttttttcctcctgcaaaataagtttaaaattggtttgggggaaggtttgcctttatttttgcttaataaggaggcattagaaaggggcagaggaggcttgactggtgtgtgcattctctccctaggtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtgaaattgacttaccctcttcacttaagttagttctggcctgacctgaactctgacttttactgccattcactttataaaataagggtgtgtaacatatcaagatacatttatttttatctgttttttttttcctgttaaagacaattatgtagagtgggcacgtaatccctccttagtagtattgtgttttgtgtaaatgtgctattgatattaagtatttacatgttccaaatatttacagactctagttgcaaggtaaagggcagcttgtgatctcaaaaaaatacatggtgaaatgtcatccagttccatgaccttatattggcagcagtaggaaattggcagaagtgttgggttgtggtaacggagtgatgaatttttttttaatggccttgagtttgatctctgcaaaggataggaaacctttaggaagacaagaaactgcagttaatttagaactgtcactgtttcaagttacactttaaaaccacagcttttaccatcataacatggctctggtaatatgtaggaagctttataaaagttttggttgattcagaaaaaggatcctgttgcagagtgagaggaagcatagggggaaactccattggaacagattttcacacaacgttttaaattgatataagtttaggcagttgtagttcataacttatgttgctcatgttgtgctgtgtcaggatgggataggaagcaagtcccatgcttagaggcatgggatgtgttggaacgggatttacacacactggaggagcagggcaagttggaattctaagatccatgaacccccaactgtatttcctccctgcatattttaccaatatattaaaaaacaatgtaacttttaaaaggcatcattcctgaggtttgtcttaatttctgattaagtaatcagaatattttctgctatttttgccaggaatcacaaagatgattaaagggttggaaaaaaagatctatgatggaaaattaaaggaactgggattattgagcctggagaagagaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcctactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatggcaatcctagcagtattaaagaaaaaaggaaactatttattccaaatgagagtatgatggacagatattttagtatctcagtaatgtcctagtgtggcggtggttttcaatgtttcttcatgttaaaggtataagcctttcatttgttcaatggatgatgtttcagatttttttttttttaagagatccttcaaggaacacagttcagagagattttcatcgggtgcattctctctgcttcgtgtgtgacaagttatcttggctgctgagaaagagtgccctgccccacaccggcagacctttccttcacctcatcagtatgattcagtttctcttatcaattggactctcccaggttccacagaacagtaatattttttgaacaataggtacaatagaaggtcttctgtcatttaacctggtaaaggcagggctggagggggaaaataaatcattaagcctttgagtaacggcagaatatatggctgtagatccatttttaatggttcatttcctttatggtcatataactgcacagctgaagatgaaaggggaaaataaatgaaaattttacttttcgatgccaatgatacattgcactaaactgatggaagaagttatccaaagtactgtataacatcttgtttattatttaatgttttctaaaataaaaaatgttagtggttttccaaatggcctaataaaaacaattatttgtaaataaaaacactgttagt

SEQ ID NO: 78 - DNA, 1154226 bp, Homo sapiens
tacacccctcggccctttggaggaccggagagccggacgacgccgcagcccttgggggagtccagcgccagctggcgaaaagtgaggctcttgccccgcgccccgctccgctccgccccacccccaccccaccccactccctagaagatgtggctgcgggcccggctggtcatgcgcagcgcacacacctttagtttgggcacctcctgaacccgcacgtcatccgttatggcccccacaaccacggctgttttgttttcccggccaggaagcttcatcttccagatcatccgggaaaggggcagaggtggccggttgttgcgactcataaacaacctcttcagcacaacccggttgaatgtggagttggttcctttgctggaaacctgtacagcttgaccgacagacagcctcaggtagatatcctggctcttaggctccttgcgccgaacctttcggtccttgtggcgggtgtcaactcccatgatggcgcctcctgcctggccaggtctggaaagagagagtggtaaactttcttttgatgaggattaaaaaaaattggatatcaatttttttatatattagtttattttggacaacaaacgcataaataatacagaaaagacagaagacagaatttgccacctactcttaagtgtcttgtacattccaacccctcacctcccagtttttgaatgaaatgacaaattttctacaaaatatattttttgttattattatttgaatcaaaatatgaattactaaacaaacagttcttgaacatgtatttacttttaaataccctcatataagaaacataccaaattattaaagatgttttaacatttcatattaaagaaaaaataattattagaaatttgtacatcaatcaaataacttttatgcctcaaaggctatttggaagtatttgtctacttcaggaacctactttttaaatatatatatcctgcctttaaaagtaattaaattttatcttctatgttcaaatgaacaaatttataaatgtccagattcatgaaagacattgagtcatctcattaaaacaatgagcttgagttcatcttaaataagaatttgccaattgacaaaataaaagttacattcatatagataattaaatcaaccttgagtgagcgtcttagacagggctccagtatgacattaaaagaacacagcaccatttttgactaaaattttggtaaaaaattaaaatatcatacacaaaattaattgtataagacttctgatacttattttaagttttctttaagtaattataaaaaccattattctagttccaaattatcctggcttgctcttacttcatttctctgttcttctaatttttatgtcggtcatttctctcatattttagtcttacataagctactccgattttatgttggcagaattttaaaaaatcaaatcccgctaatactaattgctgactcttcagcaattagcaaattgttctggggaataatcatttttcaacggtccctcttagcttcattcctaaggagggttccatatttcaatgctgttcgtaaagtattgatagtttcttattttcctcggcatgacacgtgtgtgtgtgtgtgtgtgtgtgtgtgtgtgtattaaatagtctttggctttgaatccatcttgaagtgttttctactggctgcctctgaactttgcctactcgtttcagtggaaaggggagaaataacttctaaattatagtctaaactcaaagcgaattttacttattagacatatgctcttggcagacattagcacaaagtagatattcggtatctgtttgttaactgactgatagcaatatggacatcattatatgttattaagtctcttttctggtgtaacaactctgtattttgtgagctacattagcaatgatttggggagcaaatgaggatttccttaggcagaatacctgttatgttgtcccattattcagtgatgctccattcttagaatgacatcgtttttcaccattatcttgagattgattttgtaggtgaggaaaagccatagagaaattttggtaaacttctgtatataacataaaattctactcttttgttatactgggtaaagtgatggtcacaactttcaaataaaaagttgttttatatgccatcttgtagaacgctgtcttccaactgtaaaaacaaacacttacaatgataagtgcttggccacggataaaggtataggcagcattaatcttacactcatgctagatcctcatggtattatggtgttcattttattggtttttttttttttttttttttttttttttactttttaacaacaaggtgcatatggcagtgtacacaaagaataattgaataagtagtaagatcaaaaggagagttagataattaaagcgacaactgttgctgagttatattaggaatgctttcaaatgccctcaattcctccacagctgagctcaaaatattataagtaatatcgatgttggatttgaaaaacaatgtgaaaatgtcttactccaaaaatgtgtatttcactagatttcacttgtctgatatgccttcttttaatgtgtttattcacatttattaaatattagtgtatgtgaaagtagggtgacagatgaggaatacaaatttgaacttctgtatttttcagtatttcctagcaccaaccttcttatctctagaaaaaatttaaggaagctgggggtaagagtgctgtggtctgaataagaattcaaacttgtctcattcgttaaaataatatttcaaaaacatgcaaggaatatatgccaatgtattcttcatataggtttaaaatttttattttaaatcttaacattgccatgtatatttttcttaatatctttcataatctaattatcagactgtaatgtttttcaaatacatgtgtttctgtgtctatactcatatgccaaagtgtgtatatatatgattgttctctgcattatttactttacataagtatattataatgtaaatatggatagatatgatattgagttaaatgcacccatatctagatattatatagctagatatatgtggagagagagagagaaatttggagatattcctcctaatagaaaaatatttaattggacctgaattttagagagatattcagttaaatgttaattcaccaactcccattgtggcttcacagaagtgagatgtcatgtagttctttcatatacatttactgaaattgagatataaagaatatggacaactctccccaaaggagtagtatagattacagggaacaatatatcatagtgcatatcaattagtctgtgagtcaggtgacctaggcatagtttcagctcttttagcaacttcatgtgatgctttaaatatgtgataaataccctaggtttttgtatcttttaatgactcaaaagtgacaaattctaaggtcctttcccatttttcatgttagtaacattgaaggaaaattattaacccaaaaaggtagacaaaatttcaaaataccagtaaagttaattaataaacatctttatttcatatgtaaatgtatatatgtgtatttatataaatatatatacacatataatgtaagctgaaagtgttgggctgtgtgcatttatatacatatacgtatttaagcaatttttaatacataaatgaaattaaaatggaaaaatattgtgagcgagcctgtgtagtaccagtggagtaaaacagggatcaaaataaaaaaggctttgtgtgtgtgtgtccataaaatcaaatataacatcaccaattattttatttttaaataagtcaatagaaaaattattttttcgagtaaataaatgcagagattttattttttcctgagtggttttgagtacagattgaagcaggtgttacatatgaaagcacagaatataggaataccatctgtgtgtgtctaattttagccaaaattttttcctttactgttgtttacagattagagaattggattctgcttcagagtggcgttggtactagcagctaatcccgttgaagattaaatgaaaacgctaattttaaacagtattattttataccattagatagatatattttacagcataatacatttctaaattttttactttttaaaaactgtgtataaatgtgtcttttctttctttttttttttttttgagacggagtctcgctctgtcgcccaggccggactgcggactgcagtggcgcaatctcggctcactgcaagctccgcttcccgggttcacgccgttctcctgcctcagcctcccgagtagctgggactacaggcgcccgccaccacgcccggctaattttttgtatttttagttagagacggggtttcaccttgttagccaggatggtctcgatctcctgacctcatgatccacccgcctcggcctcccaaagtgctgggattacaggcgtgagccaccgcgcccggcctaaatgtgtcttttctatgcttttggaatggtataaaataaagcaatcagattacttacagttgtgtgccaacttatatgaggttgtataatttgggggataagatcaggactccccctactggctgcatgcctgcttcatttgcatcaaaatcaggacataaaaaactcaggaaacactagaaatttagcagaagagtaagttaagatcctccaatccgcttctcatcttatgtatgtagaaatcaaagcccaaaatattaatggattaaaactcatatttatcccctgtagcttcaatcatctaattacctggggccaactaagtttaccaacctaatatggtaaccattaagaataataagataacaaaggatactaactatggactttgtgcaaatgtgaaatgaactttttcaaaataatattgttatggtacttcatacaatttttaaattacaaaataccttggggaactagcttgttttctgatataaaaaattgacctcccaaatatttaaaatataagataaaaattgcacctggccttgcagagtcacaaatcctgagtgaacagttaatcaatggattaaataatcttgacctcaacttaattttttttaactagtgtggaactgtaggctatcactagcattttcctaatactcatgtaagtctaaaatcttttttttaaattctacttgctataatattgttctcattgaaatactcccatatgagcaatacctgttcatatatgtgaaaagtcttaagttccttgttggctttttgctttacaagctaaaaaccactattcactcaaccattcttcacagagcctatttcacagttgtttagtgcgtttgtagatctcttaggaatctgagtgtgtttatttccctttccaaattgagtggctgacactattcttccctgcttaaagacacagtctgtaattcttagatgtaattgatctgtgattcgttgcctgcatcccactatgatttattgtgataaccttccactgttattgactcacattaagattataaacactgtcaccgagttccaaggcaattgccatctgagcagtgcaaaagcaaataataaaaagatgaataagaataaacttaatttggataaaatataaagttgagagaacaagcaaaaatgtataataattgtacctctgttgtcattcagggaattgtcagaggcaacttagaacctgccatatgtacaggtactgcacagttgcatatgtatttaatatttactatttgtaatttacaaatatatatgaccaaaaattaaaggtataaaacatactgatattcccaatattccacttaaagtttattaagtagctaccttataaatgtttttttaaaaatatttagaaataatagaatactggctttatcctcaaaaaggaagtagttaagtaatacgactgagaagacaaatatgtaagcaactcattataatagaaaaatggcatatctatttcaaaatcatctaaattgtgaaataacatacattttgtgaaaattactcttcaaaaactatggacaatttcaaatatatgcaaaagtagagagtataatatgattaagttccgcatacctataacgaaggtaagacaattgtaacttcatggccaagcttgtttcatttatatttgaaattactcttctcctcccacagattacgctgagacagatctctagaataaagataatttgttattaatcttacaatgactttattgcatgtaacttcatgatacaaccaaactcttcagagctgcagattttttttaacaggcaaaatataaactttatggagaattagagaagacctgagaatagctcagtaaacatggcatgttggtgtaatagggtaagaatatcaatagggatggaagagatttattgccagagaagtaaaataactgagaaatgaatagtaaacatttaatagtaaatagtaaaattgccagagaagtaaaataactgagaaatgaatgcatataatgaaccaataacctagagtgggtgcaggggatatatcttgaaagataggatgaatgtgtttgtgaatggcttaattttgagaaaatttatacatgcattcaataaatgatttgtaatgatctttcacaatatgcctttttgtgaagttaagcttcagtaacaattcgttgatcctacagttgtctacaagataaaaaaaaaaaacctaatcacaatttgacaaggtcatttagattctatcttttaagtaaaaggctggaagatacatcacaagtttatgttccagtcatattcaacaacttgccactctagtttgttatgctattctgtgtgtaaacattgttttttactctgccagctatctttttccttttgtgagcaatccttttatgtgtttttttaaatttatttaaatatttattttaattaatatatgaaattatatgtatttattatgtacaacatgatattttgaagtatatatacattgtgtaattatgaaatttagctaattaatatatacattacctcatatagttagcagttttgtgatgagaacatttactctctttagcatttttcaagaatgcagtatatcatcattgactatagtcatcatgtacaatacaatagatctcttgaagttattcctcctatgtaagggtaattttgtatccttttaccaacatctcccaatcccccactgtcactgcctcagcctctagtaatcaccattctactctctatttctatgagattaactttttttgattctacatgtgagagagagaatgttgtatttgtctttctgtgactgacttatttcgcttaacataatgtcctccatgttcatctatgttgttgtaaatgataggatttcattctttagtagtgtcttaataatattccattgtgtatatataccacattttctttatctatttgtctgttgatggacacttaggttgattccatatcttggctattgtcaatagcactgcattaaatatgggaattcagatatctctttgacatactgatttaatttcattttgatatatacccagcagtgggattgctagatcatacagtagttctaattttaattttatgaggaaacttcatactgttttccataatatttgtactgacttacgtccacaccaacaatgtacaacagtttccttttttttcacatccttaccagaaatcatcttttatcttttttatgatagccattctaacaggagtgaggtcatatcttatcagaggagaaagttctttttttctcaagccaacaaaaacagattcaagataaatatagatagtaagaatttatctaataatttggatcctcaaattttattttattattattatcatcacacagtccttgggactgctgtgcattgattaactaaaatgtgggtgaaattattttctacctgaatcatcatttttctgaaaaatatggtgagaaattgatagagatttactataataaagatatgctgatctcaggaatgaaaatgagtagtattctccttttgtttgcctcacttgccaccattaagcacacattaaattatatttatgaataacttttattggacacttttcattaaattatatttcaatgcagttgtttctatttgagggttagtttttagaaacacaaacccaccgttccttggtgattcactgtaatgcttcactattctcagcaattgcagatattttccccagaaaacattaccttcattggaaaatacctaagattaagggataataaaagtaggactagatatgaatttagatatggtgtgcattgacagaaaattataaatgatatgtaaatattattcagttgttaggacacagaatcggtcttcataatacagttttaaaagccaagattattgacgtgtcatcagggcatcacttgctttgccaatgttattgctgctcaaccttataactgcggataaaagggttaaacattttgatcacttggattttgtgttgaacttgagtttttaggaagataatgtgatatataaggaaaggtaacacattaacatctttatataaagaaacatatttatccatattcctctaggaaacttactgcaaaagaaagttctcatttatagaagacgtacacactcatagagatatacattgtaatattgcttaagtgttgctaagtgtaaagttctggggactgaagaccagtgataagtctagtaattcaaacttatccatgacaagagccagcatatctgttaaattcctggaaatggccatctggctttggaacttgagacatcgctcctgaggttgacatcgcatgggagtcaaccaaatgaaaaggttctttggtaacacagctgggaaggtgagttagtattagtcaaaaggggaaagtattgctttagaagtttggtagtctggcagttggccaattatgccattttgagccaaaattatgtgagaaaagaaaattttcatttggcttcctaaggaggacaaataggaagtgtagttaattttttcattctttattcaacaaatatttatgtaccaaataatgatgcagtcagtagcaaatcagcaggtagcaataggactcagcccccatgatgtttccacttcattcgtggaaatagacaacacacatgtaaataaataaataaaataatttagattgcaattatcatgaagaaaataaacaagggctgtactagacagcatccagggaagaggcaaagacactttagaggtggtgggccagggaagtctatttaaagaaatatggtttgggttgaggcttgaattatgaaaaaatacagtcatacagcattcaggagattagactgttccaaacacagaaaataacaagtgcaaaggccctgaatggaagagcttggcttgtttgagaaatataaaggaagccagacgcaagaagagagcaagaaggcgtatggtgtaaaacgaagttactaagatatgtgggaaccaaattttgaaatgtctttttagatcatggtaaagagttcagataatattccaatttcagtaagacggcttctgaattttggaagaatcataattgtaatttaagttataataggtaaatttatgtacaagacattgtaaagcaatatctggtctttgaaataatgtaatggataaatttataacttataaatacttaaaatattaaaaaatgaagtaaatttggcaaaattctgatggggatttattttactttcttcataataggtttaaaatcttcatgaaaaaattaaacctataaaaaagaatatgttattccagaactcaagttgaatgaaataagtatagctaatgaagaaaacatggataatgtcctgttgtttctaaacaggaatatgtgttggaaatttgatagcataagtaattatattttataatagtaggtattatccaaaagcattcattcaatttagggaaatactaacttgactaattattccccggaagtatattgtaaatctgatttaattgactcaatcacacatttatctagaatatttgctctcaaccttaaaaaaagtactcatttcaacatattttgaaagctgttttaaaaacttagtttaaagggaataacctaatttcaataaatatgattttgttgtatatttaaatactatagagaaaagagaacatctttaacaccaatgatttccgtaactctagtttttgtcttgtataatcattgtgcaagcataatttgttcatggttaacacattatcccaagatacagttgatattaagatacaataggttacatttagaaaagtttataaaaattttccagctttacttctatattgtaaatcatgtaaatgagcaaactgattttgtcagtgttataaacacacatggtatacgctcaaacttctagttttctcaagacatcattttggaaacaagaattgcattcaaatatgcataaaacgattagctcttctcaattctgatacaagacaaaatgaagaaaatttgcattttaaatcactggcggtgttggaagatggagggccatgcttgttttcactattgcagattataaattaaaattattgtataaaacaaccttttaaatcaaatacagttcttagtaaggtatttggtttggttttcctcatgatatttctggtatttttatttatcaacatggaaatttaatgggggagcgttgaggtactctatagaagcaaaatgaatgtattagaaatcagtgtctctcctccagatttatccttgtgtcctataaagaatatctctgtgaataaaccctcagagggctctttggtgaggtatggaagcagaaatctgcacaaagagattctgtctcctgcaaaaatagaagcaaacaatacaaaataaaaataaaacctggggcagcaaggacaacaagcagggtaatgttgcctaaaatactgatatattttggcatcaaatcctagagtattcttgcccccaccttttttggtgaaacagatgcagtcttaggagtacttggtatggtgaaaatgccaactgtctagcatgtgaataaaagtattcttggctaaatatttttaaatgtattgattaaactggatatgttataaattataaggaaaattatataatttggtgggtttttgggtcatttgttgttgcattcaacttgaaaaattcagttactgtttaaaaagtgatacatataaaaatgacagattatatggattgatggaaatatgctgatacattgagactcatgattataacagaacgacactctcattattttattgacaaaactcacctatacagacacagtgggacaggcacatatatgtcagatagaaacccatgttcaggtccgatttttgtttgctggcagtgaatatcatttatcttgtaacatcatcgtatgatactgacaacagctcagccaacgtctatgatttataaatattgaattaaaatgtacataatctatttttagtttaaaaatacaacataagacatcatttttttgtgatgctgttacaacatattagtttaagttctgagtttcattctgaccaaagttacatggaatgaggtaaaactgaaattttaatataaagctctgtctctaaaggattatacatttcatcctttgagtggtttgcaaattcaacttattgtaataacacttttatttttactcctgaactatgaaaatatattattttagatatagctattttatgagttatgtttaaggtaacttttctcaaaagctgttgatctattcaagaatctgatgcttttgaatccttaatagcagtttagttttcagcttttttggttgatttttttcttccatgttaaaatgagttatttaaaatttccttctgcttaccttcactctaatttccatgaaaagtcataaactcttgctcattttccttaaggaaagctcattaggtacctgccttgggcattgttatagttcaacatttcacataaatgtattctacagaacattggtctcctgagagatattaagggatgctccatgaaaaagaaaagaattccaaggacggtttgtttgatcaatctggtgtactatacattctcactttaaaatgaatataacagagtaaatagctaaattctttaagatatttgtggtccagaaaccttttaatttttataagtcttctcaatagtatttgaattcagaatctttttttgtgatgtaacatgttttggtatctttctaggctaatactttttaaagaaatatagttttagcacagaatgagtaacgcagccacaacaaagccttacattgaattgtgtcattttccaaatttccatgacatggtaaattttagatctcatgtatattttggagaacatataacaataaggaaaaaaactcacacttaaattactgcagcaagaaatcttcaagtataactggtatcgtttagagattcatttaaatccaaatattttattttctttttaatccttttatatatgtccattgtcagaatttaatttggctattttccttcaaaaaactagaacttgttgaaatcgaagtacatgttttagtaaaatatttttaggctagcatttcatttccacattcaaattttttttcttttcaagtgttctttttaaagatgatagcttaaagaatacaaatgtaaaggtaaagcagtatgataataatattctcctcaactatacatagagtgattacatccatccctgttcctgtccccatgctttatacattttctgtatcagatcctttttaaaaaaaaaaaaaatttagtctaattcctttaggagattgccctacatcacactctaacagctctttttaaaagccaactctggtaaggataagtaagccaatggctccagaacaattatagtcataaaaacacataagaattctttaacaaatgttgctgaaacaattgaacatccatattaaaaataaatttagacatagaccttacatatttcatagaaattaactcaaaaaagatcatagaactaaatgtgaaacacaaatctgtaagacttctagaacacataggagaaaatctgtgtaacttcaggtttgataataacttttagatacaatccccaaagaaaaatccatgaaattcaataattgataagttagacattattaaaattaaaaacattctgatctatatagtaggctgaaaatgtatagtcagagataccaggtcctaattcttggaacctgtgaatgtgaacttgtaagaaaaaaaagatctttgtagatatgattaagttaagcgtcttaacatgaagagattaccctggattctctgagtggtatccaaattcagttcttattagtgagaggtggaggaaaattagactcacacaagaggagaaggtgatgtgaaaatggaaacaggcattggggcgaagcagccacgaaagcaagccagcagccaccagaaactagaagagttagggaactccttcactagagcctccgggaacaaggcccttctgaaatacatcctagtcaaattggtgttaaatttctggtctccagaacagggaaagagcagaattttattgttttaagctatcaactttgtggtaatttgctacagctgcaaccagaaactaatacactctgtgaaagataccattaaaagaattaaagcacaagccatggaatgagagaaattatttacaaaacatatctgataaaggactttgaaatatacaaacacgcgtgtaagcaattaactataaataagagaagcttttgatgttttgtcgtatctaagaaattattttgtgtaattttcttatgaacttcaggagttgtgatccataccatactggttcacaatgatcaatgtgatatagtataggcttaaccttatgagagtcaatgtaacttaatgaagttctgaagtccaggcaaaaggtacaaggtgatgtttacacacacattgaggagagggttttattacagaaattatctgtgaggaaaatggtagcagaaggtcagtattctggctgggctgagcagtattttttaaggaatacagattcaatatttttatctcctcagcattggtgttcaaagttaaaccctcccaaacttcaggcttcttgggttccagaggcaaatactgcctttaccatttttgtcaggcaggaatagggtaactaaatcccaagaagaatatggggaggaagaagttcttatgaaaatccagtttcttcttctaaacacactggattaagttactgcttttctccttcaaactaaagtgtgatattgagtggggacagttatcttttaccactgaaacaaacagacaaaatctcaagagtacacaagaggtgcatcccacaaaactgagaaaagggaacagggtggaaatactgagtgggaaagagctgttttgcctacttatttaatttgcctcgggcttaaaagttttcattaaaatattacataatgctgtttcacactgcaatagtcttgttacctacagggcaccaaggatggtgactttctagttaaggagaaatggtctcactttttatgcagatactttttattactgagaagtataccagaaagtgtcatttgaagatcaaatgtaatatacttacttttgatcttggaggttccccaaccggaaatattctcaattttcctttctgactcttctatatataactcaatgccaacttctgttgctgttattatgatattgtatttttcttctttttcccttgggcaaataatctaatgtctaatctgtgagttatagtttatttatctttgtatcttccaaacctaacagaatttctaacacagagtttgtgttcagtaatttttttgaatcaaaatatttgaccagctggacttgtatgttcaatgcaagttcaacttcaaataaatccttatcaactttagctacaaatgctattttcccagatgatttagagaaatacatactcttgtgaataacttattaatatagatggaggccaatcagagcttatagatctatttattaaaatctgcctcatttttcttttgagattggactaatccttaatagacatgttcatgcaaaataggaaataacattgagtataagctaaattggtcaatgaaatattaaaatttgcttgcattaggactatatttcctattgctaatgaggcagggatattgttttctgcccatatgatttatattataaattgtgctttatagcttacaaattgatatggttcctataaatgtcataaatgctcagttgcctaaaaattacaatttcacatgtataaattttcgatgaccaatgatgttattaaggttatatttgtttttaattattttttaaatccatgtgataaaataacagtacattggcttatctaactttttatgatataataatgatacactgtcttgtctaactttttatgaccattggaaacatatgatttcaatgaagtgagttttatatgtcaaattattattatgtttaccatagcaaagacaaatattcaaagataatgaagacattcaggaaatattataagaaaatacttttgttaagaatatttaaggaaatttatatattataatgtctttttccatcgacataaataattttactgctttcatacctaattacaagagtgcaactggttcaaaatatgggtttatttcatggtacaagcctttttctcttagccatttttaaaattaatgtatgagcactgaatttaaaatgcaaaagtgtaacatcagtgctaagtttttagtcaataaagaagcaattataagtacattaactattagggggaggggaatcaaatcagaaaagaacatgatcataatgcatttccagtgaaatcaaaagccagcagatggagcttttcagttgctgttacataatctttacttaaagatgccatctaaaataaaatagagtcaatttaaagtccttaaatgttccttttttttctgcttaaaactattcagtcactacttgtaaaaaattgtttattttcagtgaaatgatatttgaatacttataaatgtttccatttctttgaatccattagcatcccattgctagacaaggaaatttcattaagactgaagtcacggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatctcgccactgcactccagcctgggcgacagagcgagactccgtctcaaaaaaaaaaaaaaaaaaaaagactgaagtcacttgtcagtgcttagatattgaagtaataaatacttaagtttatagtgtcatcacttttacatgtgtcccagtgtaaattgatgtgtcctttgaagcacaaaatgtgtattttagcatatgagataaacaaaataaatcaatgtatgtaaaccctgtgcaagtttcttgatatgtcctaatttatctgcaaattattactattataccccttccttatacttgataaaatatagtgttatagaggctagggaacaagctcaaagtcctatagctctagagggctgaagtagggtataaaacctggtctgtctgaatccagagctactcttgtcactggtacttgactgcctctatgagttttgaccatctctgtctcatcccaccaccatcccaaagatgcttgtttagaagcattatacatattataaaaataaaacagacactatatacagtaaaagtgttaaaaacaagaccaatgaaaattgaatttctagaggcaaattttacagaaacctgtaaactttgtaataaaaccctctcctcaatgtgtgtgtaaacatcaccttgtaccttttgcctggacttcagaacttcattccccacagagcagtgggtatatataagctagtccacagcagcctacccatgttgaagctgcacatgtttgatttcaaaattttaagtctgaatactttctatatttataagtaggttgtatcccaccatctccactgttttctttaattcagattacatctagcaagcctcagtctggtatataatacagaatgtaaaattaaagtctttcagttcttttcaagagtataaacttttaatgttaaggcaaataattgcttgcaacaaccaatacgcattatgagaaaggatattatggctcagaagcaaagactggaaagacaaactcttttcttttatgtggatactgccaatggctagaagaatgtttgctgttctctttagttcctgccctctttctagattgccaatcttgcatgagctgaagctgtagctgcctccaggtcctagagaaccaatccatttcccattccatcttagctgggcccagaatttgcccccgctctgtttcctcagcagacatctggtaggttctcaggcactttagggaaaagtttacttaattcttcttttactacacaattaaaccacccacctacttgcctatgattttggcagtctctccagagactcttgagtacttttcagatgaaaaacttgaagcctacttgggatgtaatgactacttctgagagttatgacttgttgttttccaattaaataaagggatcctgtgagatgagaagtaaatacgtcatggaacatttgatttgcttcgccagtaccttgtgccagaatcatagttggtcaaacgtacaaacttagaggcaatcccaaattattttttaaaatttgtgggattattttggtatttttttctgatttcaggggactatattcacagattttttttttactattgagaggaaattgcttatcaaatttactttttgctaaaatatctttaatattatcaactttactatatatattttttaaccgagcagcttttttattttgctatgtggcacaaaattgccatcatcaatcattgagaaatttgctacatagcctttttattttgctatgtggcatgaaattgaatccagagctactactcttatcactgatgcttgactgcctctatgagttttgactatctctgccccatccacgaccatcccagagatgcttctttagaagcattatacagtatgctttttttctattttgctatgtggcacgaaattgccatcattaatcattgagaaatttgctacataccttctaacagtttctctttttctctccatatcatactccaacatactcccctttgccttctgccatgattgtaagtttcctttaaaaaagttttctatttttatcgagaccagcctaatcattatggtgaaacctggtctgtactaaatatacaaaaattagctaagcgtggtggcatacgcctgtaatcccagctacttgggaggctgaggcaggaaaatagcttgaacctgggaggtggaggttgcagttagctgagatcatgccactgcactccagcctgagcaacagagcaagactacatctcaaaaaaaaagtttcctatttttaaaaacactactatgtgtgcagtacagcttttgcattttcacttgattctgcatatgtagtatttctttgttttaaatccagaaattttctacacttgtttttaagctagagaaataatttagttgtattacaatttaataagtgtttcaacttaatttccacttacaattcatttaggtattgtgctatttgcatataatatccaaataaacacattacaatattatattggtgcttacattgtgcaaaatatccatccattgacattaactagatttgtgatgtttttatgtggaatactagaaacagtttagacacttaatatgcatactcggtattagtctgttctcatattgctataaagaactacctgagactgggtaatttataaagaaaagaggtttaattggctcacagttccgcaggctgtgcaggaagcaaggctggggaggcctcagtaaacttacaatcatggcagaaggcaaagggaaagcaaacacatcttcacatggccagcaggagacagagaggaaagggggaagtgctatacacctttaaacacccagatcttgtgagaactcacttgctatcatgacaacagcaagagggaaatctgcccccatgatccagtcatcttctactaggtccctcccccaattgtaattttaattgggaattataatttcaacatgagatttgggtgggggcacaagccaaaccatatcatactccaagaagacaataatatataaaacaatcaatgtttgaagctaaatatagtgctaccaatacaacaacgttgtgtttattgaattaaattattttatacttctttcatttttaaatttaaattgatttaaattaaacacaattaaaataaatttcccctgtcacaccagtcacatttcaagtactgaataatgacatgtagctagtggttaccatactgtgcagcaactggtttagatcatgtctggattcaatgtccagttttcctattttctcaatgtgattgggagaaaattacttcattttctaagctttagtttctccatctggaaacgagagtgaaataacacaaccagctcacagaagttttgaaagggctaaacaatataatccaaagcaaatgcttattgcaggttttgaaacatgatttccattatacattgctaaagaagtgacattatttaacaactgctatataaatctgtgcaaacaagatggtttaataatttgcttttggcattgatgtaaatacaacacaaacacataaatatatgtatgtatatatatttttttcatttctgggaggtctaaggagtttttaagtatctctctgttctagattcatatttgcctattttattaataatatccaggactttaaaaatgagctgtagagctaacaatataacatttttttcagaaaaaaatatttttatgttgtaaatcatatgtattacttaaggaacatataaataatttcttttgcttgcatttttagaatgctcacagatgtaactgcatcatttaggtaactcctaagtagatgtcattagctttcactcacaagatgtgttttagaagttttctgaatggaagtgtaccttggttatattccatatatttgatagaataaaacgtagtaccctttagataaaatatttacattgactatgctttctatttttttgacatttgttgtgttcttagtgagaataagtatcacatgtaatttgttcatcagttcaagtaaatttcatttattttattcattcaatacatttttattgagtgcttactttctctcatgaaatcttggaaaaggagtgtgaaaatgagaattgtttgaatctctctggccttccctgtaaaggtagaaatcttccttgtttttttgttcatatttatactttaaccacaaaaaaagctgaccaattttttcttcactaagtatccagacttctcaggtttgatgaacatagttctctcacagttataggaatttcagttcctttgtctgggcagccaatttttttcctcctctgtggtcattttatgcattaatttaagaatttgctgaatatgcactaaaactgggggtaaactaatgagcagaacatgtgtgtttcctaatgctcaaattttggtggagaaaggcagatttttaaacaaactacatgaatagttctatagtttttttaagtggtatatgcatgaatggaaatataaaacatgcaaaggggatgaagagtattggaccatgcatgggagggtgtaacaaatgttgtaaaatgtattagataatgttatttaagttttagagtaaagatatttatgtttagacttgctaaaatcatgttaattctaacatgattttaaggtttactcatacatttttaagtatacaattccacttctactcagattcaactaatattatgtacaactattacagctatagttgcccaagtgtaagatgatcttcacaaaagatgaaaaactgctcctataatttttttggttgatagataaatgtatagttgacaaacacacacacacacacacacacaccccgtgtgtgtgtgtgtgtgtatatatatatatatatatatatatataaaaataaaacttttaagagttatttattcaggcattcaaatatatgtatatttatatttgtgctatggactgaatgtttgtgtccccctaaaattcgtatgttgaagttctattcctcaatgtgatggtaccaggaagcgcggcctttgggagacagttagggttagattaggttacaagggtaggaaccttgtggtaatataattgcccttacaaaaagaagaggtgatctctctctccaccatgtaaggatacagcaagaaagtggccctcaccagacactgaattttctggcatcttgataccttgatcttggactgccttgccttcagaactgtgagagtaaacctttgctgtttaagacacacattccatggtattttgttgtagcagccagaactgactaagaaaacctgtgagccaaagtgtatatatatatatgtgtgtgtgtgttatatatgtacacacacatacacacctacacatacatgtttatatatatacccacattaggaatatagatagaattttcaagttgttaaatatgatacttgtttatgttacacatacacttaaaactgtataatacataagttcatatatgaattaattttaaagtgttttgaagtattgtttttaacctaatttcatatttcataaaatttgtaaagttttggcttgtgaaatgctgaaaataatattgatgtttattgagatggagaagacttgacaagatacttgaaatttgagagtaaaatggggactatcaacatttgtctctgttggttgggcgtggtggctcatgcctgtaatcccagcattttggaaggcccaggtcggtggagtgcttgggcccaggagttcaaaaccagctttggcaacatggtgaatcctcgtgtctacaaagaaaaaaaaaatagtcgggcatggtaacacacgcttgtagtcccaattatttgggaggctgaggtgggaggatggcttgagcccaggaagttgaggctgcaggaagccaacatcatgccattacactccagcctgggcaacagagttggactccgtttcaagaaaaaacaaacaaaaacaaaacaacaacaataacaaatttctatgttatgttactttggggatccccatttgacattgctgaatagctccccaattgaaatgtttcttagaacattcatgtttagcaagatcattttatatcactcattaatttatataagttctttataattggattccatccttagtctgtactcctttttcaggaaaataattttatgatttgtattttcttttatatacctcaaacgttcttcctttaatttcaaggaggttcccctaagatagagcaaataaactttagctaaatttctgtctttcctgtaactgactttttatatacttttaagagttatttattcaggtattcaaattcaggagtacaaaactaagttaagttgaccaattatgaacactgccctgttgaaatcattttatgttctgagaatgagagtattacataaaaagtagaagtcaagggcacactttctctctctttgacacagtaagtcctgactttacctggcctctcctttgagaaacatgcaatggtcggtcattcattaatttaaagaggtgattcacctaagtgcaaagaatagtctatgcatatttataactttgtacacttttattaaaaataacaacaaaatagacttttgctaaaaggaaaacagataatatgagaaaagtaggagacaaaaaggatgtcagtggagagctttaaaaagctaagtaggtcactgagacaagcagaaaagatgcaatatctttttttaagaaatgaagtaattcttaaaagatgcacttcagccagtgattttttcaaaatagaatagcataaaattcaaaatcacaaaatactatttatagagctaaccttacatgatttggggggaaaaaagtcctcttcagtaagtgtgaaaaactgataagaaaccttgtctgaagagtgaatccactttaacaggactcataaaaggtcactgtgcagaactcgtgagaaaggcaaaaatatttcccagaatcaagtagaaatagttttgaataaattcactttgaatagaataataccagatttaaaacaaatctaaaaatgtctcaatgcagaggatggacctaaaacaggaacatagtaaaagaatgtgaggctaacaaatttgaggcaattgaataatttagtgtttcagtgttgtatataattactgctctttatagtcaaagggatataaacagctcaactgcaaattggtcttgttagaatatttagtacaaaaatcctttatctaccattctctctacagcctcttgttcctatcattcatatgcaaaattttttaaaaaaatatgagtaggccactattattcatatgtgtgagaatctcttcctctgagggacttttcttaattctacaatcccaagttactcgctttttctactcctcctatgtcctttagtattttattgcagagatttgatgtatcattttcctttcctcttcacatccaatccatcagaatgtcaagtgatactgccacaaaattcatcataaggaagtcattcctccatcatcactggcactactttgaaactcacctctcctcaacagttcaaaagcctatttccttgtcttattccttccatcattttagcttgcaatttgtgttccccatggcagtaattagtatcacctcttttaaaacacaaactgaaattgtgtattcttctgctcttgtgtccctgtaccaattcacccaaatattaatgcgtggctttttgttaaattgaaaagtgcaattcaaacaccttgataagctgtacaaagacctatgtgatgtgattcttttttgcttctttatgaaccacttgattcctgtgatccaccaactactgctctttagccatcctggtttcctttctctcttgcaaacttaagctgttttcttttcagtctttgtcttgtctgttccagtgtgcttgactcactcctggtataatcttaaaatgtcatctcctaaagagagccattgttaattactgtaaacagctaaggaggtcacctgcttttgtgctctagacatagcactgtccttagcaggtgtgcagaaatgagaactaggttgtttcttagagtaacaaattactaaagacttggtggtttaaaattttggaagtttattctcacagttctggaggccaagtctgaagtcaagatgttagcaagggcgtgctccttctgaaggttctcggggagaatcctgccttgcttcttccagcttctgatggtgtcagaagttgcttggtttgtgacagaataataccagtctctaccctcttcacatggctttctctcttgtatctctgtgtgtcttctctttttccgtttcttacaggcatacgcatcataggtttcagggaccatcccaatgcaggatggtctattcaaaagatccttactataattatatctgaaaataaactaattccaaataaggttaccttttggggttctaagtagatctcagaatggccattattcaaccttctgcaagtgatattgtgtagcaattaaatgacaagaaataatcctgaaatatgtgaggaacatctgttatttcccaggaaggaaactctagatgagacagacattcatggaagttcaaggtaaagtaataccatagtggtaagaggtttggtgctgctttaataaaaaaaaatcattaagcaattgaagacaaatggtaactctcttttctgaaagattcttctatgcaggaaattccaatctgtcttacagtttcattgatgacaagaaaacaaggctttaaaccagaaatctaggaatggctttgtcagttattaattatttcaacataggcaaactttaattaccacttttataaagaagatgctaatctttatctcataggtttttctaagacttaaactagataatatctgcaaagcacttagcgaatgcctggtgtttaagaaacactcagcagctgcatcttaatatgtactgatttccatagtgaatacattcaatttcaggactaaaggaaatattactaaatataatttaaatgcatgcatcttattttatttaatatatttaatttatttcactctatctccatttttctcagatactttaaaagctatcatgatcaagttgtaaataattgaattattcttttcattattccttagtatcattaaataacagtttagaattatctattttataggtgagggcaatcctgcttttattgtacatatttgtaatcgctttgcctttttccaagatatattcatttaactgtttggggttttagtctacctttataggaactatctttacaacttgttatgaaggagtcatcagaataatattttcaagcacttttaacttgatgaagtgctttcacatgcagtttccatttcatctatcatttatccacttatccaacaaacactcagttttctggttttcctgacaccaaggtgagtgctgtgataaagaactaaaagctattgcctggtacttaggaagcacactaatggagtgtggtgaaggctacagtgagtgtgtgcatgccagtgctatggtaatttaaaggcaggatgcattcagacttgagttcagggcattgtgaacctaaagggcatgggaatcagttttttttttaatgtacatggaaattagatctaaagaacataaggggtatctagggagaagtaccagcagttgtaaaggcatagagactgaataactggagtctgtgtttaaaggagaaaagtggcatgcactgagggtgagaaacaaatcagaagtcaaatcacagagaactggaacatcatgctgtccgacatggacttaattcttaactaatggaaaatgcacaaagaatattaggtaggctgtgacttgattctatctacattttagaatgcagcaacttagaaatgagaaataaactagagaagagctacctaggaggtagggtagaaagacctcttgggtaatccttcagagaaattggaatggtttgatctttcccgtattagggaggttgaaaagaagggaatcattttaagtgacattaagaaagtgaccagtttatacttgatatccagttggattttacttctcaataaattcaagagagttgtttaagttcatttgtatagtacttgtttgctccttaattagagttctttttaattcaccataacagttcttaccacgattggagaaatatctttattttaggtcctggaatccctgaaaagagtttgaagttaactctttagactcaactattttacggtagttccttatatatgtcagttatctaatgcaaggcaagaaattatttccacaaattaatgacttaaaaacaacgattcattctgtcttaccattctctgggctgtctgggcttagctgggtggatcttctcctccgtatgatgttgtcgggggtcactcatgcctttatctatgacctctgcttggactgaaacatccaacatagctttactcaaatgacctggaccttttctagggtagcgggaatggttgtggttggttgtgcctttctgtaccaagtagttagacttctgacatggtagcctcggactctagactcttaagaccataattggaaactgccaggcttctcaagaggtagacccagaatggacacagacttgcttctgttgcattctattggaaaaagcaagtcatacagaccatccagattcaagaaggggaaatagatttcatatcttaacggggggagtgacatgagtattcagggaagagaggaattatttgaagacaatctaccatactacatcgttggaagttaccgattttgcagattgtttctgaaagtagatattctcctttcttatataatatcaatttaagggcacatgataacacgtagatgtttataaaagaggttattcctcagaaagacaatttaatatagatatataaggattaaaattaattatttttttaaaaagagatgggttctcactgtgttgcccaagctagtgtcaaactcctggcctgaagcgatcctcctgcctcaatctcccaaagtgctgagtttacaggtatgagccactgtgcccagcctagagctttaaaattttttctttttgtattcctgtaagatattcttgaggcatatagtttagatgtctgtataaatgcattaagcatctatgccatttagcacatcttcacattcaatagtgatgataaaatttcatgagctagcaattcttttgctgtaagacataaactttatagccatctcaaacagtgagaaaaatctcctcagagcctagtattttgcagttacaaacattaaaaggggtggtttatatgtccctttggcacaagtgttggtcagtgttagaaactggtagatggagtaaataaaataaatgatgaaaaatgaagactcattgatttggtaagggcactaaggaattctctccaccacagacaacagtttttagctgtgaggctcagaggatggtatatacatataaaaataaataatgattatgaataaaaccaaatagtaaactagttacactaatcaacattataaaacctatatatgtatgtatatacatataccaaatagtaaaccagtaacattattcagtacgtaaaattaatgattatatttgaaaagtgaacaaaaaagcatctatttgaaagaagcagaattatacagagtttttgcatattgtgtaaaggtctaaaatgaatacattttaatttatacacacactaaatattctgtatgatacacgtaagcctaaaatagaagaggacaaattttagtaaatctaagccctaataaaaataaaacaaataaaaaaaccccaaaacaacaataagaactgtgtctttgagcattccttctgttcatttaccttctgtattcagaggactaaaaacatttttaactgaatatgaacacaatctcgatgtagcccccacctgtccctcccacatgcatacctgcttccttgatctccaggattgatttgttactcctgataatcaatacatctttttgcatcttcctccctgcttcatccctgcttctcaaagctgggtttcctagtaaagagaggcatctttgcatttggaatggttttcatcttatacaagaagctgtactaaatatttaacagcaaaggacatgagttcatcaccaggttgtctttgtttggtacatggctctactaccatgtataaagctgtatgatcttgagaaattacataaatgccctgtgcttccatttttcctttctgtacagtaacaggtacctcacagtgctgtgataaaaactacttatgaagacaatgcatgtcaaacaatttagaagagcaacaggcacacgaatacattaataacggaccttaatctcattgatgataattgaagattctagtggagataacaatagtatgctaaacgcatattatggtctggcatattaaaatttctctcatcttcttttcttattttctggttagagagtaagaggtgactgcctttctcagttgtacttatatggaaacctttgctatttttactaggaactcttagccatgcaatgtccaagttcaacaccaaccccattttttaatgatttatttttttcttggaggtattcactcctggaaaatataattatctcgcctttgccaactttagcccagctttgggctctcagatactctctttatgttgtatatgttaagtatcatttctcttcattttcatcatcctttgaaatactcttttaaaaaacgttatttgtttaacatgaaagcttgtatcttgacagtaagtctcaaatatatcttcttgctagcagccgtctgtcagcaggtgggagctggactgtcactgccgttaaactaaaatacacctacagctgtgtgaaagccaattcagtgacaatttatctttcacctcctttattcccctgcacaacatcacctgcagaattgtgtcccccaaatggcaatgtcatcttagctgtcgctcccactcttgctctccaaaccatgaaagaaaaaaagcctgcaagggaattcagcagtccttgtgatttgtttgctgatgtgccaaaggctgtaacctccactcttgggaattacaaaaccgcctgattttcacctttacacgcctttcaatgtattattccttctaaagtaaatagtgactccaggcctaaaggaagagccagggaggtgtggaaggagataataaccagagcagttattagcactaggttaagatgggtagggtaacaatacaaagaaaaaaagggaaaatattgtttctgcagtgaagaaaagtaagtgtcaaaggaagataagttggaaaatacaaccatgaaagcctttctgttactttattgatgtggaaatattttctctgctctttccagctcagcactttcttgcaaagatttatttatttatttatttattaatagacatgttcaggtaataagacatgacaggcagctcatgtctggaggactgttagacacttctggattttgtaaactgtgaggaaaagggtgattgaattcagagtacccccaaatatattactctggatgaatttcattgcctggagtatctccattttctcataaagaagaattgatgaaaaaacaagtttaaatatcagactccacaaaatctcagtattttattcattggtaccccaaatctgtatattctctataaagaaaagaggaaagaaaacatctttatattcttaatcacataaggcataagatcattaaagcattattcatggtcattcaactataaattattttataattttaatgctttgtgattattttcttgtgtatttctctcagatattttcttagtttaatacttgactggagataggaaatagagtgtaaagtttattctaaacaggcagggtaaagatacagagatcaaaagtcataactatacaaagaacacagctacatcctgaaaaatttgccctggttttaataatgtggttacatatacaaagttccattttttaaaaaaaatctagtttccttggcacttgtcagctagtttttaccacagtcagaaaagcatacctttatttgaattatgacaaagaatcagaggagctttttgattcctcaattttaattgctttttgaactgccattccagattttttaagttcattcatcttacatttatggttttaaaaattaggtttgcatttcttatcagaaaagaaagtaaagagaaaagtggggtggaaactcagaaagttaatatatcaagaaaggccaataaatatttaaatttaaattgaggatattctaaaagtaaaaaagaaaaatcccagttattgactaagagtggaaagtaagaaaacgtcctcctctcccatggtctatctctattgatcttccagttttgttccaggtggaagaaaaatgacaaataaattaaatggtaaatgacaaaataccttgaataatccaaaagggctgaaacatgggtggatctaaattatgtgagacttctaaggggaacttgttactgtgttacagtttgcaacagaactggaagatcaatagagatagacttgggagaggaggagttactaaaaatgaaatggttaaaaacaaagaagcaggcaaatagcatagctgtggacagctaagttctggagccggggtgtgtgaattcccatcccagttcagccattttaaagctgtataacctgggcaactactctcaatgattcttcttactgtgcctgtctcttcaactgaagataggaataagtttagaattacctcactgggatgttgagatgattaaatgaattattacatgtaaaatgtttttaaaaaaacagaagtaaatttcaagactaggtatttgtcttccttataaaatgacaaataaggtaaatggtaaatgacaaatttaccttgagtaatccaaacaggctaaaacatgggttgatctaaattatttgagacttctaaggggaacttctcattgcttaagcatatggaaatatcagaacttctgctaaattttgtatattcagttttttggagtttaataacaagcctatacatcacacatagtgtttagcatgtacagtcatattaagtacattgaattttatatagatttatttagaaaaatgttaatgtctaaaacttgcaaatttgagcaataaggcagttccatagatatcattaaattattttggttagctaacataaaaagattgtacttcagaagtaattttgaagaatctttagaaagtagtatcaattaacctttcacagtacttatctcttgaatgtaatattaaagtaggttgggtttatagacttatcctttgtttgaatatttatcagtacttacaaatagtaatacaaataataaaagtatgttgcctcaggtaagtattatgctttctgtgtacattgggtgctttatatgcattgtttttaaaaacctaaaaatttaaaaccctaaaatccctatcttcagttgaagaaacaggcaacagtatgaaagtgaggtccaaagaagacacatgacttatgaaatctgtataatactacaacacagcaaaagcaggtgaaagccagtgataattttggaagttgtaaagtgatgtacaataataattatcattattctactagataataaaatttaaggtaaagttattttaacatgcactttctagctcattagattgttaatattaagtggttgatgttaaagtttgtattttatttgcgtgatgagagaacttagctacagaaaatatgagtggctcacttatggatttatgaacaccagttgctggaatatgaaactgtgtctttccatgttacctatttttgtattcattgcacaatatcgactatacttgttgttggtatgatgcccaagtgatacttacagtgaatgccaacttaggtataaatttctgaaaagtaaaataaagtttagggagttatagtgcatgtgggaaaatagtagaattgagagaagtgaaatttcacattatttcgaagcaagcaaagactttcaaacctgcatctccaattctgttccttcacagaattcaagctccatacaactgcttaatagatgttttcataatctttgcattgtggtcaaaacaagatactgaaaacataattttatctcaaaagactttgaaatctaactggaaagaaaaaaacagatgtgaatcaaccagcaagcaataaaataccccacaattactagaaaaatttggttttaggcttttaagcagttataaatggaccagagctaactgagattcaaagaaggctaaactaacttctagaactgataggcataagatatttcaagagtaaaaaaaaattaaatttcaagattgttttgttcataactttctttagtcagtggaaatgttcttcttcacactcctagattaatatatgtaagaaaaaacactaatatagaatgtagcatattagtatagaaatacctatatacctaaaaatatgaaggatgtgataatttgattgtttttaaatataaatttacagtatttttgtagaaaattatagtacattattacaactaattatttatatttctgtttgttttctgaattataagatagattataacgttagtcaggatggtctcaaatctcctgacctcgtgatccacccgcctcagcctcccaaagtgctgggattacaggcatgagccaccgcacccggcttgagtgcaattatttttaagagaaaattatgatttttttcttggcccatttccttatgtgtaatatgttttttctctagtaacgtacatatttttctcttcagctttgggaatcagaatgttgactataatgtacctagctgtggttcgcttgttgcttatcattctgacctttctaaatctataagtttgtgccttcaataatatatgggaagcctgagcctgtacgatagttcttctgtatttttctgtctcaaaggcactatcttttccaatgacactcattttaaactgtttgacactggactacaagtcccttaagttctgcttatttgtttcacatatttttttctctgtgatcttcaaatggacaatttgtattgatatgttttcaattttactattcttttgttttcctagtctccaatctgatataaagtccatctcccaagttctacagttttgctttaagttttttatagttcccatttctgtaccaacatttcctattgattaactcattaagaccatatttttttctttgaatcatttaaattaccttcagaagattttaaatggataaaactcttaaatagctttaaaagtagctactttagagtaatttctgctaagtccaatatcagagccatcttgagttatgtttcttaatcctccttcagtcttttcttcctcctgctccctcagtctcctccttctcctttattgacttcttctcttcttccttcttttcttcctattttgactcttcttcctcctcctgcctctccctcttctccttccatttttcttcttcctcttcctccttctcctcttcttaattatcttcttcaactatgggttgcatttttctatttagttgaatttctcataaatgttgattcatcattggacattgggaataatatataataacagtatgtacagactttggattctgttatcttccttagaagagtgctaattcttgacttagaaggcattttggactattatcacatggaaattgagtagtttttatgtcatacattgtgagtgagatctatggaaagcccaaagtatttgccaaggcctgtaacttggcaagactcagctgccaaacttaatatgcctgagaatcttgttaaaatttgtctttaggcttctgactttaggggtaggcctagagtagagtcgagttgagtcacgtctagggtacaaattttacttgcaaggttcctagtgtctcagatttaactaaataaataatacttggaatattttatgttaatcagatcaatttaatcaatttagtcatttatacaattttattgcagttttttctttatctttacaataatatactgatgaactgcttattagtctgcaaatagcgctgtagaaataattcagctttcaggattttcagctataacgtctatttacaatagtatttctatacttttgaaagcgcattagagaatcgtgtattgaagctaggaagcaataggaaacaatcagttctttccctttgatgttatagtctagtgtttacatggaaggtgaaacatttgtctcagatagtttcatttgtctgattgataggctttccgacacagtttaattatttctacttttaagaggcatatttggtccacgtgttctttcattactgtttaatttatcaaaattttcttcttgttttttttttctttttaatcttttaaagcaactggtaatattttggctattctacgagtttggtaatttccttattatggaaaatagtgaacatcataggtaattctagagtaaatggacaaatcaatacaaagaggttacattataaagagcccaatgagctcagaaaagcaaaactatgtattttttcaccatcaagaagcaaaggaaggatattttgggtatgcagaatgatatgagcagtaaagttggaagtgttcgtcagtctagacaatgccggtggaccaatacgactgataaactttagaaaatatcctttggacaatctcattgtttactttacacctaaagcatatatttatatgatagtagcaaaactagagtaaaaatgaaatgtcaaataataagtttaactccttcgggaatcaaatttgaacattttttatttccctcagtttccatattttaaacagcctttcagatactcctattatagcatgtctcatatatatatttataaactacttgtttatgggttcctgccattagattctagaacttaactattgaaatactgttagacaaattttataaatctaatgtctagtacagtgtgtggcatctagctcatgctcaataaatattgccttgaactgttgattactctatcaattggttttgcctgaatgattatttcagctgattattgaaatgtagtttagatataggttttcagaattaaaaactttgctgctggtcaacaggtgcaattaagattaggaggagtaagctctagtactctattttcacagtagggtgattatgattaacagcaaggtattgtatattaaaaaatagctacgagaggctttgaatacatacatatgcttatatgtttatgcatatatacatacatgtacatatatgtgcataaatacatgcacttacatatatatacacgtataagttttgtccatatatatgtatggaaacatcaaattgtacccttgaaatatgtacaattaaaaaataaaagtaaataaatgttaaaaaacagaaatcacctccaaaatttatgttggttgaagaggatcctaagaggatggttgctgtgacaaagaataaagaagaataagtgataagaaataaagataaagcaatacaggtcaatttctacttctggcactggtggagtagacaaatatttcccttttttttttttttgagacaaagtcttgctttgtcgcccacgctggagtgcagtggcacaatctcagttcactgcaacctccgacttccaagctcaagcgattctcatgccttagcctcctgagtagctgggactacaggggctactgcacctggctaattttttgtatttttggtagagacagggtttcatgttgctctgactggtctcaaactcctggcctcaagtgatcaaccctacttcgcctctcaaagtgctgggattacaagtgtgcaccaccatgcttggcaaacaaaccctttcatcagaaatgatagaacagatagaaaattgtgatttttcttttaaaacttagcatacaaaaatatttgttgctagaactaaaatactggaagaaatttttcaggcacaatataagtctacatggaaagactgtaatgattaatgaataagtatgtaggttactctaaatgaatattgagtggttaaagcagtatttatgtcttctgggtgtgtataatatatataaaattaaaatgcacagaaacaatagtacaaacatcaactgatgatgtggagttaaaatggtctaatgtcctcattttttgttcaggaggtgataagagtactaatttataattgactctaataatcaaggatgcatattttgcttcctaagagaatacaaaacttacaagtcaataaaaaacttgcaataaaaacacctacttgattaagagaaggcaaaaacaatgacataaaaggaacaaataatagaggaacaaacacataacacatatataaatagttatagtaagtttagatatgttatatacttcaaagttaagtaaagactatgacatgagctaaaaaaaacctaaatgttgtttataagaaatacaccttgattatagtattttaataattataagtacaggcactaatttacaaatagctgaatgaatctatgctaatagcagataaattataatttacggtgtgagcattgatagatataaagaagggtatttcataatggtagacaagtaagcatataacgaccatatagtaattttaattctattcacctaataacttgtccaaatatgtacagcaaaaactgaaataacaaggaagggaaaatctatgcaataaagatttttaatgaagttgctcagtaacaggtgaaagaaacagaagaaaaaatagtagatctaataacaatctaaacacaatgaaaaaattggacccaattggcatacattcacccaataaaagaagaatatacattatttatgtttacactagaaattcaccaatatcaaattatattatttctcctaagagaggtagacactttagcagtaaacgtttgtatgatgttctaagatcaaaattgtcctcttctgaagaaaataaaataacttaatgcatttttttggtaacaacctgaaatacagccatgaaatcatgtttcaaaaacatccatttggcagcatatttgatacctttaggccataggcattttgtattctcagacaaattgatactgggatttttgatgtacttatttaaatttgtattttctaactcaaagacaatgagacatttatattatgtaatggagctccatggcaaactataataattatagtataactatgaggcggaggaagagaaagggaatataacacatagtattcattatgtttaaaatattgttgaaagaaagttgttaacatgcttaatctttaaaatagttattcttattattctgttatatggataaagaatctgaggcataatatgattaaatgatttgcacaaaggaagtgctaagttgtgaaatgagaatgtctggcttcagagtcaattaatggctcattgaaaatctgttattttcaataaaattatgaaaaacattttaaagtgtaattaaacagacaagtgtggacaagaaaaccttaattaataagtcatattttagagaatacaaaataaaatacagtgatttattttagagaaatgcaaccaggtccaaattcagtagtttcagtatattcagagttgtgcaagcatcaatatgatctagtttaagaacattattctaaagaaaaaccctattatcaatcacactccatcctacccagccacttacctctgtgcagtcctaatcaaccactaatcattttctgtctgcatagatttgcctattctggacatttcatatgaatggaaccattcactatatatcttattttattactgaataattccacttggcataatgttcttgagttccatgttgttgcaagtatcagtgctttattttattttattgttaaatagtattctattgtatgaatataccatattttgtttatcccttcatcagttaatagagattcaacttattttggctcctataaataatgctactatgaacattcgtatgcaagtagagtatggatatctgttttatttctcatgagtatatgcccaggaatggaatttctgggtcagatggtactctatgtataatctattgaggaatttgcaaattattttctaaattggctgcaccatcttacattttgagatttctcattctatcatatctttgacaacaattatagatgttctaatggttatctagtggtatctcattgtgattttaatttgcatttcctgagttatttttaagcatcttttcatgtgctcttttgtttatatatttttaccagggtgactactaaaatgcttggcttgtttatttcattttgttgttctttttattgttgttttaagagttatttatatattttgaatacaaatatctaatcagatgtataatttgctaatactttttcccattctgtgggttatttctttcactttccttttgttatttattgaaaataaaaattgcatatatttattgcctacaacatgttttcaaatacatattatggaatgtctaaactgagttaattaacatatgcattaccttagttatcattttttttttgtggtaaaaacacttataatttactttcttagtaaatttcaagaatataatacattgttgttaactatagtcaccatgttatacaatagatctcttgaacttatttctcctaactcaaagattgtatccctctaccaacatctccaaaacttcactcctgatctttcagtttccttatggtatcatttataacacacaaagcttttaattttgataaaatctaatttatctattttttaaattttctcttgtgctttcagtgtcagatctaagctattacctaaaccaaagacataaagttttacttctatgtatttttctaagattttaataatgttagctatatatttgttctgttgtcctttttgagttaatttttctgtatgctatgatgctagtgttcatacttttgcatgtgtgtatccacttgtcccagttccatttgttgaacaaactatattttctcaattaaattttcttgtcacccttattaaaaatctgtggccagacttgctcttccaggaatatggcatagacatacttctctccatttctcatgctacaaacaactaaaaaccctctatgttatatataaagccaatattgagaggtaggggaaaaaaggcagattgactagtgaacttgacatctaaagaacaacattttgctagttctctggaatttccttttacttcaagtatctcagtctcaggcttaaataagccagtaacttggaaatgacagacacagtcacaaaaagcaccaataacagcctgccttctgtacccaaaggaccaagaaaatggaaacacagaaagacaaaaaaccgttgagttgatatatgtcctataccagccaaacaacacagaaaaatatgtggcttccacccttatccacagcaaaaaaagactaagtggggagctggtactttcaggcttaccaggctacaagaaggtgttccaacaccctcactgtggtggtgcttgaaagagctagaatactcatctctgctggccagtaatgagaccccctgtactgcagtgtcagtgtaaacactggatcctggactttcatacccacttcatagtaacaaggtgcttcttctgcttcctgctggggtggtgtcaaaagagatctagtgttcagagtggtcaccagcacccaattacaacaatgtgactccctgggttgttaatggaggccaattaggaaacatggacttcttcgacctgacagcaatgaggtaatcctccccttcccattccactgctggggtagactcagaaaaagactcatacactgaaaatgtaatacaatccagagttccttagcataatatgaaaatatcctgattgcagttaaaaaactcacttgtcatacagaaaaccaacaagatatcaaactaagtaaaaaacaaattggatgccaaccctagatgacagagattttaaaattatctcacaaagattttaaagcagccatgctaaaaatgcctcgacaaacagcacaggcacacttaatacattttttttcaagcgaaagtgtcagcaaaaaaatttaaaagtttcagcaaagaatagaacatgtaaggaggaaccaaatcaaaatctacgaaaagtataataagtagtatgaaaagctcaattattgggatcaacagccaaatagagggaacaaagaaaataatctaagaactgaagacagaaaataaattactcaatctgaacaacaggaagaaagtaggccaaaaaaatggataatgcatcaagaacctgtaggactaaaataaagaatgtaaaatttgtgtcattggaattataaaaggagaagggaaagagagcaggactaaagacatacttaaaaaatgactaaaaattttctaaatttggcaagagtcaaacctacagattgcaaaaactgagtataccccaaaatggataaaccaaaataaatccatgcatacacatcttaaatagaaaactaacgaaaaaaagtattacaagcagccagagacaaaagggctccacgcttataggtgaaaaggataaaagatacagaagtactcaacaacacggttgaccaacaggatgtaattaacacttatagaacactttactcacaacattgtaatatccaacaggatgtaattaacatttatagaacactttactcacaacattgtaatatccaacaggatgtaattaacatttatagaacactttactcacaacattgtaatatatattcttttcaagtatcaaaggaacaatctaaggtttcatgtaaatacccaaaaaaaaaaaaaaaaaaaaaaaaagaaggaggaggagagctaaatccagagcaaggagtagtaaatatagaaaaagagctgaacatctgaaaacaaaacaacaaaatagagaaaataatagagaaatattattgaaacaaaatttgcttctttgaaaagataggtaaaattgacatactgctggtaaagctgacaaagaaaaaagatgacacagattaccattgtattagtttgttcttgcactgctataaagaaatacccgagactgggtaattataaagaaaaaagttttaattggctcatgattctgtagactgtacaagaaagaaagtacggcagcatcagcttctgggaggcctcaggaaacttaaaatcatggtggaaggtaatggaggagcaagatattttacatggtaggagcaggagccagggtggaggtggcgtgctatgcacttttaaacaatcagatctcttgagaattcactcactatcgctaggacagtatcaagggggatggtgttaaaccatgaaaaaccactcatatgattcaatcacctcccatcaggccccacctccaacattggggatataatttgatttggtgaggacatagatccaaaccgtatggccaatattaggactaaaaggagagatatcactacagttcctacagactttaaaaacataatgaaaggcacactattaataattctatacacatcaattggacaacttaagacaaaatgcaccgattccttaaaagaaaaaaatatgccaattcctctgatatgaaataaatattgcaaatagccctataactattaagaaaatagaattcacaattacaaaagtgcaaagaaaagagaaatctcctgacccagatggtttcgctggataattctatcaaatgtttcaaaataactagcattcttattctagaaacaatagcaaggaaatttcccaattcatttcatgaagcaggtatcactgtcctgatatcaaaaccatataaatccagtacataaaagaaagctgaagatcagtacttctagagagtataaatccctaagcaaaatatcagcaagtagaactcaacaatatatgaaaaataattataacatgaccaagtgggcctattgcaaaaatgcaaggatagttctatattccagaatcaaccaatgtcatccaccatattaagagattatacaaaataagtatatcatcccaatacaaggaaatatgtaacaggtacacaggctggaaatgaaaaaaaaaaaaaaaaaacttaaactatccctagttgcagatattgtaagtggctatacagtacatgtaccccctgaatctaaaataatataaaataatacagatgattaagacagaaagtagaaaattttatagatgtacagaaagactactctacataagtgagttcaactgggttacagatacaaagcaaatatcagttaaaaatcgtaatttttgtatagtagcagtgaacatgtagacatctaaattatcatttacactcattaagaaaatataaaatacttaggattaaatttaacaagtcatgtctaggacttctatcctgaaaactatacaaagctagtagaagaagttcaagatggggatctatataaatggagagacatgctgagctcatggactgaaagtctcttgtagtgaaacagcaattatccccaaatttacttataaatttaatgccattcttgacaatatttcaacaagactttttgtagacgtagacaacattattttaaattttatttcaaactacaaaggaactagaataaataattttgaaaaatgaataatactgtgggaagatttagtatggttgatttcaaagcttattatgtagttacaataatcaagactttggcattagcaaagaggtagaaacatagatcattggaacacaatagagaacctcaaagatagactcaaacaagtatgccaaactaattttgagaaaggtataaaagcatttcatttacggaaatgtagattttttactaaatagtgctggatcatttggacatgcacaggaaagcaaaattaatgttgacctaagtctgatacataatcaaaaattaaataaacagatcacaacttaaatgtgaaacataaaactattacacttttagaaaaatagatacaaaaaatgtttaaaatctaagaataggtgaacaataattagtctttatagcaaagcaggatccataacaggacaaagtgatgacatgaaattcatcaatattaaaaacttttgctatgtcatacaccctatgaagaatatgaaaagaacagctattgagtatcagataatatttggaaatcacaaactggagaagagtacctgcatctagaatatatacaacctttcaaatttagcagttaaaaaatttaatgatccaattagaaaatggatgaaagtgtttttttaaatacttgaatgtgaatttatgcttatctcaaaataagatttttaaaaagaagaaaacaataaatttgctcagttcccctcttgactcccccacactcaaatcaaatgtctatatatgtaaaactatatttatggactcaattttattcaattaatcttatgtccatctttatgccaccagtaccatgctatgtaattactgtagctttgaaatacactttaaattaggaagtaggtatcatctaattttttttccaaattgttttggctgttttggttcccttgcatcatatatgttaatataaatttttggcatcaacttgtcaattttagcaattaaaaatagccacattcgattttgcaaggtactgcttgaataagtgcatcagtctggagtgtatttgcctcttgaaaatgttgccttctaattgatgaaaaaaaggatatctatcatttatttacatattctttcatgtctttcaacaatttttgtagtatttagtataaaagtcttgcttctctcgttaaatatatgcacaaatattcttctttgcactattgtgaatgaatttattctctaattttatttgttggattgtgcattgctaaaatataaaaatacagtgattttttgttcactgatatttagcttgcaaccttgctgaatttgtttttcattctaacagtttttagtgtgttttttagggttttctatatacagggatacctcattttattatgttctgctttattgtgctttgaagatatcttttttttttttttttaaccaattgaagttttgtggtaatgctgtatggacaaattggataggcaccattttcccaacagtatatgcttacattattagcatttttatagcagtaaagtatttttttaattaaggcatgcacgttttttagactaaatgctattgcacacttaatagattatagtatagtgtaaatttaacttttatatgcactggaaaaccaaaatgttcatgactcactttgttgcaatatttactttattactgtggtttggaattgaacccacaatatctctgaggtatgtctatataagatcctgccgtcagcaaatatttgtatttctttctttgctgtatggttgcattttatttatttttttcttatctaatttctctggctagaacctcaagtataaggttaaatacaagtggcaagaatgaatatcctcgttctgttcctgagcttagaggaaaagccctatctttcaccattaaatttgatggtggtcgtcagtttaacatagctgttctttatcaggttgaaggtgttccattctatttttagtttattgagtggttttactataaaaagcatgttgaattttgtaaaatatatattctttttctattgggatacttagtggattttgtcctttattccgtttatatgtttttacattaattgatttcagaatgttaggtttagctttgcattcctgggtaaatctcatttggttattatgtgtgattatttttttattttgctgaattcacttttctagtatttcatcaaggatatttttatcaatattcataaggaatattggtctgtggaatttttatctcgcattgtctttgttttttgatatcagagcaagatggtctttaaaattagttgggaaatgtttcttcctcttttattttgtgaaagagtttgtgaaaagttggtattaattttttatgtgtttagtaaaactcaccaatgaagctttttgggcctaggattttctttttacaatttttttttttagtcacacattcaatctcttattgtagttctattcatattttataattcttcttcagtttatggtttgggtcattctaggaatttgttcatttcatttgaataatctaactttttaattcatagaattccttataacccttatttcgttaaggctggtagttatgtgctctctattattcttgattttagtaacctgtcttctctctttttgttcttggttagtctatataaagttttgtcaatttgctgatcttttcaaagaatcaacatttggttttgagaacttttttctgttgtctttgtattttctatttcatttatatggtctttgttgggtgcagtgttctatagatgttagtgaggcttagttggcttctggtcttgctcgagtattttatatctttgctgatatgctgctttgttgttatatccattactgaaagcagagaattaaagactccaactattatttttgaagtatatacttatcccttcaattctgccattttttccatgtattttgagaatctgttaggtacaaatattttcatatttttttattaatatggactactatatgactataaaagtattcatttacctctgtaacaatttttatgttgtctatttggtatgatatgaggttagccactccagctcaattttcataactgcttccatattatatattttgccatccttttattttactttcatttgttttgtgcctctgtacctaaaatatgtctcttgaataataattttcatccatctagcaatacctgttatttaattggagtgtttattccatttatatttgatgttattactgacaaggcagaacttattcttgtcattttgctatttgtttgctgtacgccttatatatttgttctttcctttcattactgcctcattttttttgttaaatactttctagtgtacaattttaattcctctgttgtctcttttaatatatttttgagatattttcttatttgtaatgctgtggattacaattagcttcttacttcaacattctagttcagattaatactaacttaatttccaaaacagacagaatatttgcagcaatgtgctttcattccctcctcatttttatagtagcattttattattaaatgttatatttatacgttgtaaactattcagaaatgtcttataattactgtttttgcagtttaaaaattatataggaaaataaaacagttaaaatgtacatttttggttctcttcatgttcacctaggtagctgctttactggtactctttatttatgtggatttgaattgctgcatcatgcttttccatttcagcccaaaggactcattttaatttttcttgtaagacagttcagatagtgatgcattttagcagtttttatttttttcaaatgtcattatttctccttcatttttgagagcctttttggttatagattttcttgttaacgttctcttgtttcattcctttaaacatgtaattctacaacttttggccttaatcattgttaatcttttatatgcttgatttattttttctctttgctgctttcaagattctcactttgtctttcaacagtttcactgtgatgtgtctgggtgtggatctctatatgttatttttcctggatgtgtagattaatattttgaaatcatatttgaaagtatttgacgacttttttcccacccaaatatccttgctgtcctcacctcttgcatcttctctgggacttcaattatgcagatcttggtatgtgtaatattgtcccaaaagcctctgaggctttgcttattcatgttcattattttctgtttatgttccctagagaggataatctcattgaattatcttcaagtttactgattcttcttcatgaacttcaaatttcttgcttaattcctttagtgaatttttcttttttcaattgtttaacttttcaactgcagaatttccatctggttattttaagctaatttctcattaatagtgttatttatttggtgagacattatttgtacattttcagttaattccttatttatttatttatttatttatttattttcattctttaaacatacttgtagtagctaacttaaaatctttgtcatatatgtccaatttctgaacttcgaaaatagtttctaaccacttatttttaaaatgagccatactttccagtttcttaaaatgtgtcataatttttgttgaaaacatgatattttagtgcaggaagtggtggctcgcagctgtaatcccagcattttgggaggctgaggtggacggatcagttgagtccaggaatttgagcctagcctgggcaacatgatgaaattccatccctacaaaaaaatacaaaaattagctgtgcatggtggagcacgcctggagtccctggtacttgggaggctgaaatgggaggatggcttgagcctgggaaggttgaggctgccatgagtcgttatcacgccactgtactccagcctgggtgacagtaagaccctgtatcaaaaaaaaaaaaaaaaaaaaaaaagaaaagaaggaaggaaagaaagaaagaaagaaaagaaaacatggtattttaaatactagaatgtaccatcagtggaaatcatattctcacccttccaggttttgctgcctgtacctgtttttcattgttttgatatttgttcacttagtgactttcccaggttaattctgtaaagtctgtattctttctagtgcatggctatcctagcttctgctcagttagcaaattataggtcagatatttcctcaaatgtcataagcaaatcaatacatctttcatcttttttttttttttttttgagacggagtctcgctctgtcgcccaggctggagtgcagtggcgggatctcggctcactgcaagctccgcctcccggattcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccatctttcatcttatcccaaaaggttttctctctggtgtgtgtgtgtgtgtgtgtgtctgtgtgtgtctgtgtgtgtctgtgtgtgtgtttgggcacaacttcaacattataacaatttacaagtttgtcttagctttcacttattttttaggcaggatctcaggtcatccgtaagtgagagactggttctctctcagcttagcattcacacaggcctgtacatgcacataaccttgtgaatatggtagagcttttcaaagccccctgtgagcacgtctttccccagaccttccttttatgttttgaccaggctcttgttccaatttacacagaagcttcaggcagttgcaatgttaaacaattgtttcaacttttttttttttttaaacaaatgagctggggatagggctctaaccatggagaaatctccatgtcaggccaaataacagcaacatgtgcaaattgagttttccaggggaatgcaagataggttaaatagcgacagtcttctgggcaaggggaaaggaatgcgttgaggagcaccaaatctggtctgttccccctgattgctgggaggctgttttgcacagctaccagggatgggaggctgctgattttgaaggttcctactgggaagaggggagtgggagcagttgagttacagtgctatattccatgccattattagtaaggttcagcagtttttcttgaaaaaaacaccccttatattaattccagatttgggataaatcccatagctctggaaaaaatagattttgaccatttttgccagtatatttgttgcttttaatgtatgagactctatatggaggcctcccctctgccattccagaagtaccaccaaatacaagtcattttattcaaaaagtaatatgttatcactaattttcctattccgcatatattctcataaaatgagaaagtgtaattaatatagccctcataacagcaggatgtcagctgcccaattaaaaataaagaaaatcacagaaaaatactactctctaatttgaaatactttagtttttaaaagtcagtagtattttatataagctcttgggtggcagtgggaaatccagctgggacttagacttcttaaagctatccaattatgtttgacataattcattatattctttctcaaactttcaaacttaggtacaacctaaagaaataatttttactttctgagttaatttgtatttctaccgttaatgccatctttttattgagtgattcctagatttttcctataatatataagactaaattgactcaaatatcaaaaggtttaagcttaaaatgtcattcttatgaatttggaatgggttataaactttataaaattaactgaactgtatagaattaattttgtgtgaaaataagaaaataaaatcagaaggacacagtggcataaatgtctgaaatacagtttacttaatagtagcagataatttgtattagttaataattcagagatccaaatgaggagacatacactaataagttttatagataaaacacttacacatttcttcatctttaaaatgtagagcgtactaatatgtacttcacaagcttattgtagagatttaataaaataatatatgttccttgacaatagaaatattagaataaatgaatattctggaggcagcttttgctgttgcttcttgttgtttaatttgtagacaaatcagttaccctgatttaaaaaaaaaactatgttattattattgtagatgttatagtgaggatcatcaggaaaaaaaactagaaataatgggatcttaatataattaatataacaacatggtcactttaaaaagacaagatggcatctggtctagcaagatttgtaatcaactgaactctatcaacatgttcaaagaaagactgtcagaaacaagggggctttttcacttattgaaccgtaaaatgtggagtctaagatgtgaacattagcattgctcattgtaattatatcccatagggcaaataccactgcattctggagataaccatgaaaaactagctaagttagatgttatgaaacatttgaaatatacacataatccctcttatttaaaataggtgtttttacttcttttttctaaattagttataaatatcttataatttaagatgtcttcttatttggatttgctatatagagaaatatgttaggaagaaatattggcactgtagtttttcatctcacactctgtgagtttatttattgtaagtctaccctgatggacagacacctcactctctgtcacttattccattttctcataatctgaggctaagatctacattggaattatgacacattcacttaggaaactttctgtgactgagagacccttttaggagagagcaggtgagtttgcctaaacaaactcttgtggcactgcattccaatactttttctacaatgactgcatatagaactcttttctaccatacaactcttttcatcagtggggaattacgggatgaggaatagactgagaaacttgagtgtaaggctgtattagtctgttttcatcctgctgataaagacatacccgagactcaacaatttacaaaagaaagagctttaatgaactacagtttcacatggctggggaggcctcacaatcatggtggaaggcaaggaggagaaagtcacatcttacatggatggcagcaggcaaagagaagagagtttatgcagataaactgcctcatataataccattagttcttctgagatgtattcactatcatgagaacagcatgggtccccatgattcaattatctctcactgggtacctcccacaacatgtgggaattcaagatgagatttgggtggggacacagccaaatcatatttttctgcccctggcccctcccaaatatcatgtcctcatatttcaaaaccaatcgtgccttcccagcagtctcccaaagtcttaagtcatttcagcattaactcagaagtccgtagtccaaagtctcatctgacacaaggcaagtcctttccatctgtgagcttgtaaaatcaaaagcaagttagttacttcctagatacaatgggggtacaggctttgggtaaatacagctgttccaaatgggaggaattggcagaagcaaaggggctgcaggccccatgcaagttcaaaatccagcagggcagtcacatcttaaagttccaaaatgatctcctttgactccatgtctcccatctgagtcatgctgatgcaagaggtgggttctcatggtcttgggcagctccacccctgtggctttgcagggtacaacctacctcctggctgctttcatgggctggtattgagtgtctgtggcttttccaggggaacagtgcaatctttcagtggatctaccattctgtggtctggaggatggtggccctctctcacagctccagtaggtggtgccccagtaggagcgctgtgtggggactccgacaccacatttcttatccgcactaccctaacagaggttctccgtgaagaccctgcccatgcagaaaacttctggctgggcagccaggtgttatcatacatcttctgaattctaggtggaggttcccaaaccccagttctttacttctgtgcactctcaggctcaacaccacatggaagctgccaaggcttggagcttccattctctgaagccatgcaccgaggtctacgttgtcccctttcagtcatggctggagcagctgggacacagagcactaagtccgtaggctgcacacagcccagagaccctaggcctagcccatgaaaccattttctcctaggtcttaaggcctgtaatgggaggggctgccgtgaagtcttccaacatgccctggagaccttttccccactatgttgaggattcacattctttccacgtaacttatgcaaatttctgcagccagcttgaatttctcctcagaaaatggtttttcctttttatcacattgtcaggctgcaaattttttgaacttttatggtctgctccccttctgaatgcctttaacaacacccaagtcacctcttgaatgctttgctgcttagaaatttcttccaccagatatcctaaatcatctctctcaagttcaagatgagatttgggtggggacacagccaaaccatgtcaaagactgattccttcttattaactgtaaagtattgtattcattcattcatgtattgataaaacacaatagaaatattggttagtgatcaaaagaagaaaggttactggagaaacttttggaggaacatacataattttacaatataaaaatgtaccttttatatttattttctagtgacaaaaacaagcattcaatagaaattaaattaacattcagtgcttaggtttttcttttactgctaaaatgtgagtagcccaaataatttgatatataaacatttatgaaagaacatgtgaataaaatttatgttgttttacccactatttctcttgaccctgaaaagtgtttttggtttagtgaaaaagatactttttataagtacattcatgttgttaatttatgaataatgcaaatgaggtcattttgaaatcttatagggcaaaatatctgctagggtccttcagttaatcaaaacacacgttaaacttgattctaacaggatcaggttgagccttgaacaaatttggagctgcaaatatattgaggagtttatattattggataatccagtaggtaattttgttggccactagtaaaataataatagtttgaataacaattgagtaatttgagccgtttggttattttattttactgtttatctattcattctttttaatgaagagtgttcaatgtctacagtgaattatactaagccttgaggatataacaataatacaggcaaggcctcaaatctcatgaaacttacattcttatgggaaaaacattgaaaacagacgagtaaactaataatttcagacagtgattagggcttcaaaaagcgaatgagggtaaagtaatagttactgaaatggggtaagatggtcaaaagcactcatctaaattaaaaaagtaagccagccaggagctgggtgtggtggctcacgcctgtaatccaagcactttgggaggctgaggtgggtgaagaacacttgaggtcaggagtttgagaccagcctggccagcatagtgaaaccttgtctctacttaaaatacaaaaattagccgggcatggtggcgggcacctgtaatcccagctactcaggaggctgagacacgacaatcgcttgaacccgggaagtggaggttgcagtgagttgagatcacaccactgcactccagtctgggcacaaagcgagactctatctcaaaaataaaaaaaagccagtataaatgaaggttttcataataatattttcataacattgaaaatgtcaatatggcaaaatgttagctctccccaatttatctatagaatcaaaataatcccaatcaaaattttagcagtttattttgtaaattgattctaaaatacatatgtaaatgctaagctttaaaaaagctggagcagttttgaagaaaaagaatgatgcttcttatgaaacaagttaagatagtgtggtataaactaatggaacagaacatctcaaaacaggcctacacgaatacccatgtttaatttatgacaaactgaagtatgggtcaaaaagtgtgtctttttttataaatggctctgggtgatttggatatctaaatagaaaataaattaatctctatccatctctcccatcaccaaaaattatgtgttcctaatgtgcatgtgataagtaaaccagtacaacatgagaagataggataatttcatcatgacttgaggatagaaatgcatacatatataataaatttatgagtaaaagtttagaaaattacacaaatctgaggcgataatggttactttgatgagtaatgaaagatattgtgattaaaactaatgaaggcatcataaagagttgtaatagtgttagttttggatatacctactggtaacataggttttcagtttgtaattattaaatttttcatgtatgtacattaatttggtgcacattttgtatatttgttgtgtttatattaaaaaatttaaaacaaaggcctctctgaggagataatatttccaaatttttatgtaaaatactgcaattttaaagcttttgggattatgcaaagaaatattgttcctcagtgagtattataagttcttcttatgagtatgtagcttttcatttcaatcaatgtgaaatttacaagttaaatgcattcaccccaaatctttacaaaaatctgttatccaaaaatttacccaaaattataatactaaccctatttgtctctgagtttcctcaatgtggaagtttggagagtcatttggtatgggcaaagaaatggtagaggaaagtatttattcagtcaaaaagtgcttactgaatttctactgaatgccaggttttgctcaaaccacaatggcataaaggcaaatttttgaaagacttaggaaaaacattcataaaaaattacattgtaaataataaatattagaaacagaagtatcaataaagaaaagcaaaagataaatgacaagtgacactttaccttaatatctagtaagtgaacattttgaggactttgatgagcaggtgtatatgtgtgccccactccttcctctgtctagaagaagaagttgttagtaaacttcaaagaactattcctaggtcagcttcaagaaatttaagaatccagtttagcactccaaaattaaagatggaatatggctcagcaatataaaaacaaaaatcagttagctattatataagatacatggagagaagtatgaaccttatattgacaataagaagtagctgaataatactattgaataaggaagtgacaagattgggtttgtttgttgtagaaatgactttagcagcaatgtggggacctgagtagatgggcaaatgcagaaagcctagcaggatagactggttgctcttaaaataggataggatgcaggagatgaggaagaattgaatcaaatccacagggtttagaatagaaaaacaaagaggggactagagatagatttaagagacagttaatagaatgaactaatgagatttgaggataagcaaaggacatggatgactagtttctacatggtatgctacatctacacggagatatatagcaaagggtggaaacagataaatgaagatatgcctcttttatggtcaccagtattgcttacagctatatctgtggttgctaagaagcctgcaaaatagagaagacagatgaagacagaaatttagtaaaggagtggttttaggagaagttcatgagattagaaaagcagggcatcatcatggaaacaataagaaaagatttccaagaaagaacaacgattagccgtaacaaatgcacaaagatgacaagaacaattttttaaaaaagaactgattttgaaaatggaaaggtcatgagtaatttttgcaagagtcatgtcaacataattggtcacagaagctcagttgcagtgttttgtgaagatggctggagaaagtaaacacaagtgtgaatgttgtttgtcagaaaccttagcacgctcaaaaaaattaaaacatcattaaactactatacatatagtcattgcattatttcttgctgaatagtaaaggtgaaatatgggcatgatgttttttgaaatcaatattgttaatcaaactcttgatgacagtgagacctaagtcatataaaatttagttacctttcaactgtaagtacactgttaattttaagtgcacattaaaagataaggtctgaaaaacataatataaggcatttagaaattgtaaaacacgaatctatgaaaaagttgcaatgccagtttttgaggggagttttccatatacatcatactgacttaatctatatttagttttacttctatgtgttctcatagcaaagtgtgcacacccaaatcataatactttctgtattttgtagcaatggcctaaatgtcctgctatctcatgttttagattgtcagctcccagaagatgagcttggacaatgttctttatatcattttacctgtaaggcatgaaatatgtgatgaatagatgaaagaatataggaaaacaatcatcagaggagacaagagaaaaaggaggtgatgttccacatgtactataaagaacaataaggaattgtagatttatgagaacaatgagcaagaataaccaaagttgtttcacttagaaatgtatttacaaaggcaaatatagattccaagtgaatcacaatagtaatctcaacagtaatcagcaaaattacaatagcaattacaagagtaactacttgttatcagagaaatgcaaaagaaaatagtatgataacttttttttgccttgcaaaatttgccttttagcttcttgacattggctttggcaattaattttgataccactccaaaaagctcaaactacaaaaacaaaagtaaataaacagaacagcattaaactaaaaaccttaggaacaataaaggaaacaatcaacaaaataataggcaatttatgggctattaaaaatattttcaaactacatttttgttaaggggttaatatatccagaattataaagaattcttataactcaatagcagaaaaaacaataacctgattttaaaaatgggcaaaagacctgaacagacatttctccaaagaagctataaaatggcaaaaaggtatatgaaaagatgctcaacataattaatctttaaagaaatgcaaatttaaaccactataagatattgccttactcccgtaagtatgattattatcaaaaagacgagataacaattgttgtcagggatgtggagaaaaggaaaccctagtacactattggcgggaatgtagattagtacagccattacgaaaaaactgtatggaggttcctaaataaattaaaaatattatattcatagaaccactatatgacccagcaactcctcttccaggtatataccaaaatgagatacaagaaccaccatgtaaaaatatctgcactcccatgttttttgcagcattattcataatagtcaaaatgtggaaacaacctagatacacgttgagagataaattgataaagaaaatgaaatgtgtatatatacatactcacacacaaaatggaatcttattcagccttaaaaaggggatatagatccctttttatatatacacaatggaatatattttacacacacacacacacacacacacacacacacacacatcttattcagccttaaaagaggaaatcccaccatgtgctacaacctggatggacttagaggacattatgctaagtgaaataagccaggcacaaaaataaaagtattggaagatatcacctatatgtggaatatattttttttaaaaagcttaagtacacacgcataggcaatgaaacagtgatttccatgggtgagcaggagtaaggggaagagaaagtggggagctgtaggtcatatagcaggtatgtaggatgaacaagtttagaggcctgatgtacaacattaggactacagttaatgaaattgtattgtagtaaggatttttgttaaataagtatattttagctactcttgtcaaacaaaaaagtaactatgtgagatgatagctacagtaatctatttcactatggtaaccactttactctctgtatgtgttccacagcatcaagttgcaaatttcaaataaacatgataaaatttcttaaaaagcaaaaatgaaaaacaaaatttgcctttcaaaaatatctaatgttgccagaattaggattgagggtgaaaaacacttcatacagtggtgccagaaacataaattttcatatttattaagtatggtttcactgtatctgtataaattttctgcaaccccatttctgggattccatcttgggaggtatcaagcaagtgcacaaggatatatgccctttgtacacaaaagatatatactttgtacaaggatatatgtacagagttgtttttacacagttgctcattagaccgttataaccataaaaatgaagttatcattaggagaatggtaaaataaattatactataggcgtactatatgctgtgtagctataaagtctttcaaagaagaatgtagtagaagtctacatctgtacccagaagaatgccagtgatttttttaaaatagatataacaattcagaaaaataggcataatatgactgacatcacttgaaaaataatatagaatggatatctgcttgtgcctaggaaaggcctagtaagaaaaacactgcgctattaaaaatgaccaaccctgtgaagcataaatgaatgagggaggatattttgctttataatgcttacttctgattttcaaatttttaaagtaaaatatttaaaactcctttctggaaaaaatgtactttattctagagaataatgctatgtttaatgtaactttgtgataaacaaaaacaaaagtaaaaagaagaatacagataaggaagtttaaatataggtgtaattcctaatttgtctaaaaataaaagtactcgaaatccatgaatcagcaggcccttgaagaatgagtggacaaagctgagcatgttattttaagacatatgtcctttttctaaaactatcagggttatggggcttgagagtatataaaacagcccgtagatcagattgtagctgaagggattcatgcttgcctttagttatgaagttcaaattggaagctgttcaggcagaaaactaatagaaatgggtgatagctaattaacctaaggcttcaaagtaattgctctgcaagaagcaatttaaaaagagaccttttatttatttatttatttttgaaaatcataaaatgccctatttgacttttggtgcatgagcaaaattatctgaatatacacaaatattgattttttttaaacctcttctacctgatccaacttcctggtcaattttcaaagaggcaaaatgataacaagaactatgctttatagcacataaacataccaaatatcccaggcttaagactttgccatatggtgagatataggaaaagatccctgtagtaaattttgctcagaggataggattatattggtcaaccaagccctgagccacatttctcatcactggagtcagcagagtcagctgctccaaagtatgtagctgttttggcctggccagtggctcactcctgtaatccagcatttttggaggctgaggtgggtggtttactttaggtcagtagttcgaaatcagccttgccaacatggtgaaaccccatctctactaaaagtacaaaaattagctgggcgtggtggcgtatgtctgtaatcccagctactcaggaggctgaggcaggagaatcacttgaacccaggagggggaggttgcagtgagccgagatcacgccactacactatagcctgggcaacagagcaagattccgtctcaaaaaaaaaaaaaaaagtatatagctgtttgatagagaagtggcttccctggcaaaaacaaggtgctattgtgaaaagaatgtggaataaatgtacaacatcccaaatcagccactatctgccataatctacaactctggcttctgaggacttctattcagcattcctcttacttttaaaaagtatccatacttacataaaatatattcatttcttctcaaagagaggagccccaaatttcctgcatttctatgccagttccaaacatagatgcttttggtagtatcgacttctctccctcagattagcttgataactctgatttacagcttctggcacttcagcttcctgtaggactcacagataaagataataacatctgggtgaagagtttctcatgagaacttctgatcctgtttaaccgcctctaaatgcaagttttattagcatgtagcctacataaagactgggaccatcttctcttacggttgtattaatcttaggtttttacattacacaatatgctacagaatattatatatttgaagaggccaggcatggtggctcacgcctgtaatctcagcacttcgggaaactgaggtgggtggatcacctgaggtcaggagttcgagagcagcctggccagcatggtgaaaccccgtctcaactacaaatacaaaaattagccgggcgtggtggtgcatgtctgtaattccagctacttgggaggttgaggctggagaatcacttgaacccaggaggcagaggttgcagtgagctgagatctcgccactgcactacagcctgggtgacagagcaaaattctgtctcaaaaaaatatatatttaatatatatatttgatatatatttaatatacatttgatatatatgtttaatatacatttgatatatatatttaatatacatttgatatatatttgtgatatatttgagatatatatttaatatatatacctgatatatatatatatttgaagagacaaattgctgaagaaatatagtaagttttctaggtatctccagaactcatgctctcagtaacttagactttccatggaacaaatacagaagttcttaagatgggtgctgtcagttgtccaagatccatttatttaacgtatttttgtcctgaccttcggattcactctgatgtggttaatttagaattctgttcatcatggactaaatattttaatgaaaggtagagccatttcatagactttaaaaaattcctcttctataatcagggtgagacagattttcctaaagcatgtgagctacagggtagagatctgaatatgtcaaaaaagctagcatgtgttgccaagaaaaatggagttaattctttgggacccaaaatgcatacaaagatctttaaaatgtcagtgttgtttatgagctcccacaatgagatttaaaactctttgaagaaagataccgtgttctaggattgtgtttgtctataggaacctgtaatggataatgaatcagatgtatgtggataattttatttcatcaactgctttataattatttacctcagtatgtattataaatgataaatcttctattattttgtttcttatattttacatatatatttgtatatagtgcccagctcttaaactgccatttataaaattattgttaactttggtcttggaaatgcaatagactttcaaaataatattatctcatggattgttcttgatttatataatattaatgtctgtttattgtcttttgttgcaggatttatttatacatgtggtggaactttaaaaggacttaatggcactatagaaagccctggttttccatatggatatccaaatggtgcaaactgcacatgggtaataatagcagaagaacgaaatagaatacaaattgtttttcagtcatttgctctagaagaagaatacgactacttatcattatatgatggacatcctcatcctacaaactttaggacaaggttagtgtgttttgaatggaagactggagagaaaatatttcctgggtaaaagtagtttattttacaaaagatgcttaacatttgtgatgcaattataataaagttgtattcaccatctaattattatttatttgaaaatatatcatcccatgaacaaattagcttggtgtctctgatgtcatattgctagtacattaatactatgtctcacaaaggtgaatatatattgagtggtgatctctttatagtggctaaaggtattttgtttttaaaaatgattatctcaaggtttcattcattatggatataacttttgataaagtaaaacatactatataaggtatatttcagtgataatatgtccaattttaatatacaacactatgcaaaaacaccttaagtcagcattcatgaatagtagaataaattaatttctgataatgtgtgtagtttataaaatctaaatatctgaaaactacatactttcatgtcaaaaatggggtcatttatatttttgcctctataaatgaaagtgttttttgaagcttattgattaaacagatgtaaaaattaactagcaccctgactatttttaaggtagttcttctggttcttcagaattttctcttggcaaagaggttatgtaaaattagaagtatttttgaggtcttaccagaaacttattttagttgtaaatcaactataattcaactaaaaaattcaacattccaagaattgcacattttatttagtcctagatttatgccagtgtttgtatacttttctttaagtgccataagcttttttaaacttgtaatttaaaatagtctaagaaggtaacatgtaggaattaaagactctttacatacttggctatgtttgagttatgattctctgatggtgttactttctaatagttgataacatgttcttgccttcctaatgtacaagaagcagattatcagtgctaactttttacagtttcatcagtcttccatattcctttgcatttatattttttcaattttaagtaaaaatttagtgttttagtgaaaccccgtctctactaaaaatacaaaaaattagccgggtgtcggggcgggcgcctgtagacccagctacttgggaggctgaggcaggagaatggcgtgaacccgggaggcggagcttgcagcgagccaagatcgcgccactgcactccagcctgggtgacagagcaagactccgtctcaaaaaaaaaagaaaaaagaaagaattagtgtttattttcctcaagttttggcaatgaaaaacataatgtagtggggaaaatggtggatctggagatgagatttattacattaggatgttaggtttgttgctcaccagctttttgagcaatctacgctacctctgtttaaactgagagatggtagtaaggccggttctagccatctcattatactgttctgcaggtattacgagaaaatgtgtatgaacctgctgcatgtctacaaaatcctattagagcacatcgaactgcttccagtcagatgacacttaaaaatgcctgagttatttcacaaactttgttgtgcaaaaacaaggttactaggttgattacagctaagattctatttttctttctttttttcctctatactcgtttaccgagtaaatctgatttctttttccttttacattgtaaactcatacataaacttttacattgtaactcatacaataatcatctattttataaatatacattatggtacgcacgtctgactgctgtttgatcatcattgccactgtcattaaaagctggtgtcttttgttaatgcaaataatacctataagtggaagtacaattttttacactggcaatctgtgggatataattttcctaaatatataaaaatacttctttcaatattacctgttagtttcaaagtatcaattccctgatagtaatgcttgtacatgtacctattctctctagattgccttgaaaatgagaaaacacatttttatttttcctctttcctgcttttctaaacaactgtggcctctgggaagttaaaaaattgcgaagttaggaaaataaatttattgttctcattctttctttcctaatctgtaaattgggaataatagcacttaattcacagagattttatggggaatacaatataatgaaagctcagtgactctaacccttaacatttattgaatgattcctctgcacctgtcactgtgctatgtattttgtgttcattatggtatttaacttctcctgtatccaaacaatgtaaaataattactattatcatcatcattttacaactgataaaatgaggcttgaattgattgcccgagtaaaatttttgaaagtggcaaaaggcagaactatcattacaattcagatttgtttagtttagatctgaagctcttcaatatatataattctatgtagttagacacaatctccaaagtttatgtattgatatataaataaaaatctattttttcttagcagtattggatcaaatttagtaagagaaataataataaaaggtatattttcaaacaggtgtaatatatacaaatataaaccgaaaggtaagctacaaatttatttttcctatttattttatagactatattcatacatgtactctatttatacaagcaaaatgacaagactatattctaacatgtagtctatgttataatatagtctttagagtctaatgttttgctcactgtaaacatttaacacatttattggtttttgtgcttcaagaagtactgtagttaatgttatagctgactttagttagcaagactggaaagaaaaaaattagtatgtaacctacagcccgttccagactgtgtttatatacaaaatctgctgtttgattagaagtcgaaactgctgctggcagagtttgattcatatttgcgtctggctgtttgactcactgttttcttgggttttgtttctctcatattggatcatattctcacttaatgcatgtccttatggtgtgtttgctgttctctttcttccagaaattgatatttattttttttacttttcatgagctccaatagattttttaaaaatggcttcttacacttgtcttgcaataatgtaggaaaaaaaatggtttgtgggtcttgtcattcttgcttgtataaataaacacactgggattcataatcagaatttcatattttaaaaactgtactctaagcctccaatgattaatgatattacttgtttttctgtaagttattttttattaaaagagaattgatattggcaaagcaccgttagataatttctttcttaatcataattttatcttagaacaagtgctgatgcatttaaggcaacattgctggaagcataaaggttattctaagccttgtttattttacattaatattatattttccgaataataaacttataccaacaagtaaaaaatcacctattatttaatgaggcagagacagatatatttacccaggatcattccatatatgatattgtatgtccttaataatctctctacattataatgtacatgtctaatgtgtgattagaatctttgtaaacattaatttattgaatttgttaagtatatttaatcattttatgtaagcattaatttatgcaaatatttaatcctgtggatataatttatgtaattatcattctattatatttttgttttttcttttataattaattcacgtattagcatccttatgaatatatattttctatattttagattggttcttggtagaaacaggatgtctaggtcagaagcaaataatattctttatattactaatatgctttccagaatcttatatcaatgaatattattacaactagaaaactatacttcattacctctcagtcttcccagacttacatcttttattcttaatttgattatttacatatatctgatttttatagatatttaacatattctcttgtttgataaccatgctggttttctcctgtaatttattttttgtctatgtatcaatatttttcttgatgatttacataattcatttattcttaaacatgtaaatatttcctttttgtgacaaaaatatttctcagcttcttggttgcttgttaaatcttagctgttttttctgcacaaataagtgaagaattttaaaatttttatatgatatatattatccatttatttaaagattcatttcatttcttttaatgttacaaagtcaagagctagatgttttataaattctcatttttaaattccttttcctaatttttaacatgtacaaccttaatacatatgaaatattatggaatgataatcttttctcaaagtggaagagaatgattatttctaaataaccaacgtagtagtatagttattttttaaaagacttgagtacaaaaacttttatttagtgtgactcctgacatgttactctggtctcctcattgctactttgatatggcctatcactttggatgtttggctgtaacagaaatcctgacttactgtagcttaaacaaaaaatttatttttcttatataacaagaagtttgttattatacagttcatcagtaaatcaaaagctttcccaaaagtccttagaaggattcttctcctatatcattggccagaacagcctgacatcaccatcccttggtcaacagtattctagaaaaacagctttcattttcaacctcagttgtggaaaacagcatggagaagactgagggccaggcaactgacaaaatctatcacaatatccaaagcttattttttggatattttgataggtaaataaataaatattatttctaaataaattgtttccaaagttgtgatttaaaaacagggagtaattatcacaaggtcatagtcatggtgtagtaatgactgcaacataaacttcactttcctgagttatataaacgtccatggattagaaatgttaaaaacaaatggataggtaaagataaaatcaaatgtaagtgtaagtgttaacataacacaaaatcttaaggcggaggcagataataaaaaagtaaatatcacatgttctcacttataagtgagagctaaacattgggtactcatggacataaagatggcaacaatagacactggggactaatagtgtggggagggagcgaaggaagcataggctgaaaaactgtcatgtactatgcttacatctgggtgataggatcattcacgtcctagggcttggcatcatgcagtatacccatgtaatggacctgcacatatactctctgaatccaagataaaagttgaaattataataaaatcattaaaaaaaagaaaaaactttgggaggccaatggctggagctcgggagtttgagaccagcctgggcaacatggtgaaaccccatctctacaaaaaatacagaaaaattagctgggtgtggtggcctgtgcctgtaatcccagctactctggaggctgaggtgggaggattgcttgaacccaggaagcggaggttgcagtgagcagagactgcaccactgcactccagccagggtgacagagccagaccctgtctctaaaaacaaaacaaaagaaaacaaaaaaacaaaaaacatctgccgtaaagaaattgaaagctgattttaatatgttggttgataaaagactatctcttaatttcttaaactaaataacatccagatgcatatataaactttgtggctctctttaacttctccttaaagagggtctacaggtggtaaagttcacttatacggggttgaaaacaataattataacttctatgccattaaaataaaagacaaaggaagtataagctatcacatcattaaaaagaattaattatcaaaatagaacgatacagatacagaaatatgagttctaaatattgaacaatataccaaattataattcattacagattttatgactgtatacataagaaagcttaaatgggcagggcgcggtggctcacgcctgtaatgccagcactttgggaggccgaggcaggcggatcacgaggttaggagatcgagactatcctggctaacacagtgaaagcccgtctttactaaaaatacaaaaaatcagccgggcgtggtgttgggcgcctgtagtcccagctactggggaggctgaggcaggagaatggcgtgaacccgggaggcggagcttgcagtgagccgagatcgcgccactgcactccagcctgggtgacggagcgagactccatctcaaaaaaaaaaaaaaaaaaaaaaaaaaaagacttaaatgatttactggatatttatagaactaaaaagaaaaattaatgtgttgctacatgtcaatatctcatcaatcatcattaagaaaaatcacaaaatatattatattgcaaataatagcaaaattttgtaatatgttgagaataaattccccaagtatgaaacagaacttagaattaaaaaaattgcagtctattgcaaaaacacataaagttgtaaaatagagaaacactctatagccatgggtaaaatgaactttttaaagctctcattctgtgaaatgagatgagtcaaaatgtttggttattaggtagatatagatttaatatcataagaaaaaactgccaaatagcttttctaagctgtgtacgcattttgtacttcaccatcactgtatgagaattctaaatgctccacacctttgttgacatttgaggttgtcagcatttattgtggtattattttgcacttttgtgatgcctaataatattgagcatgtgcttatcaaccatttatttatgaagagtttgttcaaatattttgtctatttttttaattgggttgtttgcttagtcttgatgtatcaaattataaggatctttgcaatctttatagcatttatttgacaaatacatgcattgcaattattttcttccaatctgttacttgctctttcattttcttacattatctttgcatgagttaaggtttctaattttaacaaagtccaaattattaatattatattttgttagtgctttctggtagtacaataaatatttgcttatccaaagatggaaagatatcctgtattttcttctgaaggtttagagtgttagctttatatttagatctgtgattcttcttgaagatgtgaaggagtctaagttcattttgttctatttaagcattaaagtgaagaagaattaaggtgtacattttaaggaatcctagaaataacaacttaataaattatgtgtcctagctggctgcctctggacacaattataataaagcatgtttcaagtacattcttaaaagtattacttgataaactaagttttttccagaaaaggctaggccttattttttatctgtatttctacagtaatattactcttctccctctttggatttttactttgtgactatatataatatttttataccttcttggtcattattctagaatatatttcattaccatggctaaattatctgaactttatatattcctttattaaatatcaattctttacccagtatttttttttcttgatacgttgagggatttaaaatatgtaacattctgtcacaattcatatttattatacaaacttgatggattgttgtcataaccatagaattcaaaagcctaatggacataattaaggaacagaaattagagtgaataaaccatctgtagcttgaattcccacttgtgtaattgttagaccatttctttttggttctttataattaacatataacaagtagaccttttctccttcagaaaatgttggcagcatccccataaatgtttttgagcagccactacacttattttcttacatggttagtatttcttctctcctttgctccctcaatgtcccatagaacttcctaatactcacaattaaaatctttcctcactatacttgatgcctcttttaatgccatgcaataatctgtttcctttcctgtaggcataatgttgaggtagagaatgactttccatgaaaattatccaaaaatatctaaatgccttaggtcatagaaacaaatgaccagagggtagttttattttatgtcagtgcactccagtgatttaactctacctgatgacattgtctcgcatgtctctatctccaagttttcctaaagattacattgagagtgatataactcaatccaattagctgacgataaagatttctcccttcagagttggaaccaacccttgtgtactgattctctctcttatataataaaacatctgggaaacgcagaggctctactgtctgactcaatggcatagagtgattgcgtgtatagctgtgtgctgaaatgacatatgtgatattaacaactataataatagttattatttattatttctcaataaataagaaaagcaatactagagttttgttatttatctataatattaatgagacacaccaagtgacaaagtgaactttgcttactgttggttcaactatgacctcagtcatagccttgtataaaacacataccccaggaaacagaagctgagtgtagaaatgcatttttctatatacaaacttgaaaataccattatattgtgtttagtatccccctacctaatactttaatttacaaaagacttactgcattgccattgggcattgggcatgcaagtgaattagaaaaaaagccaattaaaattttgatgcatcttaggcagttaatgattattctctttagttatcattacttactttggagcattcaaattaatgattgcatagatctcaaggacagataggatttctaaaacttttggtcaacataaaaggctctttcaaatctgactaaggcaaggattccagagtatacacaactatttattgtttataccaggcattttgccaaaaagaaatgaggtggcttttagtgaagaaatagactaaattaaaccattaaaactggggttaaaagatcaaacaaaagatgacaataagcaagtttaaacactttgttccttagattatatttattcaatcttttgtagtaaatctgtggaaaggtttacttccattagcctgctttcggtaaaacagcactgatatcctaaaagcaaactacacatgatgttgtaattgactaaaaatatttaataaaatatttagtaaagtgaaactcacgctccataaacattcattttctctttttttaaaaatttatttattattattatactttaagttttagggtacatgtgtacaatgtgcagattagttacatatgtatacatgtgccacgctggtgcgctgcacccactaactcatcatctatcattaggtatatctcccaatgctatccctcccccctcccccaaccccacaacagtccccagagtatgatgttccccttcctgtgtccatgtgttctcactgttcagttcccacctatgagtgagaatatgcggtgtctggttttttgttcttgcgatagtttactgagaatgatgatttccaatttcatccatgtccctacaaaggacatgaactcatcattttttatggctgcatagtattccatggtgtatatgtgccacattttcttttttttttttttttattatactttaagttttagggtacatgtgcacattgtgcaggttagttacatatgtatacatgtgccatgctggtgcgctgcacccactaactcgtcatctagcattaggtacatctcccaatgctatccctcccccctcccccgaccccaccacagtccccagagtgtgatattccccttcctgtgtccatgtgatctcatagttcaattcccacctatgagtgagaatatgcggtgtttggttttttgttcttgtgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatctctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtattttttggctgcataaatgtcttcttttgagaagtgtctgttcatgtccttcgcccactttttgatggggttgtttgtttttttcttgtagatttgtttgagttcattgtagattctgggatattagccctttgtcagatgagtaggttgccaaaattttctcccattttgtaggttgcctgttcactctgatggtagtttcttttgctgtgcagaagctctttagtttaattagatcccatttttcaattttgtcttttgttgccattgcttttggtgttttggacatgaagtccttgcccatgcctatgtcgtgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagcatgatgcctccagctttgttcttttggcttatgattgacttggtgatgcgggctcttttttggttccatatgaactttaaagtagttttttccaattctgtgaagaaagtcattggtagcttgatggggacggcattgaatctgtaaattaccttgggtagtatggccattttcacgatattgattcttcctacccatgagcatggaatattcttccatttgtttgtatcctcttttatttccttgagcagtggtttgtagttctccttgaagaggtccttcacatcccttgtaagttggattcctaggtattttattctctttgaagcaattgtggatgggagttcactcatgatttggctctctgtttgtctgttgttgttgtataagaatgcttgtgatttttgtacattgattttgtatcctgagactttgctgaagttgcttatcagcttaaggacattttgggctgagatgatggggttttctagataaacaatcatgtcgtctgcaaacagggacaatttgacttcctcttttcctaattgaataccctttatttccttctcctgcctgattgcactggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggttttctcatcagtaaaatggcataatcgaagtgaccatttgataatcttacagaaagcatattaatgttctcataaatgtaaatgtttttagtaacaaaatttttacataattaatatgagctcgtaaataaaatgtttagataagacattttagattaactcttcaaattcatttagttgtgttaatatttgatattctgaaggaaggtacatatactctgtatctgttaaaaactaacattctctgaatacatactctgtcaggctattcatatacaattctcataacatcatttcagatattcttcctaatattttttattattatattatattattatatatataatatatatattatattatattatatattataattatatattatatatattttatataatatatattatattatatattatattatattatatatacaggtgagaaaataaaatctcaaaagtattgatatctgtttcaagatcaaaaacaggatttcaagagactgaagtgtgaacataaataggttcgagcacagctcattaattgtatttatttgcatttttcaactatagcatttttggagtgatgaataagaagacttaagccaggcaaccataaaatcagataaatttattgaattatttcattgagtcattttactaaatataaattaaaatgtcacaaaggttaaagggtataagaaaagtggtcacatttatatcagggtccacttaaaaatctcatgtatatgacctattttctgttaaaacgtgacatacatctgaaggatattgtgccatcaaataatcatgtaaaaaggggacttttccttcatagatgttcaagtttgatgttataaagttatttaaaagatactgaacccatacagaaaaataattaaatttatcaacataaaaatatatataattaagtttacagtcacccagtttgttttcagaaatactaaaggcttttcagttgtatttttaaatgatatttttagagaaaaaaatcacaagtgtcacatatatatagcaggacagatagaagaactaaaatgtatagaatatagacccttgccacagccactgcctacatttttgtggtaattaaaaaaaaacataaactaatcagcaacctcatttcattcattttaaggttatgttttctaactataacagtcaaattatatctgagtgagatgtgattatttaaaaaaatgaaaatatataaaacagttcattgccataatatatttattagaatactagcgttaactctttattgcatccatttatcttgccatataaattttctatattctctattactatattttaagaatacaatttattcataataatatataagtctgtaacatacacattgtgaagtgctttattaaaatcagcaccaataagcctaccactaaacaaggatgctgctcacattttgtttcatttgtatcccatcctctccttgctctgacttcaccctaccagtaacaagcacctccatgttgtggtcatttttaacttttttcgaaattatactttaatcatacatgaacatgtatgaatcatacatgaacatccctaagcaacatcacgtttaattatgttaatttgtaagatttataaaatatatatcatcccatttagttttctgggacatgctttttttggctcaaccttatgtttctaagagttatccatgctgtggcatattgctgtagttcattttcactcattttaactcaattgtatgcatttgtcacacttgtataataaatatcgtgccctttttaaatttttgaattcagaggatatatgtgcagggtcattacatgggtatattgcttgctgctgagctttgggatacatataatcccatcaccaaggtgttgagtatagtacttataggtagtttttcagcctatattcccaccctccttcccctatctagtagttcccagtatctattgttcccatctgtatgtctgtgcatcttcagtgtttaactcttccttacaagtgagaatatgtggtatttggttttctgttcttgcattaatttgcttaggataatggcctccaactgtatccaggtggctgcaaagaacatgatttcattctttcttatggctgcacagtacttcagggtggatatgtatcacaattcctttaaccacataactgttgatgcatgcttaggttggttccatgactttgctattgggaatagtactgcagtgaacatacatgtgcaggtatcatttttatagaatgattttttatagaattttcctttgagtggatatgcagttgtggaattactgagttgaatggtagttctacatttagttcattgagaaatctccacgtggttttccatagaggttgaactaatttacattctcatgaaaaatatatgtgttcccttttcttcgcattcacaccaacatctgttgttttttttttttttttgacttttttgagacagagtctcactctgtcacccaggctggagtgcagtggtgccacattggcttactgcagcctccgcctcctgggttcaaacagttctcctgcctcagcctcccaagtagctgggactgcagacatgcaccaccatgctttgctaatttttttttttttgagatggaggcttgctctgtcacccagactggagtgcagtggcgtgatgtcggctcactgcaacctctgcctctgggttcaagcgattctcctgcctcagcctcccgaatagctgggaatacaggcatgtgccacacacctagctaatttttgtatttttagtagagaggggtttcaccaggttggccaagctggtcttgaactcctggcctcaagtgatccatccacctcagcttcacaaagttctaggattacaggcatgagccactgtgcccagctgttttttgactttttaaaaatggcaattctgactggtgtaagatgttatctcattgcggttttaatttgcatttctctgatgactggtgatgttaagcattttttcatgtgtttgttggctgcttgtacttattatttaccacatccactaacattctggtttttctagccactttctctccaattaaaggctcaatatgcttttgatatgccttcaaagttattgcaaacaaaaaatatattgtgttactaactgaattcaatctgatttctagaccatggaatctgtttcctcaacccccattgactacttaggcagggcaacatattttatgcttttattatagcaatataacacaaatagctattctacacatatttttcaaataagcatgagcagcaaaaaaaggaaaggaaaataattctagaattaacactatcttatttacaaattattaaatattctacattaaaaataagatattactaagaatgcagaacaaacccatgagtaatctctgagatagtcagttgaaaccaaattggttattatgtatttatcctttatcatacagacaaatctttctaaaaagtattgttgagcacgcttttggctaatatttatagcagcactgattggctcaatgcacttgtgagccagagggacatgtgagttctttaccagaagaaatacatttttctgtctctgttagactacagtataaaaattaatatgtattcaataagaaaatattcagtgaaatattttttactcctatcttccttcaacaaatatgaacaatccatggacacaatgttttgatataggcattgtgtgcagatcgctgctctagggatctcgctccttcttaccttcctgttcctcagtctctactgtttgctatcctttctgtgaccctcatctctagccagaccttgaactctgctttgtgagtttttcatctctgctatgtccttcggattttaccaaacatgtaactagtctctccaagctctcctccatcagcttcccaccttccaaaaagaagctactacaaacaaaccttcctctgttattttgaggttttcttctcttgtctttggatgataagagaatattaaaataagcaagatattacattaaatgatgagtacctactatcctcttgattaattcataattgatgctcaataaaatacttgctgattttaagtttaaaaggaatattttattatgaaacagatttaacaaattaatttgcttcttaattttgaggtcaataatgaaaataaaatgttgaaaatgattatatcaatttacagttgaagtgctaatgttataaaatgaatcccactattatcatatcaatgtcttgttattttagaaaaaaaaccttatttaggttaaaatacgtaagtattttcaaaatatgttttgagagaaacctagcaggattaatatccagaataaataaaaatcatgggggaaaatttttcacataaaatcttcatttttatttttcaacaccaacctaactatattcctatcatatcttccacatccaatttaaaaattaaattttaattatagtattaaccttatttttataccttctaattgctcttactattctctattatttgacattgtgcaagttcacacagctaatattgtacttactgtgtgttgtatcaaagcctgttgattaaatatatccagctttactgtgtatcaacaaattttaatttgctacatattgtctcttctgcttaatcacatctaaatttgtgttttaataaaagcagaaatttgatatttttctacaagatttcggaataactaaatgtgtcagtcaggtgcatgttacataaaacaatgactttgaatttccatcatggtaaaacgtctatagttgtttgaaattaaaatgtgtttctttatcaaaaaatatacaaaaagtaaatatataactaattaatatgaccagctcttggtgttgaataggctgaatagactatgaatctttttggttaggagcagctatatttgtctttgtatgtctgatacttaacataatactattatgatataaatattctgtaatatttgcctaatgagtggatcagaaatgactactagtttaaataaaatagcatttttagattactaattagtccagattaaactaaatgttttcttggtatgattaattggagtaatttattgttcccatctgatttactactgcatcaaattgttaggtaaatttttcatatttcagttctcgtggttaactttgatgttttctatgaacaatttctaacatgaaattccaaagtttccatcaaattccaagtaaaatattttcattcataatactgacagtatgtattgacagttaatgtgcgaccagattctagtatgtttaccctttaacaaatactgtactgacttaaacactatagttttatgataggtattgagacctaatagagtatcttatctatatttctagcacctaatttcataatagctacgtggaaattcttttctttagtttaatatattaacttaataaaacaatttaattcaatatatacaaataacacaatattttaacaaaatgttttgctttttctgatcaagcattgatatacttttcttacagcatacaagaaaggacaaacataaataatgttgtgtttaactttatgagaaagtagcatgaccctgtatctgcccattaccaccttctataaatgctttattttttcgcttgtgtttacaaggatgcaacttgaagccactaaattttttatctagttgttttctggaagtttatatttgatagaatgcagaaaaatggttttcgtgatggggcaactatttggaactacgaattagagacaatgttggctggttttctgacgtgtagagatcgtgtgttttctaaccaagaaacagaaggaggaaagacagtttctctctgccaactttttggtattctctatatctgataacataacattcatgggacactaattgccctgttagggtcaattctattgttcttctcatgaaaatcccttctagaatctggtcacacatttactttcaacaaatattttatttggatgtttcagaagctctctttctgttttgtttgtttgtttggttgggttttttttgagacagagtctcgctgtgttgcctggactggtgtgcagtggcacagtcttgactcactgcaacctctgcctcctgggttcaagcaattctctcctggtgtgttagcttcctgagtagctgggactacaggcatgtgccacctcaaccagttaattttttgtattttagtagagatgtggtttcaccatgttgcccaggctgttctattattattattattattattattatactttaagttctagggtacatgtgcacaatatgcaggtttgttacatatgtatacatgtgccatgttggtgtgctgcacccattaactcgtcatttacattaggtatatctcctaatgttatccctcccctctcccccaaccccacaacaggccccagtgtgtgatgtcccccttcctgtgtccatgtgttctcattgttcacttcccacctatgagtgagaacatgcaatgtttggttttttgtccttgcgatagtttgctgagaatgatggtttccaccttcatccatgtccctacaaaggacgtgaacttatccttttttatggctgcataatattccatggtgtatatgtgccacattttcttaatccagtctatgattgttggacatttgggtaggttccaggtctttgctattgtgaatagtgccgcaataaacatacatgtgcatgtgtctttatagcagcatgatttataatcctttgggtatatacccagtaatgggatggctgggtcaaatggtatttctagttctagatatctgaggaattgccacaatctgagaccaaaatgcaatcacactagaactcaggctggtcttgaactcctaagcttaggcaattcgcccacctgggccttgcaaagtgcgaggattagaggcgtgagctaacatgctggccctagttttctactattctattttaaactcacatattttccaatccactaaatcggcctattgctaaatttttaactttattttatatcattctttctgctctacctttagatagctaatattttaaaacagtattattttttatgttaatgttctttgatgggaaaacattttgttcttctaatacttaattctaaatgtctgtcttttcttcaccttcatattatatgtaaattgtggtggcaatagtgttaaattagtagaaagaacatgaattttggagtcagaaaaaaaacctcttttgaattatagttcttccactaaacaaacaggattgagcaaaccacttaacctttctacatgacagggtgattacagtcaacaataatttattgtgcatttaaaaataactataagagtataattgggacgtttataacagaaagaaatgataaatgcttggggtgatgaatgtcccatttaccatgatgtgattatggcttattatatgcctgtttcaaaatacatcatgtaccccataaatatatgcacctgctatgtacccattaaaaataaaatgaaaataaaaataaactttatggaaaataaggatataaaacatggctatttttacagtgttttgtggattaaatgtgtaaaacattaactcagtacatgacacccacatgatgttttacataatcattagtgaggatactcttgaaatcttggcttctatgactccgcattactatttatgatgttatgattctgttcctcattttctccttccgcaagtctgtaattaggattgtcctttattaaggtgaatgtcagtcacgctgtaacttattttttttcacagtcaaatagcttaaaatgatagtcaatatgggctactatagttcctcttttcctatttctattaataagcaataagttagatttgtcacctcactgaagctactcagaacaaggtgattttctaattatcagatccatagattaattttaagcattcacgttaacttcttacatcagaataatttggatacactcattaaaaatttagcaaaactaattgagagtcctcgcagaacagcaaaaagaaagtggcctaatttctgacttttccgtttgctgacaatgtggcctttaacgagaaatttatattctcataggcctttgttttcttcattttcaaaatggaataatataaataaagtcatgtatagacatatatgttatgggagataatgagataatgtatgttgaatgtttgattcatagtagaaacttaataactggtagcatttaacattatttcattagttaaaataattatgctgatttaacataaaaacagacaaactattattacattaacataaataatttaattttaaaagcatccttgaatttccttttcaagatagtttcatgttcctaattagctaaaattaaattaagtgaatcatatatatttggcaatgtaattcttaatgtaatacatggtaacaagaagacatatctaatggctcagagagtacagtgagttctgatgtaaaacagtatttagaattcatttaagactacctagatataaatccggtttcaatggagatagaatatcatttgtggaaatatattttttactcaagaaaaataacacttaaaccgtgatctgattttatcatcagtaaggtagtactcagttaactgtaactaaatgtaaagtatttatctattaattttatttcttatatgtatttttcttcctacatctttggtgagaaaaatgagaaaattattttctacccataaatagccaccttctttaatttctgtttcaaactatgactaggaaaacaaatagaaagaatttaataaagggaacttgttataaaagaagtgaagagatgaaagcgggtaaaggaaaagaagtgattcaggagttatttagcaaagaaagaaaatatggctagagagtgagaccgagggattgggctttccagaatacaaaacaaactgatttctgtgtgtgccatgtaccatgcactactgtggcacatagtggatatgggaatgggggaggaccatcagcagatgctcaccctatagatggggaatcatatggtcactgctgaaccacaaagagagggctgctgccaccaaagcagggatcctcaaagcaatacagtcacttccacagttgctaccagaagcaaatgaagagaaaggaagagagaaaggagaaataatagcttctctccacttctcagtttctaatctccaaattcaggttttggacatatgtctgagatgtggattagatatccaagtgggcacgtaaaataggaatcatatatatatatgtatatatataaatatatatgtatacttaaaggtcaggtaagaggttatctgaagataaaaatgtttcacctatgagagtatagatgttataatgttcagaactatattacatagtataaatagtaaaattttgtctctacccatgtgcatataacatagctagagtgaaggtgtgtcatggttgcaatgatttaacattggaacatcacaaagataatgtgtttagaaggaatttaaaatgggactctaaaacaaaatgcctgctggaacagtttgtttggttggttgataggttacaaaaatttagcaaaattttttttcatctttcttctccctactttcccatcactccaccttcttttccttctctgttttcatatttttaacatattagttcattttttattaggttggtgcaaaagtaattgaggttttcacctttaaaaaataatggcaaatcctcaattacttttgcatcaacctaataatattacctccaatgtaacttgctaaaattgtctggcaactgttaatataactactatgtttaacagcatgccatctcatatgttacctcaaaaattacatttttgtctcattcacaagcatatttcaaattctccaaaaaatcagtgatacttttgtgtgtaaattgtctattattttttgttcccaaagactaataaaaataattgataatgcttctgcatataattgtccaatttacatttacaaacaattttctcttcataatatttagtttccaaatatgcacatcagtacatagtttaagaatatgcttttgttttatgtatatttttgttgatctaatgataaaaaatatattattgaattttcttaaatttttatcatttacaaaataggattggaatattttgaatataaattagtttatgcacttacgaacatgactgtttaatattatgcttgccaatattctctctttcagaaattcaataacttataaattttttattttacattcttgtcatctaactacacaccatgtaagaataaactatttctatcattcttctattccatcaaaattgtacccaaatttcagagttatatgggtcccctaaagaaagaaataataattacaaagtaaactgtaaacattcttttaaactaggcattattaattgaatacctgggacacattaacagttataaaatatggtaaaatgctaattcctaaacctagtggatattggcttaaaaacattatgcaattattctaatcttgtctgtgatgtgtaagtagaacttctacttagaagtaagtagaagtagaaccttgaaaaatgaaaatctatcaaggaagttacttttattgttattttcactataaaatactcattgacatttgtctattgatatttattttacttcctttagtttttttgtgtagaatacacacctagttcaaacaaaatttattccctctctctgactttattgatgatttcatataactttgtgtacagtcaataacatatttctctattaaacctttcagtatctgatacactggtggctactcgtaggggaacaaacatcttgggtttccaggacaatggtggtttcttgtctatttccatagtgtaactgaaaacgagatgctctcaaaggaatcccaaattaaaaagtctatctactagccttatcgaaagtagtcagtattttttatttcttccatctagaatccataataccttagctttccttcttacatagaaactttattagcttttcaaagaaacatgcaattttccaataactgtccttaaatgcagtgttaaaaagaaaattttaattcccccaatgaagtcctatcgtagttatcatgaaaatgttaaatgattgaaatattatgatgagttactttaatctaatcactctgttttaatgccataatattagctgacagataatggggaaagtcacatgtattatagcagacttttatgtttaaaacagatacataatagacagcaaaacatttattgcaacttcaagtcatatttccatggttttcaacaactaaaatatatagttattagagtttactaaaatataattaaattggcatttctcatattagtaaatctcacataagtatccctagaatgttgaaaaatagaacattcaaatatatgaagacattattatgtaattatgtttactagtatttattaaccttaattattttcaatattgtgaagtagaaaattttatcattttatatttattatataaatgggtaatttaaaaaaatacttcatatagagtaaaagagcttataacagtacaagtaatttattatttaattttaaccatttttccaatttaaatgttagaatatggcctatgattattattttaaaatagtataataattgactgaatggcttttcatgtgacaagaaaataatgatcatttgaaaacactaaattagtccataaatcatgtctaaattcattaattaggtaaatgaccacatgtacgttccatgtcactgcattctcatgttaatgttttctttatgatgtattccaatgaagacagattatacttttatttaacctaaaatgattagaaataatattttgaggtgttatgttatttaccagttgtattgggatatatgcatgcatacacacaaataaataatcatctcagagggcagtggtgataattttataagaaagtgttattgggcacaatggaaacaattaatggctatatgtatcttgtaagagtaattgttatattctcagtaacttgtctctaatagctttgtaaataaaatattgacttaaaaacagaatcaaaacttttctgaaaaggttctccacactcctaaattttacaatgtctagatgaaactatagtagtttctttatcaaaacatctttaatcatcactatcataaggctttattcaaaatctccaattgcagtgctctttgtattttatgtaaaatgtatctcttcttaatatattttttaaaaatatttaagtcaacaaaactggtaatggaatagatcctcagaaacattctataattatttcagattaaagaaattatgattcatccttaccatggaacatatcacaaagattatttattatttgttggcatagattgtatgtgcaaaccctctaattactggaggaaattgacaaagaaaataccacattataatatatacattttaaatgcataaaaaataataaaagttgtgtaaatttcatgttttgctaaaaccgagagtgggtgctaattaatattacctttctgggaaatagaaggagccataaattttgagttaaattcttattgttgtggactggataagtggaccaaacaaaaaattgtcaatatgggaaatgcaaagcatgcatttgtagaatcgtgttttttgttttgtttcagtttttccttaatgaatatagagtacttgtaaagaaatacagtaaaattaacatgataaagtgtgtgcaatactttctgatagatatctttgaaatgcaccaaaaaaaggtggcagggtttatgggaggaagtcagttgactcaatctcagtaattgtaagttactaaagacacagatgtatttctctctctctctctctctctctctctctctctctgtctctctctgtctgtcttctaattgagaatcttcatcaatgctctcacctctctctcggtcataatttttttaaattgaccttaaataaataacttgtgatgagtctttactaattctacatccaaaaagatcaaaagtcatagcaatgataaacttagcagaaaaaataaacaacctagtagaacacaatagcatgtacttgaagaaatactacatttatcccaaatactccaagtttgttatagctatcaataatgtagtgcgtcaagaagaaaactctgagtggtgtgtgaaagaattctctaattctcagatctgtcatctttctcaagagtagctagtttgctaaatgcttggcattgttctaagtgatgtgcttgtattaacttatttaaacttgacagggacttaaagggaaggtaccatttcatctacattttgccactgaggaatcaggagaggcaagtaacctgcccaatgtcacacaacagtaaatggaatcactgagatttactccaggtagtccagctccagagttatcactgaatgagtttttttataattagatgaaccttgggtgggttcatcatcaaaataattatggtaaaaatcatattcagcatatgtcagcaactgtggtaagcttttacaagcattatcccaattaaatctcccaacataactatgggataattcctagtatttacctcatcttatccctagttttttggaataaagtagcttgcccaatattacactgctaataagcagcagaatgaatttttttttcaattgtatactctaaaatacaagcttatagtcactagagtcaactgcttcttagaaaccttagaaaaatatgctaattaacattttcaggagtttatacaaggtggggaaactgtaaaatatatttaaattgattaattgctctacataattttcctgtatttctagttttctcaatgattcaagatggcctttggaattacagtcatgtataaccttaaacgtcagttattcaatggaaaaaataagaagggggacattatagaaggtttgaagtatttgtagcataaagagaacaaattggaaaggttgacttttgaagaaaatttttagtagtgtatttcatgggtctggagaaaatgttgatcctgaagatcaaactctaaagtcaatggtaaaaacaaattttctggaaacatggtatctttaaatatagtgagctgagaatatctacatttttatcaatatccatttttgcaggaagaaaaagttttctctagaagattgtggtttatatttttctactttaaatatcagccatcatttttatttatatagaggaaaaaatgccaaaagttaaaataatgaaaattatgcatagttttacacaaatagttaagaatatactgtcaatatcatcttatctaagaattatttgcatattactgtaacttgtgctagaaatcaaaggaacacttttgtaacaaaaagagtgaaaataatttactagaaaataacctactttgaaattatttggagaggaaaatttcattaataggctggtagtctttttgcatttctcagtgctcagaccaaaaaaatgaaatatttcaagcaggaattcttttaataataagaattctaggtttaaggctggcttttgatggtcaaagatagccttcactaactttcaggtaatcaagaatttgcagaattgcaggaaaataccagtgataagctcagttgtttgcaaaatcaaatgcttgtttttaataagaattctgttaagtcaatgcataaacctcacctctaaaactttctgaagtccccgtacctacctgccatgacatcaacttttattcacattccaaatcttatggaagtgcttcactgacaaatatttacatgtatacccagcacatgttcccaacatggtgaatttgcctttctcacacgtttctttctggaattttatatttgatagaagcttcaggtcatttgctctcaacaaatgatacaattattcaaatgttgccacagccatatttttctttaatattactgccagtgacatcttgacataaccatgaattattgtgctgtgcttcatgtactccaatatcaataggatatgcatgatttattttaacagaacagccattactttaaatatcagcttgttcctgtggttttcttgtttattgtgacattaaataggctaatagtttgtttcagcagagaattctctgtatatccttggatcatttttaaggactgttgaaccaaagaaaaattataagataattcatatccaaaagtcttactgtgagtaatgtgaaatcactgtgcttatgctggtcgtattatataatatatcttagcattagcagtacagggtgcagcaaaaagggcaatggagtttgagtcacatcactaaagaaactaatatttaatgacaatttgttatccaaaaagtacactagatcatttcacatgaattaccttacttaacattcacaaaatcctgagagtttgtaatagtaccacttttatttttaaataaatctctctctctctctcctcttcctatttctttcttcatcagtcattctttactcctcgtcctctctcctttcctcctgcttccctttctctccctttctctcttacctcttacatccatgtctattttgcttctatcttattataagcagcaatatgctaataacctcttaatttaaaacgatgcctgttacatccattctttaaataacattttaatattgtaatcagctgttatacacattacatttaaataaatagagtcttttttttttacattcttagagaatgtatatgtgtggtcgttcttctcaactctcccagaaaaaataaaatcttacagttaaaacctaataaacatagttagatagtgagacaggtatcattcttatctataagaatgatgctgattcttatatgctttaacaagtctgatgctttaagaattcccatcacattaagttgaaatacagtatgttaattctcattaattacaaaatattctaaacgtacaatttattatttaaaaaacatattcattgacattttaaatggatttcttgcaatgtaaatttctatcactttttcattaattaccaaataattactttagtacttttcatattagttattgatagaaagttgtaagttaattgtttaattctccttgtgactagttattcatttcagtataaaatatcgttatcatttctaagtttttacagaggaaatatttcaagaatgttttcatccaaaagggaacatgagaagagacaggatcacatgttctaagtgcatgatttttcaaacagggaacaaaagcctctgatgagtttcttgtctagtaaaacataaaatgctaagatggggttggaggtgtatgtgggagtagggacaaataagaatagagattatcaattagaaaccataaaatttaaaatgaaaaaaaaaataccagctaatacattgcaccattctgtcagatgagaaaatgtactgaaaaaattgccatagacaagtcctggtccatgacaaaatattcaccaaataacagttgaaatgtaaaaaaataaatagaggaaaagctgtagaattttcatgaaactaaatgtatcaaaatgaaatgattattcattagtatgagtttacatgcatttttgaaagacaaatttagggtgagagaacatagttattgtcaagatgtgacaaaatattcactaataatcagaatgaatacagtttaatactttattggtcagccttaatttttgacatattaaaaatatctgcctgaaatttatattgcatgattccaggatgttcgtctcatatatttaaatgtttactaatcttacttagttttcccagtcgggaaatatctttgctaaccagtgcagttttcgctataaaggtgtcaccaactggcggggcggggtggctcacgcctgtaatcccagcactttgggaggccgaggcaggcggatcacgaggtcaggagatcgagaccatcctggctaacacggtgaaaccccgtctctactaaaaaacaaaaacttagctgggcgtggtggcgggcgcctgtagtcccagctactcaggaggctgaaggcaggagaatggggtgaacccgggaggtggagcttgcagtgagccgagatcgtgccactgcactccagcctgggcaacagagctagactctgtcaaaaaaaaaaaaaaaaaagctgtcaccaactagtcagacaatggctccccattgccttactcacctttaattcaatgacttcataataattcttaccacccacaactacttaaagttgtgatgtgggtgaaatatgttctattcattcaaaatacttgttaagaaacctacatgggcattgtgcaaaaaccaaaactgattaaaattttattctggcttcatagaaaaaaatcatttctcttatgggaaagtcctagtggattgaagtctgaagttactgtttttatctttgctccactacctgcctaccacctgcatgaatttaaacaatttacttatcattcctgagctgtgatttcttcaactgtgagtcaaagaaaataccgctggactgtggtacaattttcaaagaaacataaaatgtcattcactatgcaatttcatcgtgcatcaacgcggagggaatataactgataatgtagtaacgagcaatatatgcaaaaaactaaattttacaaatatcaaaaccagtacaaataattacatggaaaaatagcatacttatctataaaatagtatgcttttaaattacctagaaaacatgttaagtccaagtgaaaacaatatatttaaataccataaatttatagctcacattttaaagatacaaatcatattagctttaccttaaaataagttttcgaactatattgttgttcctagaaagatatgtcaaaaaagtgtgcatgagatatttatcttaaacttttgaggttaacatggggaaaacttactttctctgaacaagagtctctacttaagctatagaaattttcttaataacttaataacaataaatttatattcttatgatgtttcaagaacacaattcttagtgtgaataagaaattgttaagatggcatcgatattctcctaccatttcaactcattagattaataagtacttactgagagactcctccatgacatacattgacagaagcactggttttagactctgagtcccaaacactgacatctttttttttccataagtattggggtacaggtggtatttggttacacgagtaagttctttagtggtgatttgtgagattttggtgcacccatcacttaagcagtatatactgtactatatctgtgttcttttatcccgtgcccacctccctctcccccaagtccccaaagttcattgtgtcattcttaagccttttggtccccacagcttagttcccacatattagtgagactacatgatgttggttttccattcctgacttactttgcttagaataatagtctccagtctcatccaggtcactgcaaatgctgttaattcattcctttttatggctgagtagtattccatcatatatatgatatgtgtatatcgcagtttctttatccactcgttgattgatggacatgtgggttgattccatgattttacaattgtgaattgtgctgctataaacatgcatgtacaagtatcttttcaaataatgacttgatatcctctggataggtacccagtggtggtattggtggatcaaatggcagttctactttcagttctttaaggaatctccacactgtttttcatagtagttataatagattacattcccaccagtagtgtagacgtgttctctgatcactgcatccacacaagcatctaaggttttttgattttttgattacggccattcttgcaggagtaaggtggtattgcattgtagttttgatttgcatttccctgatcattagtgatgttgagtattttttcacgtttgttgccatttgtatatcttcttttgagaattgtctattcatgcccttagcccactttttgatgggattttttcttttttttcttactgatttgagttggttacagattctggatattagtcctttgtcagatgtaaagattgtgaagattttctcacactctgtgggttgtctgcttactctggtgaatgttccttttgctgtgcaaaagctctgtagtttatttaggtcccagctatttatatttgtttttattgcatttgcttttgggttcttggtcatgaaatccttgcctaagccaatgtctgcaagagtttttcgaatgttatcttctagaatttttatagtttcagatcttagatttacgtccttaatccatcttgagttgattttttataaggtgaaagatgaggatccagtttcattcttctacatatggctagccaattatctcagcaccatttgctgaaaatggtgtcctttccccactttatgtttttgtttgctttgtcaaagatcagttggctgtaagtatttgggtttatttctgggttctctattctgttccattggtctatgtgcccatttttatgttagcaccacactcttttggtgactacggccttatagtgcagtttgaaatcaggtaatgtgatgcctccagatttgttccttttgcttagtcttgctttggttatgcaggctcttttttggttccatatgaattttagaattgtttttttctaattctgtgaagagtgatgttggtattttgatggggattgcattaaatttgtagattgcttttggcagtatggtcattttcaaaacattgattctcctcatctatgtgcatggtatgtttccatttgtccatgtcatctatgatttctttcagcagtgttttatagttttccttgtagaggtcttttgactcctagcttaggtttattcctaagtattttaatttttttttgcagctatcataaaagggtttgagttcttgatttgattctccacttggtcactgttggtgtatagaagagctactgatttgtgtacattaatcttggatcttgtatatggaaactttgctgaattcttttatcagttccaggagctttctggaggagtccttagggttttcaaggtaaacgatcatatcatcagcaaacagttacagtttggcttcctctttactaatttgaatgtcctttgtttctttctcttgtctgattgctttggctaggacttccagtactatgttgaagaggagtggtgagattgggcatccttgtcttgttccagttctcagagggaatgctttcaacttttccccattcagtattatgttggctatgggtttgtcatagatggcttttattacattaagatataaaggagaacctatcaaattaacagcagatttctcagcagaaaccctacaagctagaaggaattggtgcctatcttcagcctcctcaaacaaaacaattatcagccaagaattttgtttccagcgaaactaagcatcatatatgaagaaaagatacagtctttttcagacaaacaaatgctgagagaatttgacattatcaagccaccactacaagaactgctaaaaaggagctgtaaatcttgaaacaaatcctggaaacacatcaaacagaacctctttaaagcataaatcatacaggacctataaaacaaaaatgcaagttaaaaaccaaaaacaaataaaaaacaaagtacacaggcaacaaagtgcacgatgtatgcaagggtacctcacatttcaatactaacattgaatgtaaatggcctaaatgctccacttaaaagatacataactgcagaatgagtaagaactcaccaaccaactatctgctgccttcaggagactcacctaacacataaggactcacataaactaaaggggtggaaaaagacatttcatacaaatggataccaaaagcaagcagaggtaggtgttcttagagaaaaccaactttaaagcaacagcagttaaaagagacaaagaggaacattatatgatggtaaaaggccttgtccaacaggaaaatatgacaatcctaaacatacatgcacgtaacactggaggtcccaaatttataaaacagataccaatagacttaagaaatgatatagacagcaacaaaataatagtgggggacttcaacactccaccgacagtactagacaggtcaagacagaaactcaacaaagaaacaatggatttaaactttaccttggaacaaactgacttaacagatagatatacagcacattttatccaacaaccatagaatacacattctattaaacaatgcatgaaactttctacaagatagaccagtagatagactacatgataggccaaaaacgagcctcaataaataaagaaaaaattaaaattatatcaagcactgtcttagaccacagtggaatgaaactggaaatcaactccaaaaggaaccctcaataccatgcaaatacatggaatttaaataatctgctcctgaatgagcattgggtcaaaagcgcaatcaagatggaaatttacaaattcttcgaactgaatgacaataatggtacgatgtatcaaaacctctgtgatacagcaaaggcattgctaagaggaaagttcatagccataagtgcctacatcaaaaagactgaaatagcacaaactgacattctaaggtcacacctcaaggaactagagaaacaagaacaaaccaaaccaaagccggtagaagaaaggaaataaccaagatcagagcagaaccaaatgaaattgaaacaaaaaaaattacaaaagataaatgaaacaaaaagctggtccttcaaaaagataaaatggatagaccattcacaagattaaccaagaaaagagaagaaatccaaataacctcactaagaaatgaaacaggagatattacaactgacacaaccaaaatgcaaaagatcgttcaaggctactgtgaacacctctacgcacataaactagaaaaactagaagagacggataaattcctggaaaaatacaaccgtcctagctcaaatcaggaagaattagacaccctgaatagaccaataacaagtaggaagattgaaatggtaattttaaaattagcaacgaaaaaaagtccaagaccagacagattcacagcagaattctaccagacattcaaagaattggtactaatccttttgacactattccacaagacagagaaagaaggaaccctccctaattcattctatgaagccagcatcatcctaataccaaaaccaggaaaggacataaccaaaaaaggaaactacagactgatatccttgatgaacatgggtgcgaaaatcattaacaaaatactagctaaccgaatccaaaaacataccaaaaagataacccaccatgatcaagtgggtttgacaccagagattcagggatggtttaacatacgtaagtcaataaatgtgatacaccacataaatagaattaaaaacaaaattcacgtgatcatctcaacagatgcagaaaaaacattgacatcttgaagcatagtatccaaaggagaaaaagatgtttaataactatgcacataaatatgaaattacaaaatgaagtcttataaagaaaaaactaattagactcataactgagtttatttttaaatcaattatacaacgtattacaagaaggagtaaaacaagttacctcaaatcctcataatgatacagctattatatgaaaataacttttaaaaaatacattttgttctctcattgattaaaattaaaaaaacaaaacaaatctcccattacacaacatgccactacatgctgattatttaaacatatatacagaaacccagcttttgctaaaagtgaacaattcttcacaatgttcttctctattactttgagtaacttaatgataaaagtgttctaaatattgcttcaaatattatttaatacaactgagtgaataccaatttgaaattgtatacaaaatgatttggatgttaatgtacacattaatagttcaaatatttattgtttctattttattaatgtctcaaagacaatcagatgccaaacagggtgtttaattgataataggaggcaataatacagttgtagtcttagacctggctcttctgtgaacttgatctagttgcctaattcttctcggtctcttgtatcttctaatgtaaggatgtaatttcatattatactatatatataatatctcatactatgttatcgctcttcatagagagatttttagtcataattacataaatattgccttaataggttctgaatgtactcattttatataatatcaacagcagtcttggtaacttagtcactaggtttcacaggacttccatattcaattatagaataaattagtatttatctagatattttaaaaatgtatattccaaaacccaggaaagaattgtatatcagttgtccattcctgctacaacaaattgccacaaacttagtagcttaaacaacacaaatgtattatcttgcagtctggagggctgaagtccaaaatgagtttaactgggctgaaatcaaggtgttggctggatagcattccttctggaaattataggagaaaatctgttttattattttttttaaatatgactttaatccttcttaaaaactcttagataaaatgattatgtctctaacaattaattccattttgttttaggttaacaggattccatctgccacctccagtgacaagtaccaaatctgtgttctcactacgtttgaccagtgattttgcagttagtgctcatggatttaaggtatattacgaaggtaagtgatggtagtggcaaacaaaccactgcccttaatgtaatctaacaaaatttttcaagtaggaaagaagaatcaacatttgagacaacatcatgttgtctcaaatcttgtcctgaaatttatcttgttattaatcattaatgtatagtaaaatgctatacttagtgggttttaatattttatatcactatgtgagaccattaaattgctacagggttacgaattaacaaaacggaattaaatgtgagagtaataggactctagacctgatttgtgtgtcaggcatcacagaccctaccctacagtcccttgtgctgtgccagtctaccagaaagtaaactagtaatctgtcttctctgaaagttagagtcaagagaagaagttcagaaagagacaagagttgacatctactcctgaaacagcctttccaggaataagatcaataatcccttaaaccaggaagaggacaactaaatatttctcaaaactgaaggttgtgttttttctttttcctagaagtttggtacaaactcagttggcatcaaaacctgatgccaaatgaatagaggacatttatgatctttatttatcacgcttagtgtggatactcatacatatcactaggaaaatatcgtttgataatgggatggtgcccaggctctactcagagtgtttaaaggcacagaatctacatgttttgctttttaaaaaatgtgctagcaaaaataattctgatggcaaaaataatttgttcttgaaggtttcagatagaaatcatggacttatcatttcttatctatgtgatttgacaataaaatttccatctaatttaggaaagagtccttttcttccccatagggatagtgtatcagatttcaattcatctccccaggaccatattacagaatttatcacatcaggtctaacattatcataaagagatacataaataccgtagcaagggcaattaatttctaaaccatataataattcaaaatataatgtgtttaaagaaaacaatcacatagtaaatagaattgtttcagtataaatgttaacatcttgcatgtaagggaatgtcttaaactaaacactaattctagtacagtatttttcactagaaaaaaaatcctctggctaataatttagtaaaatgctttctctgttttatatcctaaataatgtcagatagcagcagttttgaacattattttctacctaatacttttctgaactgtcttttgtgtagcaagggaggataaattccaagacttaatttcctccacggtgatagtaataatcgttgtttttctaaggagctctcacaatagttgaatattctttatcctggcaacttaattcatagtttaaaacactataaccacaaagtttaattttaaggtataattttggcaatactgaagaagaagttagtaatgcaattattttgtgctaagcgctcttaataaaaaacctgtattctgttcatcaaaatataaagatatttttagattagtttaagctttcaggaagtactaaatatattgaaaatgtacttgtgaattatgaggttggcatgttttttggtttggctgtcaggtttcatgaactcatactaaaaaatattttcatagctcccaattgtttctacatataccacactaaatttctgtccatctttttcacttaaggtaaaatagattcatatatttttgacatttaaatgtatgtttggcatgtgctgacttaaaatataggatacttgacattcagatagtactgaaggatgggttatcatactgcaaaatcttcaggtattgattcacagtatcttgttcaatgcatattagttttcaatttaacatcttaaaataatcttaaaaaactatctcagttttataagttaaaagtcctggtgttctttgctgatttctctgtttggagtcccacaaggctaaaataaaaatttcagtgggctgggtttgtatccaaaggttttggggaaaatctactttctggcgtattctgattgttagcaagatccagttcttcaagtttgtaggaccatgatacctgtttccttctggctgtcagctggggctgcccatagctcctaaggctttctctcctcttcacgtagaggcctcataccttagagccagcaactggtaaaaagaatcctcctcaccttggaatctttgatttcccctctgatgtatctgtctgctactttctccctccacacatcttatactccaggtgaagaaatttctcagcttttaaagtccgtgtgattggcttgggcccatctggctaatgaatgctaatctccgcatcataaagtccttaaccttaatcatatcttcaaaggctttttggccatgtaacatgacatatgtgcaagttccagagatacatttttggggaggtagaggggcattatttggcctacaatttcatgcttaagtctatgtaacatgatccagagggagtagctggtagcatttctatatttaactgtagccagtgatactgccagggccaactggcatattgtgaagctcggaaatcttatcttggaattacaaaatctgtctcccactcccctgcatttggatccagttttttttctgcagttacctcaaattacaactcttgccctgtgtatgatacagtaaaatagatctactaacctggacatcttctcaagtattatgcctgtatttttaaatttaatttaatttttatatttttgagataggagtctcactgtgttgccctggcttgtcctaaaccccaggcttctagcgattttcctgcctctatctctcaaagcactgggattacaagcaagagccactgctcctggtctcttacctgtatttttaaaaatatttttcaagctaatcctaatgtgtaaatctcatttctttttatttcatcctcctctatataatcatttactatttttaaaaaactttcctaagactttgtccttgtgtattagtatttatgagaccgtatttattactaatgttattcatttatctgtgtttctcaaattgtcaacactgaaccacatgcatcagctttatctggagactgtattaaaatctagaattcttggccccacttacatattctgagtcagactctgccgtggagccctggaatatgcattgtaataagagactcactgattcttatgcctactgagattgtaaattctatctttctctccctggaaagaggactaaaccagaccaaactaatctggtgtataataaaagctaagaaagatatttgttcaactggtatactgcaaagagaattattctggagaagatacttaatgtatctaaatctcattgtcttcatctgtaaaattgagataataattctccctacttcatagtgttgtgaggaaaaaaataatatagagtgcctagaataggatctaacataataaacagtctatacatatgaattacaatattgatagtatcatgatggtgattaaaagagtactttatatataagcatttcaattctatggggacatacagtatatttgtacaaatttctataatggagttaatatgcttttttaaaaaggctatttttatggtctgttcttttagcaagagctgttgaagtaatcacacattctctctctctctctttatttctctgcctccctccctccctccctccctgcttccttcctttttttctttctctctctctttctctctgtgtgtgtgtgtgtgtagctgaatgtgattaatgacttaatgttacaaatatatttctttaaaaatcattattaggtgagtaaaggtcatcaagctaatgaacaaacacattattctcagttaaggtaatgtgctgtaactactatgagatctttcaagacaatttagcgtattgaaattgatttaacttgcagaggagaaggtaaagtaggagaagttctacttattcactctctacatttttcaaactgtctatgatgaaagaccaataggtatctgtaattgcacaccaatacttttgtaaaataaaagctaatggaggaaatgttgcactgatgtcaatttgcttgaaagtacttaaatgcttactcttgatttctatacttcatcgtggacaagtaagaaattgtttaccaaagcacactggtccacgaaccagttctcaccttttcctttagtgttgctaaattatccagaatgagttatacagtctctactttcatactagagtgcagatcaatttaaaatattgtttaaaattaattttctagatcccttgatacattaaatttatattctttaggcaaatatttcatcttaaattccatatagtatccattaatagcaaaaaaatcaatatattaataatttaacaattctgtgtgcttggaatcattctatacatttaaaatttttatattgaaattatgattttcaaaatgtaaaaactttatgctttatttagaaatgtaaagtatacttttattttgtcaaattacaaaaatatttaataaagaccgctatcaaattctttacattttctatgatttcttttgcttcttaagtttcaaaaacctgttactttcacttattcttatattttatttagctctaggcaattgctaccaatttataagacaggaaaataattcagttaaaatataaaacatcattatgaatgtttctaagtagaaatatttctctgtattagctatacctgatagtttatcctaaatacaaaagattaatcaacatataatacaatgtaatagtttagtgaaattctgtcagatatcagaaaacactacaaatgagatccattaaatcagggtaggctatatttcttaaatactcattgacagtagaatagtcccattgtcctttatctgtgagggatacactccaaggcttccagtggatgcctgaaattgtggatagtaccaaaccatatatacagtagtatgttttctcagtctgataactgagaccacaaataagtatctaataggcaggtagcatatacagcttggcaaagggatgggtggggcagaacagaatagagtgctcatagattttatcatgctgcttagtgtggcctgtagtttaaacctatgaattgtttatttctggaatttttaaattaatattttccgatcttggttatcaatggtaactgaaaccgcaaaaaacaaagtcaccgataacaaggggaccctatagtacataatcctgctaattttattagagctgaggtttttttttaatgtattcaaaatgtttagcgttagacaaaggaaactaacttaaaatgtgaagttagaagtcacttaagttcacatatcccatgagtgggatctcaataatcaagaaaatgttttatttaaacaaaatttgttttattttaatttttataataattatacatatttatagggtatatgtggtattttcatacaatcatacaaggtgtaatgatcaaataagagtaattgggatatctatcacctcaaacatttatcttctctttgtgttggaaacattgcaaattcacttcactagttattttagaatttatatacaataaattattgttaactatattatccctattatgctattgaacattaaatcttattccttctgtctaactacatttttacccatgaaccaacccctgtttattcctccttccccactacccttcccagcctctggtaacaatcattctactctctacttcaatatgttttacaatatataagtagaatgaaaatagttccagatttgtggaaatatgttccgtattagatattatttcaataaaatattttagatgtaattgaataggttctgtattagtccattttaatgctgctgataaagacatacccaatactggggaaaaaaggaggtttaattggacttacagttgttccacatggctggggaggcctcagaatcatggcagaaggcaaaacacatttcttacatggtgctggcaagagaaaaatgaaattgcaaaagcagaaaccccaaacacacttcttacatggtgctggcaagagaaaaatgaaattgcaaaagcagaaacccctgataaaaccattaaatctcataagacttattcactaccacaagaacagtatgggggaaactgctcccatgatttaaattatcccccactgggtccctcccacaatacatgggaattatgggagtacaattcaaggtgagatttgggtgaagacacagagacaaaccatatcattctgccctttgcccctccgaatctcacatcctcatatttcaaaatcaatcctgccttcccaagcatcccccaaagtcttaactcatttcagcattaacccagaagtccacagtccaaagtcacatctgaaacaaggtaagtcgcttgcacctatgagcccataaaatcaaaagcaagctagttatttcctagatacaatgggggtacaggtattgaaaaaatacagccattccaaatgggagaaattgtccataacaaaggggttacaaggcccatgcaagtctgaaatcctgtggggcagtcaaatttgaaagttcgaaaatgatctcgtttgactccatgtctcacatccaggtcaagctgatgaaagaggcaggttgccatagttttgggcagctctgaccctgtggctttgcagggtatagcaccacttctggttgctttcactggctggcattgagggtctgcagcttttccaggcacatggtacaagttataggtggatctaccattctgtggtctggatgatggtggccctcttctcacagctcactaagtggtgccccagtagggactctgtgtgagggctccaatcccacatttcccttccacactgccctagcgtaagttatccatgagggccccacccctgcagcaaacttttgcctaggcatccaggcatttccatacatcttctgaaatatagatggaggtccccaaatcttaattcttggcttctgttcacccgcaggctcaacatcacgtgtaagctgccaaggtttggggcttgcaccctctgaaaccatggcccgagctgtaccttggccccttttagcaacaggtggagcagctgggacgcagagcaccaagtccctaggctgcatacagcatgaggaccctgggcccagtcaaagaaaccgtttttttctcctaggcttccaggtctgtaatgggacgggctgccataaagacctgtgacgtgccctggagatattttccccattgtcttggggattaacattaagtgccttgttacttagcaaatttctgcagccagcttgaatttctccccaaaaaatgggtttttgttttctactgcgtcatcaggctgcaaattttctgaacttttttgctctgtttccgttttaaaacagaatacttttaacagcacccaagccacctcttggatgatttgctgcttagaaatttcttctaccagataccctaaaatatccctctgaagtgcaaagttccacacatctctagggcaggtgcacaatgccaccagttttttttttttatgctttttgattatactttaagttctagggtacatgtgcacaacgtgcaagtttgttacatatgtatacatgtgccatgttggtgtgctgcaatccattaacttgtcatttacattaggtatatctcttaatgctatccctcccccctcctcccaccccacaacaggccccggtgcgtgatgtcccccttcctgtgtccaagtgttgtcattgttcaattcccacctattagtgagaacatgcggtgtttggtattttgtccttgcgatagtttgctgagagtgatggtttccagcttcatccatgtccctacaaaggacatgaactcatccttttttatggctgcatagtattccatggtgtatatgtgccacattttcttaatccagtctatcattgttggacatttggattggttccaagtctttgctattgtgaatagtgccacaataaacatacgtgtgcatgtgtctttatagcggcatgacttacaatcctttgggtatatacccagtaatgcgatggctgggtcaaatggtatttctagttctagatccatgaggaatcaccacactatcttacacaatggttgaactagtttacagtcccaccaacagtgtaaaagtgttcctctttcttcacatcatctccagcacctgttgtttcccgactttttaatgatcgactttttaatgatcgccattctaactggtgtgagatggtatctcattgtggttttgatttgcatttctctgatggccagtgatgatgagcattttttcatgtgtctgttggctacataaatatcttcttttgagaagtgtctgttcatatccctcacccacttattgatggggttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacatttaagtctttaatccatattgaattaatttttgtataaggtgtaaggaagggatccagtttcagctttctacatatggctagccagttttcccagcaccatttgttaaatagggaatcctttccccatttcttcttttttttgtcaggtttgtcaaagatcagatggttgtagatgtgtggtattatttctgagggctctgttctgttccattggtctatatttctgttttggtaccagtaccatgctgttttggttactgtagccttgtagtatagtttgaagtcaggtagtgtgatgcctccagctttgatcttttggcttaggatcgacttggtgatgagggctcttttttggttccatatgaactgtaatgtcgttttttccaattctgtgaagaaagtcattggtagcttgatggggatggcgctgaatctataaattaccttgggcagtatggccattgtcacactattgattcttcctatccatgagcatggaatattcttcaatttgtttgtatcctcttttatttcattgagcagtggtttgtagttgttcttgaagaggtccttctcgtcccttgtaagttagattcctaggtattttattctctttgaagcaaatgtgaataggagtttacccgtgatttgggtgggaacacagaggcaaatcataacaggtgctaaaaattttattaaattgttaattttaaaaagctactcaaaagaattaaataaaatctttttgatatatgtattaaacacatttattttacaaaccattttgacatttatattttgcaattatcttggattccagcattaattgtagtaaaaggactaaaattcatgatagcttttgccctaactcctaaaaactaattattttattctttcattcagggttctgttgattccctatataatatcacgtataaaatatatctgaattttttattggatcaaattatatccaaaggaatgggtgacctcttgactataaaagctatgcatatgccacattttttccattagtggcatagaactatcatgaagttctacttaatatctcaaatgtggaataaacaattaattaaagtaagtcagtctgggatcttcagagatgaatttctccattttcaaagtgtattttagccttctttagcccatttactttaaaactgtggaagttgatattcctgtttcttaaatattgctagagtttaagggcctttaattatgtattggagaccctttactctgaaacttcttgcagtcgaatctgtgaactattaaatttctgcagaaaaattttctaatgaatatctagttgcatatatctctagttttccttattatgtctgccatacacttgaatttctgaatttctaccatacacttgaatttcccaaagtttgtttcacagaacttaggttttatatgttttaatgttataaagagccaaatgagtaaaaagttcttctgagaaacaataaaattgaaaaaatattaacttatactaagtttaatagtcgtataaccatttgtcaaaatttgatcaaggtgcaattgatgagatatgtgttctgtggaacaaagggtggggagtgctcttaagtctttctagacctgccaaacaatattctaaatgcattctagtttctgataaaagttattttgtaatatagaatccttttaaacttttctttgacagatgcatagtcactttttataggtgaaagagtatatgagaacctaccatggaatatcttaccatcttaggaatcatttattatggaaatatggtaatatagttcaagcatttagaggaatgtatatgtatatgtaattatatgtatgtattatttaatatatcatttataatgattatcttaagatctgggatgagctaaataatttcggcatgtatcagttagacaatataattatcaggaacagttatataatcaataaaattatagtctttttgtatagttttgcattttctttattttttatttgtgcaaattcatgagatacgtgtgaaatcttgcaacttgtataaaatatgtagtgattgagtcagatatttagggtggccatcatctgggtacaatacaactttgttaactatattcatcctactcggttatcaaacattgaatttattccttctatctaacttaagtttgtaccctttaacccacttctcttcaccctccccttcttccccattcacccttccaagtttctgttttctatcttcccaccatctacctcatttgatcaaatatcttagatcccacatataagtaaaaagatgcaatatttgtctatttgtgcttggtttatttcacttaagatactgacctccacttccatcgatgttgctgcaaatggcatgacttaactcttttttatggtcaaatagtattccattgtgtgtattttctttatctgttcatctgttgatggacactttggttaattccatatatttgctattgtgaatagtgctgcagtaaccatgttagtgcaggaattcctttgatatattgatttctttttctttctgtaaaaagaaatttctgtactggaatttctgtggaatggtaattctatttttagttttttaagaaagctccatactgttttctatagtggctgtactagtacccattcctaccaacagcgtataagagttcccatttctccacatcattgcacatctgatactatttgcctttttaacaataataattctgattgggacaagtgatatctcattggaattttcatttgtatttctctgattattagtgatgttgaaatttttttcatatacctgttagcagtttgtatgtcttcttttgagaaatgtctatttgtgtcctttgcccatgttttcatgaaattattcatgtttctcctgttgtgttgtttgagttcgttttgtattctggacatattagttcactgttggatgaagtatttgcaaataaagaatatacattgaaaaccacttcaaacacaaggtacttactattctatgattgtcgatgtgtattactaattaaaacattatagaaaaaatgctcacatttagcaaatttgctaataaatcattctcacattttaattcagaaatataaaaatgtggctaataacactactactactaagaaacatttattaagttatttatatgtgccattcacagctattttacatggattatctcaccctacaaaattacatgagaaatagtaaagaccaataatttaacgaagcacttactataaaaaatgtatttaaatgtcttacatttgagaactgtatacattttagaaatttaatttagaactgttagctgtgattccacttagatttaaatggatatgagaaaatataatttagaacaaaaaacattgcttaaacaagaatgtatattaaaacaataggtaacataaaatgcaaaatacacccttgcaaatattatgcatgacttatataatctttgtctttttaaaataatgacatataaaaggatagttttactatttgccattctatttagttctctgtcaaacatgtttattagaaatttatccttgagagcattaaattactttagtttttttttttttttttaagtttaggggttattttcaactactaagctttaaaaatctaagtggcagtatcatgaaatttaatagagagcttacaatttagaatcaagtcaattatgcttctggcaaaacagttggattttagtaagataagattatgttataaaattccatttattaaacagtttgctaggaataaatttaggttaggttcataaaaagttaatggattttcattcttaaatacttctaagaataaatgagagttactatatttcaaaaaacagaatacgaggaaatgtcatacctgcaaagaccttgacctttgtcttttggtcaaattcgaatcttttgtctttagaggcccataaagtcaacctagttagtcatggaaacaccctaatccacaagtgactttttagctaaatcatgagtatctctctaccttctaagcagttgtaaatgttcaaaatcctaatctagagaataacacaaatcagtttattatttaaatataatcttcaaaataaagaaacttacaatgaatattcagattcggctagatataaacaataatttattaattttctagtcattttacatattttatccaggaaggtataaatcacttttactgtattaacaggaaagtttcaacagattagcaatactatagatgcttttagacattaagcagtaatattttatcacccccattttagcttagtgtagcatacacaacctgtacaaactacctatccctccagcttcatttctagccagggtttacttcaatttataaaacaattgaattaacactattaatgcatatcaaacttttgttaatacatatactgtattatttgaattacccagtcttaacccaggctatttttttttgtttctgctcagaacaccctgcacacacttcacttattggctcacatacttatctttccagacattatgcaggccttggttaccttcaaaaaatcatagatttttgaatgctctttctctctatgctcagatgtgtccataccttgtctcaattaaacaattctagcatgcatattaaaatgataaattatagcacttgacagatatgacacgtttagcaacatgtataaaaaatcattttggatttttcactcacagtaggctgtgagaagcttacaagtatagaacatgttttactcattttgtgtacctgcctctggtttcaacatattcctcacatgttccaagcacttaataaatgcttgttaaactcagctgatatacagaccatctaacaaaaaaattgattagtaatgaggaatggtttaatacatctcctacgttaaggaattaaaactccaatgaatgtgtttgtgttaaaaggcagacatgagctatatttaatcacttagaatttgtgatattcatacatatttacattaaataattaaggtttagggaaaatagccttttattttttaaataattaaaaatagacgaaattatttatgattttaatgaatatttctttgtttaaaaatatttattttcttaggttaaatggttactttttgaagcatttcaaaaatacagaattgcttatgtagcacaaaaagaaaaacaagctgagaatgaaaaattgcttaagttagtgatatatgacctacataagctttgtgcttcatgtgaaaaagatgggatggcataaaaggctttatttcattctccagaaataaagtgatcaaacttattatgtaatcctgtttcacaatgaatttccttcatatatatatatatataaatatagttgaatgtgttatacttatcaactgctataatttatcattttgataagtatgtaagaatgaagtttgatagagtgattatttcagattctaattatatgtaaaaggtattttgctatttttcactcaaaggccatacagagtaatagttgttataattgatagtgcaaaaatagtggtataaagttacactatgagcttgctttagaaattaatatgagaatttaatttccccttcccaaaacttagtaaactgataaaaaataatttcatactattatttgatgctaaatattgtggtacatcataaaaaataaacttgaaatgaattcttccttattaagataattattctttttactatatcattttaagtatcagaaaaaataaagtaaaatgtacaaatcaaatactgcaatagcaataataagtctcaattattttaatatggtggctatacattatactatgctagataaaattttcagcatgaataaaataatagcctcaaatttcattttctcagtacttgaaataataactatcagctttaacactgataattattaacctggtatcacaaaggacaagatagtttgtaaaatgttttcaatataccaaaaaagaaatttcttacacagtatcatatgttgattttatctagaatattcttcagattttatatgttcttttaatcatatatgttcaagtgaattttaatgctaccaagtgtgagaaattgctatcaaaatcttaattaatagaacaccagaaaaaagaagcgcccaaaagtcgttttcatttggtcataggttgagggggagtataattttagttcttgcaaagtcataataacaggctaaagtaaatgggaaatcaatgatgtaaaatttaaaggaatgcaagaagctgagcaatagtgattaataatacattttgaaggatatgatgttttcttttgtcaggaaatgtgaattgacctcaaagcactggttgtgggactttagaattattcagaaaactaaatattgattagttattgttctttttatttaatgattacagtaatgatggtatttccaagtatgtagtaaaaataattgatcttctaaattgttttctttatattcatttgcagttataataatttctttgactgcctgtcatctttgaaggcacttatcaatatttttggttctttcactgtgctttcagttgaagactttatttcacgtgttacaaagagatctctggcagtgtgctcttttggtcgtaactgacaagcacaagtcttcactcactatcctttatgcagtattatattgtgcctttccctgtggacagaccatagcatttaatttgcctagggatattaaaataaatctttaaaaaatgatcattctcatgtatattggttttatattgctgcataacaaacgaccacaatttagaggattaatacaacagaagtttacagtcttgtagttttgtaggttagaagtctgagctgcagtcagctaggttcttagctcaggtcttaaaaggcttcagtccaggcgttggcagctctgtgattcatgtctaagactcagggtcctctttcaaccatactgattgctgatagagtttattttcttgcaattgtattattgatgactctattttcttgctagctattgactggaaaattttcttacgttttagaggctccctttggttcctatccatgactttctcaaagaccgttcacaacatggctttctttcagcagagcaggaatatatctctatatttatctccctctttagttggctaaaaagagttttatacagcataatgtagtcataagagtgactcttcaatcaccttttgtaatatagctttacctaatcaaaggaacaactattatattagctgcataattccacctgcactcatggggaaggagtggaaatcttggagccaatagtggaattatgcctactatattatgttgagtgacttatttagatgataattcaaaacaagtatgtacaaagacaaagaatagaagattaaaagatgcattttataattaatcaacataatgtactttgctttacctaaaaatatatagtcaatgtattcttcatatttttcctcaaacttattttagtaaataaattttgggggcaaaaatagtgtatctttgtacttcctcttataggttacaaacatttcaatcataatcatatattatgcttcaaatggcttcatttgtcaagatggccacattttaatataaatgcatcttctaaatatatatttcttctttgtaagacatatatggtaatagaagaatcacaaatatgctaacagggtgtcaaaagacatgacctttaatgctggctttatcactcagatactgtaaattcttcaaaatgtgaagtggaaaatataataatgattctacaaggttattttgaagataaggaaggggagcaaatgatacaacatccacagagcaatacttggcatgtaagcagcatttcatatatgttagctagtatcttttctgttctaccatatagtttaaatataatgaatatgcccatgtatactataatgtttggaggtgtctttcaatctccatttggtcaaaaggaacaatattctaatatttattttgtattttttagagggttgttgaaataagcaaatgtgtttgcactgaagaatttaagaaatggcacccttaactggggcttcccagaaatcacaatgttgccaatgaggtaaataattttcagcttgaaccaagggaagaagtgacacttatcacacatgcacccacacacgcaaagctcttccagttgcaaaattaaaaccctcacagaggctaagggaggtagttcactgaagagttgcagctctgagataaaggtcaatgctagagacagaccaattcatttaaaaagaggtcacaatggaagaatgacaaggcttacacagaagttaattgaaaaatacatgctaattagagtcccttaagtaattgtgtaaacaaaaattcataagaactttattgataattatgaagtccctgaagcaaacaaacattttgtgcagacattatggccataagagatgatacctggaaccaaaagtaacagttataaactataacagattattattttggtaagtttaattaaataccatgtttcattccatattgacaaataaatagacactatggaccaatctgtatatacttcatacttttatcaagaactcggcccatctgtatgtacttcacttattgtcaagaactgtaaagattcagagatttccattccactgtaaagacacatgcacatgtatgtttcttgaagtactatttacaatagcaaagacttggaaccaacccaaatgcccatcagtaatagactggataaagaaaatgtggcacatatacaccatggaatactatgcaaccataaaaaagaatgagttcaggtcctttgcagggacatggatgaagctggaagccatcactctcagcaaactaacacaggaacagaaaaccaaacaccacatgttctcactcacaaatgggagttgaaaatgagaacacatggacacagggaagggaacatcacacactggggcctatggagtggggcttaaaatctagatggcgaattgataggggcagcaaactaccatggcacatggatacctatgtaacaaacctgcacattctgcacatgtatcccagaacttaaagtaaaagaaaaaaaaggattcggagattttatcattcttgagagttaacaagttaacatgtcacagaatgcacaaaactgagacaaggacaaaggactttttaatatacagccatagaaatagccagagtttcaaacttgtttgggttcccagagcctcaatttccacaaagcaatcagtagagagctgatgatacccccacacatagtgactttttacaggagaggaactccaagaactggaatttgttatatttatgaaggtttgaacatgaataactgaacaaaacgtgttgccatttattgagaaagacatggtgatgagacaacttggattcaggaatggcataggattagaaaacaaggtaggtagttatagtaagttgactgcaaaacaggccaccatttcttcattcaatcctgcctgtattggtccattctcatactgttacaaggacatacctgagactgggtaacttataaaggaaagaggtttagttgactcacagttccacagggctagggagggctctggaaacttacaattatggtggaaggggaaggaaacatatccttcttcacaatgcagcagaagaaagaatgagggctgagtaaaggaggaaatccctgataaaaacattagatctggtgagaacttactatcatgagattagcatgggagaaaccacccccatgattcaatcacctcccactgggcccctaccaccacacatggggattatgggaactacaattgaagataagatttgggtggggacacagccaaaccatatcactgctcttatacaacccttgagtataattactgccacttagtaattctcacattattcttcctcttttcagactttaaaatattctccatttttaacactccttaaagcattttcatagctttccctcccaggatgccccattttttaattttctccttatatatctttattctttaaattccttgtgtaagtcctcctgctttttatttctagatattagaatggcatagtgctcagttttggggctgtcatctctacctacactcatgttctacatggggcaatctacaccagtctctaaaataattatagaaactctgaggatatatttcatttagctatctccatgaacatagaaaacctcagagtcattcaaaataaattcttattgttcaagcttctgaagggattggctgttattctggtgatcttgtatggactcactcatgtttctgcctgaggctaatccacttggcctcttataggacaatatctcatctactagtacaattattttaagcatgttctcatgcctatagcagaagtgcaaacatgggaaaatgaaaacgtaccctttatcaagttctgattgattcagtctactaacttctcattggctcaagcaagtcacagacaagagaaggatgagaccacaagggcatgacaaggctatatggccaaaggcacatataaggacaggatggaatgaagaaatggtggcatttttttgcaatcaacttgctgtaactacctaccttgtttttcaattagatatctttcctgaattccaaattgtctcatctccatgtctttttcaataaatggcagcatcatgtgtttaattgttcacatccaaaaacattgggattttctttcattctaacagcttatatccaattcatcagaaaatattaaatcaacatatatttgtaatcttaccacttcttatggtctttaccactaacactctactcctagctactatcgtctcatccctggaccaaactagactactacactagactcctaacaagttccctagctttctctcttgcctttttactgctgaattttctctaatagtcatctcttaacgcttccctactcaaaaccgttatattcctctgctccgttaagcctttgagacatatgcttatttaaatatttactcttccatctccaggatgggaaactttttcttcccagtccaaaacataatatagcaataatatatgtgtaccaagcagcagagaagatgaagggaagaaagatgggacaaatattttcctaaggaagattcctagaagctgtgttatgacacttctacttatatccaattggccagattatagccacatgaaacttggttacattggttgctggagaatgtagtctttgagtgttaatatgtcccgctaaacaatatattgctatgattgaaagggatagagaccaataggagacaactggcagtctctgccacagtgtcagaataacaagcagcaaatattctcgtgtactatctttttataaagatgaaaatactctcgttctactagtaaaaatggcatggaatacagtcctgtctatctattaatgtattccaaaacatacaataagcaccaatcctgttttggccattatgttttgtgtcagaaaatctttaatagttattttggtagagaaacaaataaaagcaactattattctaacagctttcatgaggaattcatatcattttttattttgtcataaacaattcttcagatagtgacttacagataatagtgtactacagccaactcagatgtggtcaaaagaacaaattgtgcagttgacctttttttccagctgcattcagagttttcatcttagtaccttgaaatcaagtatgttggcagtgttactttacataaatcagcaaattaaaaaaaatttttttcttagtgtgttatttttttcaaattccagtatgtttataaagactcatgtttcactaaacagtgtatttgttgaagttgatgtgagcaatttatgtttctacacttgatacagtgtgagatgctttaatttgccacagtagaatggctggatatttagctgactcattgcagaaagttattatctaatttcctgatgttgagtatgaaaagagttagacattgtacatacatcaatgttttgcaaatatttcaaatttctcctttgagaaagtattttactcctttctcctttcctataaaggatattacaaaggatactaatgaacaccagatgaatagatagattagacaagggatgagggaaagggtacagagcttccagagcatctctgggtttgccactcttgaggaaacttcatgtgttcaggtatgcagaagctccggcagttttgtcatttttatttatttatttgtttttgagacagagtcttgccctgttgcccaggctggagtgcagtggtgccatcttggctcactgcaaactccgcctcctgggttcacgccattctcctgcctcagccttccatgtagctgggactacaggcacctgccaccatgcctggctaatttttttgaatttttttagtagggaggtggtttcaccatgttagccaggaaggtcttgatctcctgaccacgtgatccgcccgcctcggcctcccaaagtgctgggattacaggcatgagccactgcgcccggcccgttttgtttttatttattcttttccagagagccagttgttaaacacttaaccagcccatggtagtagatagaggctgattgaaactaaggtctcattctgtacaccctgcactccttcctctattaacattcatgtaaatcagggctttccagacttcagtgtttataagaactatctggtaatctggctaaactgctgattcttattttacacatctggagtggggctcaggagcctgcatttctacgtaatctaatatgataccaatctttccatcctacacactacaaaccacttaatgcaaaatcttgtatattttgcttaaaacttgcaatgtctgtttggtcatcatgttattccaaagtatcatcactaagacatattttggtggcttcagtaaaagttgtaattgttgcagccaaactatcctactcctccttaagtaggatggattaatttgatgccagttattttttacagttagaaatagaaatctgctctaaatgaggtttctgcactccactcatcagcttcactttttgttgttaggaaatacattcttgacaattgtaaagttatgcaatatttccaattgtttacttctgaagaaactcagttataacttttcctagtgagcacattgtaaaatgactgagtctactatgccagcttcaattgtaatgattcctttagttaatttggcagtggccattaggtcttaatctggggaataaggaatggtgtcggtgctgagcatgtatttctttgtacttaaattattacaagtccaaatcttttaatatgaatttttaaaatgtatcttaagtgttttatatattttaaagaaaacaaacagcttagatttgaactatattatctaatgacttcttaatgggcatggacttgttttataaatatgatatttatcaacacaaccagagattaatttcataatcttaagattaaatttttacatttgctttttttttctttctgctgttgcttctcatgaaatctctttgtccctggattcactaccagcatgtaggatcctcatgtagcacatttctcttcatttgagtaaatgcatcttctgatatatgtacttactatagaaaattgtaagtattttcattcatgttagacaaagaattggaggcttaaataatgacacagtctatgtataattactttatttctcctttaatttgttattgacactgtaaaataatagcaaaagtataaaatcaagggatgtaaaacggttcactgttaatttataaactaattactatatattattatagttaaatattataggaaatacacttagagacaaacagtagatatgaacactttttaaaaattataatatcagtatattttcagattcaaaatctaagtagtttcaatattttatggatgtgtaatatgttctgttttttatttgttggcaccctttattagcaggattgaacattgtacttctaatattattcatcaccataaagtaacaattcaaggctaatacacagtgaggataattgttttagttggtgatcagggtagtacaactcagagttgcaacatttcagcttatgataaatcaaatatactcaaatataaaactgaaaaaagcattgttttgtcattatttttctataaaattttgtatttttaactcctcatagttgtcatgatgtgcttatagaaatatcatcagatatgctccttttaattttcagtacagcaaaagttttcattttataattttaatacaaaactaaacaaacaacttaaaaacaaggaaagaatcggagatccaaaaatgagggcagtctttattatatgtaagtaacagagctggcatccaaaacctagtctcaatgtctagttttactttttcaatatgtattgaagaacttaaacatccaattttatatttagatagtctaaggtaatattattgtttattatttggagcactaaaaactatatcatgtctcttgtccaataaatcttggtacttccatttaaatgcgtgaacgtatgtgaattgagaaataagaaatgcttgtccttgccttttcagcattgtcctccattcttttacttgctttctagaatctaaccttttttaagtactcattattttccaaatgtattagtataatactttcacccaattgttataataaatttttgttgaatatctacttagataaataactgaatgaatgccaagtgtgattcatgatgaccttaatatagtgtgtttctggaaaataaatataatctaaattgttggaattaaaaaaataattaaaagtttcagataaaacagaatttccagaatttccaacaatttttatttttatatacttcatttaaaaagaaattagaaagttgtctccattttaggcatatacaacttcatttatgtctctccttctttgacagatgatggactccattacttaatattgtaagacctaaatccacacttaaaactcatagtagaatttaatagccttagactagcttaaggaggtgatggctgatttacatacattccaaagatttgttggaccatgtgtgccttacataatgggcaaagaagctggcctccctaccctaatcttttattatgcagatgggttctatacctggccagtaccatgctgtctgttccttactgtgcatgtggttgacaaaggaaaggaaagatggagcctccatgctgaacacgcctggaccctggttagccttttcctgttggcatagctgctgacattcaatcatgcacgcttccagcttatctgtatctgtagctcaattttttaggctgctttctgttaacaaagaaatgatttcacagctgattttcattagaagggaaaccttaccaaggactctcttatcctcactaactgcctaaatttcttttttgcttctgtatcacagacacgttgaaaatgtacagcatgacattgagaaaattatagacactcagatcagacggaggatactaaaaatatttttgtgttctaaatagtgatgtcaatttggatgtttgcaggtctagattggtaaataacatggaaagacatagtatctaattgtagaggaacaggtcatgtcaggcacagggaaaaattgaagtggaatgttatatctggaagaaaaatcttgtaactacatgttaggataagatatagtactggcacataaactgtcacagcgaggacataagtttcatttcttttcttttctttttttttttttttcagacggagtctcactctgtcaccagactgcagtgcagtggcacgatctcgggtcactgcaacctccaactccctagttcaagtgattctcctgcctcagcctcccaagtagctgggcttacagcacacatcaccatgcccagctaatttttgtgtttttagtatagacggggtttcactatgttggccaggatggtcttgatctcttgacctcgttatctgcccgcctcggcctaccaaagtgctgggattacaagcgtgagccaccacgcccagccaagttttggttccttgtaggagttgaatgaagtggagggatgctatagcagaaagaaaaattggcagaattcagaaagaaaaaaaaaacagttttaaatttaaaaagtcaatttgtaatgagaacatttggacacaggaaggggaacatcacacaccggggcctgtcgtggggtggggagaggagggagggatagcattaggagatacacctaatgtaaatgacgagttaatgggtgcagcacaccaacatggcacatgtatgcatatgtaacaaacctgcacattgtgcacatgtatcctagaacttaaagattaaaaaaaaaagtcagtttttttttgtcagctaacttgtcctgatgtccccagccaatccctgtagatagggaaactgaactatcttgggtactgtccaggatcaatctcagtcctggtttgggaaatgtgggattgcatggatttagctcttatctggattctgtgcttttcttttagttttaaatttatattattgatctgtgctctggttctgagaactgagtttctgttctactgagtggagaaattctgtcctgtacctagtcttatctccttaagccgaacactcgtgttcttacgccctcattcttaaataatgccttttctagtgtctgtttacctctcagcattgattctttgcaatgtggggcttccataatatcttgatgtgatctagagatctagtgtcaaatgcagatattgggctttcttaatttggtccacccactacttatgaaattcatgtatccatctgcagaatatctccatgtggtatttatagttttaaacagcttaatattttagcaaaagatggagttttaaatgtaataattttctttcaaaatcttttcccaagatttttagtttgatataaaaaaattgatttgtcataatagagaaggccatagagagaaggcaaaaaaacttggaaaaatgaaaaaggttgtttctctcactttgctctatggagtctgagttagttgcagagtatcctatctgtatcagaaagaaagatatctgaaagttttctaaaggagaagattgaagaaaacggtaaaaaaaaatacataaaatttgaaagaattaaagaagactatgttgacattcatatagcattttttgccccagtgaattacaacttcacatgcactttaaaaaaaattggacaatttttaagcctctgtggatcatcatttgttatagatgatagatagtatcatctcttaggaatgacaatagctgtgaaaaccaatgttccagacattggtttatagtttatgagtatttattccatcagggagaaattggagattattgattttgacatgtagagagagagaagggaagatcactaacagataaaagattcataaatagtagaagacttgctgagaaatcaggagtattctctagaaagatgaacagattttttaaggaaatttttctctcaagtataatagcagcagtatgaaaaatataaaaagtaaattacacttatggtatctgtgaaaattttaactgtaacatttgagcataataggtgctggttagacatcaaattttatctgaagaagtatttgctgactgtacccaaattaatttatgtatacacttttaaaattcatgggatttctaagaaagtatacaatttactttttaatttttgtataaaaacataaaaactctgtcaagtgaatcagaaaagtgttagatcatggagaattcaggtcactaaagctaaggttattttcaccttttaattttcctggcaggtctctggctcaagggtcaaaaacttacatgtaacattagtgtgtttaaattaatgctcccaatatatcctagcaatttctataagggaagtatttttggttaccagattaaagttatttaaactagtatttagataatggattttttaacttacagctaaacaatagaaatcccaaagtaaatcaagatttaaggattttttttttacttttagtgattacaagtaagacattttttatgtcttaataaggaaggtgatattaactttaatagtatatcccccatgctttctttaaaaaagaataaattaaaattaaggagaaaaatctctgtgtctcatcattttccttggacttcagaattttagttgtgcgatcagtatgagatttaggtcacagtctgttaacagaggcctagagcattaatttcatttgaatccactcttaaatttactttcatgtatgaaattctttgtgcttcctactgtttctctctgtttctccattatcatgaatgagacattgataatcaatgagctagtgactccggttattaaaaaatgatgaattatccaaatatgggtttataaatatgcttagcttcataaaatgggaggcatgtctaattcattattgattactattcacattttgcacatagtagatactgaataacttgtaaagaataaagtatgtaaaagctctgtatttactcttcatgtactcatttttaaactttttttttcctttttagcttaatttctacctagtaacccttctgcaaggcaattttcacatccacttaaacttctgtaatttacactttatttattttttgaatgcccaattctattcataaatatggctgtcttccgcgctggctagaaaccagtctcttaatttctgctgtgacgctgtgagcaacagtcactcttctattggtttttaaccccagtaaacaagcccattaaattctgtaatatttgagagatctattttaacactattatgttcctcatctactgaatccaatcaattatgtctacctactaacaagcttttgaatgtatactctacattttgaccatatttaatccatcagacacaagattgtctgtttggccccatctccttccatcctgttccatacacacaatctcttttcttttaaatccaaactccgctctgcatctaatggaatcttttgaaaatgcaaatctgtttctacaatcaatattgaagcatcaatatatttcctattatttcacgaataaaacaaaaaatgtttaagatggcctagaaccgcccacaaggtctgcttagtgtgaaattattgtttttcctccatctctctttcttgagagagctacactcccttctacatcaggatgtgtcattctcacaaacgcatcttcaagaatatagccttctttgtttttaatggactaaattctaataatatgaactcctttatttgatgaataggcagaaaccaagtttgggaattcctcttccacctccatcacctgttgtgggaaggcagatggggatgtcaaataaatgtgtaaaaaaagattagatgtaattatatcctataattacaattctcttagatcccctgacgcaaatcctgaaaactgttgttcgtgtctgttttgttttcttctttacccctggtaacttaaagaggacatagaaaagaacctgtgatttgttgtatttatttgtttatttattgaataagcaactttctatgtttatcaactaacttcccttatatctttaagctaaatacacacttctacaattagtctgtttctgtatatttacatagatttatagaactgttccccagttggtcatcagtccatctttcttataaacaagtctttaaattgttgtttttttttttcttgaatactattgccatagattacttcttctttttcaggaaacaagattcacaaagacttatggcaagagtagccacattaaatatttaagggtacaggaaaataatgtaacaatgtaacagttttgggagctcagagaattcactcaggacataaggcagtcgaatttctttttatgctctgtccaacaaaaatattatatgccatattcaaaacacgtacaaccagatttacaccactgaaaatcatgggtaagtactagtatatatttatttaccttatttaaatttgatttaaaaatagaaaaattcacaataaaaaattgattccttataatatgtacaactgttgtaacaaatacctcaaactcaaggggaggcaagtaactactatctaaaacttgtttctgggaccatctttcacaatactacataaaacatttctggaagaacgtgggtctcaaatgtttccatgccgaatatccactgttcttaagctaagctgtccaagattttactgttttcataggttataactgtattagtctgctctcacactgctaataaagacacactcaaggctgggtaatttataaaggaaagagaaaattgactcacagttccatatggctggggaggcctcacagtcatggctgaaggtgaatgaggagtaaagtcatgtcttacatggcggcaggcaaaagaggttgtgcaggggaattccccatattaagaccattagatcttgtgagacttattcactaccttgagaacagtatgaaggaaaccacccccatgactcatttatgtctatctggtcctacccttgacacgtggggattattacaattcaaagtgagatttgagtggggacacagccaaaccataccaatgacttaatatatcatatgaataacatttttttctaaataagattgtcaggaaagttgacagtttcagcaatcgccgttacattaaaaaaaattaagctgtttttagaaagttcaagtttcttgaacatcataccagatttaaaatacttatgcttaacaatttgtttcctccacatgtatatcatatatgtgcaggaaataaattgaatgtgtattatacgtgtggtggaaataaattaaataacttattggaaaagtctcatttagaatttgtcattctttgatctgacccagaactgctcagtggaaagatcctatctctagggcatttgtcaataaataaataaatacatggcaatttatatataacaatttatttcctccacatgtgtgtgtatatatatatatgtatatacatatatatataatatggaaatatatgtgtgtgtgtatatatatgtatatatacatatatatcacacacacacatatatttccatattatttcctccaaatgtatattatatataatagaatctctataatctctatagtgtatattatatactaaaatctctattgtatgtgttatatacaatagagtttttaaacactaaaacaaattagccttaattttaatctaagttacttttctcatatttgaaaaatggtacacgtaagataggtaaattatgcttcatctctatttttaaccattgtattcaacactcttactaacgagagccagttcagaagaacaatttatgcttcattaaattatcaccactcataaaataccccacattttcaaaaagtcagatacttcacaagtccagttgatgtcagtggaataaatttgattcctgacattttgttctatgaatttcttgagagtcagatgcagtgtggtcccttcataaatgtttttctaaacttctttaaaagtatggttctgccttatttgttgacttaatcttctattttcaaatacatgcaaaagataatatgacctagctcacgaaaactccagtcatttgcaagtgtagaaattttgttatctgttttattatatgtcagttacatcagtgatcattaatataagctactgtaacactcccccttaaatattgatttaattaagttatattaataacagaaggtatattcataatatgcattgcttaagaatctgttattgctaagcagtttaagaatctgtctttaaactggaaggtaacaattaattctatgtagtaactttgaaatttatgacaaccaaatcaagacattatgaataaatggtacttacagaaatctactcctcataaaggcaacatgaacactggcaaaaattgtcaaaattcattttttcagatctctgaaaattaatgactttcaacaatctggtgtgtttattcacaaaaagtgattaaatctcagtggttgataatttaagaacactaaacattgtgatgaattaacttgccctactttctggacctatagtacccttgaaaactattaggtgcacaaccacagtagctgtaaaacactgcaaggggaagacaagctttgaagctcatcaaaaaggcccatcctcagagaattgtcactattttatctgtctgacaacttcttggaaaagtctcatataccaagttggtcattctttgacctgagccagaactgctcagtgggaagatccttatctccagggcatttgtcaataaataaataagtgttagttgtttaacatagtggctgcctgaggcattgatactggttggaacaaacaagagactagtcaaaagacagctcctgtggagaatgagatagacataggaaactttgaaagcctttgacataatcctacagacataagaaagtgcacacatgtgcaaagtgtgtacatgcccagagaataccttagaaaactccaaacccttactacttctggtcctccaccagcaggaagtgaagctaaggcagagtctgacattgctggagcattgcatgtgtatcccagcacacaaacaaacctctccagcaaagtatctaagatttactggttcaaggaatttaaataaatctccgttcaatcttagtcaagcactgagataattaagcagacttaattgaccacatgcatcagggaagagtgacttttagaattaaactgaacaaataaatggcaaacaccacaacaaacagtgacaagaagcccttgggggaagggacactaattctcagacaaaacatgctacatttgtaaaataattttacctagttctcaactgcaagttataatggaaataaacaggaaactatggcccataataggaaaaaagtagttaatagaaattatatccaaattacagatattggacttactagacaaagactttaaataagttttaaatatgctcaaagaactaaaggaaattatatctaaagaattaagtggaagaacgagaatgattgcacactgaatattagataacaataaaaagatatacatttaaaaaagaaccacatagaaattctagagttgaaaagtataacaactaaaataaaaaatttgctagatgagattaacagaaggtttgagttggcagtaaaaagtatcagtaaacatacaaatgggtcaattgagattattcattgtgaaacttgaaagacaaaagattgaatagaacctcagagacttgtggtacacaataaagtgtattaacatggaccataacgggactctatgatgaagaagaggagagagaaaagataaaaaaaatagaaataataagaaaaaataactttctgaattctattaagaatcttaatctataaattcaagtaagataaactcaaggagacaagcagataaattacaaattatcaaaagtctaaaagagagaaacttgaaagcagtaaaagaaaaacaactaatcacacataagggatcttcaataagataaagagaggtttcttatggaggttaaaagtggtggtatgccatttccaaagggttgaaagactgtcaaccaagaatttatagtagcaaacaatattttaaaaataaagaataaattaatacatttccaggtatgccaaaactgagagaatttatcaccagcagatctttctcacagaaatatctaggaaaatccttcagattgaaaggaaatgacattagacagtaactcaagtccaaacaaagaaatagagaacagtaaatgtaactacatcaggaaatgtaaaatacagtataaataaatgtaatttaacttgtaaaatattctgtctgattttaaaaacaactgcataaagcattaattaagaaactctgttaatgggcatataatgtatgaagaggtcatttatattacaataacagcagaaagggggttggagaagatggcatatattaaagttttttatatattactgaaaataaattggtattaattcaagataaattattttaaatgcatgtgttttaatctacaggataagctctaagagaataactcaatataaagtaaaataaaaaagaaattaaaatgatataataggacatatatttaatacaatacaaaacagtagtggaatactaggggaacaaaatgatttaaaacatataaagatatataaaaatggcatacacatgctaactaataggtacttacattgaacataaattaattaaacactccaacatttcaatcaagaggcaaacattggccgaatgtacgtttaaaatgacccaactctataccatccaaaagagacacttttatttcaaatacataaataagctgaaaaaactatatatgccatgccaacagtaacaagtggctatactaatattagacttaataagctttaagacgataactgtttgaattgtcaaagagggacattttctaatgataaaagatacagtgattgtaaacatgcatgtacctaacaacagagactaaaactacaaatagcaaaaattgacataaatgaaaggtaacaggaacaatataacaaaattagttggtgaattcaacacctcatatttaataatgaatagaacaacaaggcaaaatatgaatgagaaaatagaagacttgaataaaataataagcaaattagacttcatatattcacagaacactccactcaaaaacacaagaaaaaaaccagtccagatataaacccttatatttatggtcaaaacaactcaatgaagaaaaatttatcattttccacatgttgctggtataactgaatattcacatggcaaagaatgaagtttgattactgctgacaccataaaaaattaatgtaggccaggcgcggtggctcacacctgtaatcccaacactttgggagtctgaggcaggcggatcatgaggtcaggagtttgagaccagcctgactaacatggtgaaaccccgtctctactaaaaatacaaaaattagtcaggcgtggtgacacatgcctgtaatcccagctactcaggaggctgaggcaggaaaatcacttgaacccaggtggcagaggtagcagtgagcaaagatcacgccactgcactccagcctgggcaacagcatgagactccgtctcaaacaaaacaaaacaaaaaatgtaaaccatatcatagacttaaatgtaagattaaaattacaaaactcataatgaaaaggtcatatatatccttgactttgcattaggcgatgatttatttgttgtgataccaaaagcacaaggaattagtaaaagttgaaatttgaatttcatcagagttaaaaacatttgtgctacaaagaataccaaaaagaaagtgaaaatacaatccatagaaatggagaaaatattttcaaattgtgtattggagaagatacataatttgaaagatagatacaaatctatactatacaagactagagatagatacaagtctatactataatgaagaatgcttacaaccgaaaaataaaattacaaataaatcagtttaaatatgggcaaagttttcaatacccattctacaaaaaagatattaaaataaccaataagcacataaacatgttcaacatcattagttatggggaaaatacaaatcaaaaccacaatgagactacttcacacccagtagttggttaaatcaagaagatacacaatagtaagtgttgacaaggattggagaaattggaatccttgtgcattgcttatggatatgtaagctgttgtagccactttggaaaacagtttgacagttactcaaaaagttaaacacagagttaccatataatctagcaattctagtcataggtatatattcaaataaattgaaaacagggatacaaacaaaaacttgtacatgatggctcctcatagcactatttagtaaatagtcaaaatgtggaaacaagatgaatatcaatcaactgatgactggattaaaaataaattgacatatttatataatgcagtattatttagcaatcaaaaagaacaccacactgatacttgctacaacatgcacgaaccttgaaaacctgaaaacagaagactacaatctatattttaaaataaaatatactgatgaaaataaataaaatatttctgaaattagatagcagtgacatttcccttaatgtaccaacagtcactgaattgtgtgttttaaaagggcaaagtttagtacatctcaatgaagacattcttttttaaagaaagaatgtgtggataaataattttacaccaaatgcagtttttttctttcagttttaagtggagcttaatatatatttcataaatattatttcttgtattaatagagatgaagaaatatgcaaatgaaattaaaaacaaagaaaatcaaaagatacaagttaaaattgctttaataacttcaaatttatgcagaactattgtcaggttttaccaatttctcttttatttatttgtgctagagtatcataactttaaataggctgtgaaaattcctggcactttttttaaatttatagaaagccagaaacctttacattcatttttcctgaaaattatattgtagctagtaagttagtaaatattaattgagaatcgtgagaactttacctatattttaggtatattcaatgtcttccccatttttgaatttaataaagaaaaatatacttcaagcacagtaggatttcacaccttggaataaagaaaacatatacatgttaacatttcatgtttaaaaattgcatacttgaagtgcatttctttgttaccaaaaatcaattaatttctattaaaaaataaaaaggatctttaagtccattctgttaccaaaggatgagttttcacaataaagaattttttgttcatgacaaagcagaagcggactgcagtttgatgatgatctaatcacttgtctttacaatggggttagcaataatatatgattttcagattggtgaactttagtcattctggccactgcccacaacaattttagtctattattgtgagtagttgtgtgttatcatttaagtcacaaacatggtccagaattgacctattaggttgcaataagttgaaaacattaaatggcttctcagtctctaagttgatatctgacagcatttagaataaccaaaaaagctcctctttattgtattaatattttattctgttcattaaggtaaaatgtacatgagtaggtatatgtgcctaagaatcaagactagctctaaaatattgtacttctttagatccaagtaccatacaattttttgttttattggcattcatcatttagttttcataattgttccttattaaattttttaataatgtattttcattttaattttataagacattactcgaccttgggaaaaagtcaaactattttatgtttaaaatataatgctattaatattcttagtaaaatatgtatatatgtatatagatataaaacctgtctaaaattgtgtgtgtatatatatatatagtaattttttatataaacagttttcttgcacaccaaatatagcattcagtgcacatcaggacctatcatggacaaaaaggcagctcttttctggtgtcagtatggatgtttttctgaaaaagtcagtgatgtgtgtcagaggacaagatagaatcttcccactcaaattttatttttctttttggagtgacatttcattccttggaatttctaatacataatactttaggtgttacctctattactgagagattttaaagtgttttcttttctgaaaaactatacttccacactgccattttgcaactaagtcttttgtactgagacattcttttttttttttcagcaaaaaatacaggcatccaaatacatagaatttacaaatagcatttgaagaactcatcaggatgattatatattagatatatgatctagtgttcaatataatgtttttttctgaacatttaagattctaccaattcattttgtgaaaagatatttgtgatgaaatagatcaacgtaggcatagctattgttatttctctcttatcttttcagggacccactgctaggtgccttaaatatgtatcaggtatgaatctccttccataatcacaggcgtgaatggaacataacattttttctgctgttgttgccattgatacagcaaaaactacatttattttctctattcatattttctctaggttttgcagaggatgaacatagtccccataatttttcttcttgttattcttatttgagattagaaatgtcccagcattttagaatatttcttacattattctagtcatctgccctagaagcctgaaaggcaatacaaagtacttgaataaagaaaagagaaaagtgggaataagtggcaaaaaaagcaaaacaatatcagctaatatcttgataatatgtttctaccatatttattatccaacttgttcccgtaataatcccttattatatttcttattatccccagtatccagtgtaagacatacagacttgaagaaattgaaactgagttactcactggaagccagaaagaaagagagaaactaatcccaaataaatagtacaaattttatcttactacagagcacctgctttttgtaattcacatgtcatttttctttggaagaataatttggaagtgaaaagctatttctttgaagtgagattatacctcatcagattacctgttcatgttgcaatatatggacaaataaatgaggttacatttgatacagatattcaaatataggaatttggtttaataatacaaccatatgacatacaattttacaggtaattagcagaaacaagataaacatatgggttttcttttgtgaaactatattaattactgatgcagaaacttagaagttgtcatagaaagtttacactataaccaatcttagcctagtgaggttgtggataaaaaggaatacttacatactttcggtaggagtgtaaattagttaagccactgtggaagacaatgggacaattcctcagagccctagagacagaaatgctatttgacctggcaatctcatcactgggtatatacccaaaggaaaagaaattgttctattataaagatacatgcacatgtatgttcattgcagcactgttcacaacagcaaagacatggaatcaacctaaatgctcatcaatgatggactggacaaagaaaatgtggtacatgtacaccatggaatactatgaagcaataaaaccaaaagagagcatgtcctttgaaaggaggacatggatggagctggaagccattatctttagcaaactaacacaggaatagaaaaacaaatactgcatgttctcacttataagtgagagctaaatgatgagaacacatggacacatagaggggaacaacacacactggggcctatcgggggtggagggtgggaggagctagaagatcaggaaaaattactaatgagtactaggcttgatatatgggtgatgaaatagcctgcataacaaacccccatgacacacatttacctatgtaacaaatttaaccctgaatttaaaataaaaggtttttgaaatccagatttctaccaacatttaggtcatgaggatatatgtattttctaagaaaatagaggctttctctccaatattgttttttctttctgagacctcatgagaatcatctctaataattcatatttctacgaacagtcccttcacagcagtctagacttttactaccacgaaactccaaacctctccaccctcctactcattacccatttccaaagccatgttaacacatatttagatacttgttacagaaacagcccacttcttcatgccaaaatctgtaatattctgggttctgtacagaaacagaactgataagatagatgatagatagatagatagatagatagatagatagataaaactacatactgcatatataatttatttttataattctcaccctggattactgatgtttcagatatctaaatcacagtggcatacgttcatctgatgcagttcttcatcctcagtaccaaatatgcaaaattaaaaatagacatggtgtctctatgcagtaggcatacattatatatttatactttatgtataaagataacataaggaattggctcacatgattatggaggctaacaaatcccacaacctgttggtggcaagctggagacccaggagacctggtggtgcacttccaatatgagttttaagtcctgataaccatgagagctgatggttattcacaggcaaccaatgtttcagtttgagtccaaaggcaggaaaagcgtagtgtcccagctcaaggcggacaggcaagaaaaataccctgttactagggggaaggtgagacttttggtatatttgagtgttcaacagattggatgaggcctactcacattagggagggcaacctgctttgtgtggtctatcaatttcagtgttacactcattctcaataacttccgtaggaacacagaataatgtttgaccaagtatcttggaatcccatggtccagtcatgttgacaaataaaattaatcatcacagtaggagctgatgtgctatatgtttacacttccctatcctataagtgccagaggggattctcctgcttaggaagaatcacatatagaaaagtgctagtacctcttgggccccacaaatctaaagaaccttttgaattgcaagtttgtgtggcatagttttgcaaattgaagcctctagcaaaaagacgcaaaatcgagctggaagtgtcctttagacttttgaatcctacatctgactaatatgactgctccctgtactcttcttgcaaagcacctacttggttgctactgggcttttgctgaagctgaagacttgatccacagaggctttgcaactctcctgcctgatactgcctatcaggatgagtcaatggagactcaagaactaataaggtaggaagtccccatctatctaatttgtcaaatggaaatggtatagtccaaaattcaactggtctaaccccaatataattttgtctttacatgaaaaagtggatgttttccccttggggaaaagtttctcaattacatgaagcaaagccgctggccccactgcacctttcattcataaggtatcccttaaaaaggttgacctagattactgatggttcagctatctaacctacaatggtgtgtatttgtttgatgtagcttttcattcttaccaccaaatatgcagaactaaaaacaaatgtggtatctctactgagtaggcataattcagagccattctcatcactctagccagtactccccacctttttttttttttttttttgagatggagtcttgttctgttgcccaggctggagtgcaatggtgtgatatctgctcactgcaacctccacctcctaggttcaagtgattctcctgcctcggcctcctcagtagctgggattacaggtgcccaccatcacacctggctaatttttgtacttttagtagaggcggggcttcaccatattggccaggctggtctctaactcctgacctcgtgatctgcccacctcggcctcccaaagtgctgggattacaggcatgagctatcgctcccggcccagaactccctttgataaacattgttatatttttactgagtattggtctgttgttagtagcctagatgtttactctgacacttagaaaactacaaactagcagattaaagactgaagctgtaaactgtagaaacaaatggctgttaattaaacaatctgagtaattcatctagagaccaactggaatcaagctgctgatcatgcctgtaccacccaaattactatcactgctaactaaatccattactgcactagacatggcaatacatccgccattataaaatgtatgcaaaataaatggctttgtttctgtcacagaggctaccacttaatgccagatatgtgagtctggccaaaagtcactcatttctttcctagtgaggaataccaatttcagagcattataccaatgtagattgactacagtgaacccttcaagtcctctcattgctcagtaacttgcagtaattcaccactgttgaccatttttcatttatgatgttgctatttgaatccaatcagttgattcccaccccgatatcagggtccttgaagcaaatccatattgtgttcttggctgtgtggcacattttcatttaggcatcctttattgtaaaagtcacttaaaaatgttatttcatgttaatcacttcttaggtaatgatttggacaaaagggatgagggaataatatacagaccaattttgaatatttgggattctgcacagaatattgtcaagcatgatgtttcttttgttctcctaaagggaaccccagactggcctgttattatactctctattaacctgatgaacaaagaatcttaggaggtgcaagtatattctggttcagccacactgggttctcttattggtttggcattgtaatagtcagaattcttcagagccagaaccaataggagatagaaaaatagatagatagttgaataggtaggtagatagatagatagagagatagatagatagatagatgagaggcggttattagaggaattggctcacactattatagagggtgagaagtcccacaacaggctgtctgcaagctgggatgctgattgtgtgtctcagtccaagtataaaagtctcagaaccagggaagccaatgatgtaattctcagtctgaggccagaggcctgagaacctggagagcccctagtctaagtcctggagtccaaagactgaagagactggagttctaatgtccaagggcaggaaaaaaaaagggtgttacatcaacaggagagagagatagagagagacagagagcactatagagtggaaattgtcttttccctgccattctgttctattcagccccgcagcttattgtgctgctggtaggccagttcaggttcttgactttgctgcacctaagaatttgagagcaagtccaaagtaagagtaagcaaagaagtttactgcaaagcaaaagtacactctgagaggcaagagtgggctgctcaaagggagagacagcagctagtgccttaaggggaatctctttttatggtagctgtatatacatattcataaaatactggcaaggtcaagtatgcaaaggcggacctgcagttggaacatgtgctcggcatctacatgctctaacatgtaacatatgtatcattagcatataaaatctccacctagtggtgtgttttttactattcaaatgaggaaaagcttactataagctaaaccttgagcctagctgtgcatgtgggaccccagggaagtctctagcccccaaatgttggaatttgtagctaataccttctttggcttttagtgctgatggactggtgattggggaagttacatcaggaataaggggcttttgttctttcctgggccatactgggtatcagggacctgtaaccatctggctgtctgccggtatccttcctgtagggttactaaccttgcaaaaaattgggtggtcatgcatgagggtgcaagggatgcagagcctgctgggcttcacacaaggggacaagccagtttggcctcctaaccttatttatcctgactcaattggatggtgctgcctaccttgacagcagattttccccattcaatctaccaattcacatgccagtctcctctggaaccacactcacacatacactcagaagtaatgctttaccagctctctctgtcttccttaatccaatcaagtttgcacctaaaattaaccatcacagatatcatcctagatcataatgcccattaccatttagttgaatttactgcttgctattttttcctactgtggcccatacaggtcaaagtgggggacacaatatgtccttgtaagtttttaaaaattattcttatacctgactctgtgtaaaaggtctggctatgactatggaatattggtgaaaagatgaagttatggctattggaatggggtgcactatttttgaggtagcggagagagagcagtaatgcagaacctggtgagaaaataacttagtttccaccaggtacaggaaggtagggagggacattagtggtctttctctttctaaactgttcctagagctttcttcatgaaggaaacatgcctaaatgcatctctactaaacattactagtgtgttaatttaaatgactgctgtatctactattccctgccgaagactttcaccacaatttgaaagtccgcttaaatgtagagataagtcagtcaaaaacagcaggaaatgtccccagctcctgcacctcccatgaaaaacatctgtcaacacgtctggatatattttccaccccatttatacattctctgcctagacgctccatagagcagatgaataccacctggctggtggcatggtcgaaccatttagtttggctccaggcatttctccttaaaaaaagaatcagacccagaaaacccagaaacccagtttctttaagctgacagaaaatcgtcacacgtgttagctgaacttgaggtcacactggagtcaacattttcattccatagatacaccatttgcatccccagagactgaacttgtatgaactcaggcattacttgcttcctaaccaaatgataatgacttgccttctagtggtggtcataaggtatcttcaagttattaaaagaaacatcatcctgaaattgaaaagcattcaggtcagcctgaaaattattggccaaggttgttataagtggtagaattgccctagaattcttccttgtgttctagtagaagctatgtaatcatgaatacatcttgctctgcttgaattaatgtttccagcctagcagaaatgtcaatgcagaaacttatagagactggcacttagcttcctttctaaggtcataacgtttaaggaattttgttcagctggttaagtctgggcttctaaagggcatgggttgatatctattgtgcaggctgacatcatcattctgctttgagtcatgttgttagctgcttaagtaaattctatatgagacaaactggaaagattcgatgccagtgtctgtcagtaagattaatttaactggtgattaatttgacaatgtattcatgggaaaaatttccaggagccaagatgtgaaaatgaggggtggataatattggaagaagattctctatgaatttttcacatttctgcatgtcttctgagcaacaacattgactgcctttattcggaactatctttccaaggatattttttgtagtaacagactttggaagatagccttcctctggggcaaagggaatgtgtgcttgtgcctattataaaggtatcaggttcccttagcttggaaagatctactgtagtaatagaacctactgtatgtgcagctgtcaatatgaaaatgtggaaattctggctactgctactgctgtgatgatactctgatctttttatctaactcagaagtctggagtcttctgtcagcaaccgtcaaattgtggctaacagcctaaaagtagagtaaaatcttagtaaaaaattatgcttattgccttataatatacattgtctgctattagacaatgcatttaatttttattttcaagttgcatttttttatcttttccttctcaacttttcttaatccttgaatataagtgtttcttataaacagcttatgattgaggattttctttgtcctatctgactgtctttattttttcattgatgtttatagtctgtttacatttaattatctatatagtggagttaatatctagcttcttattatatcatgtaaatatttttataattaatattctaacattaatattagcatattataattaatattctactttataattattagtttacttttttataaatgcaaggttttattattttttaatctgaacaatcatgtttttaatttctaggaacattttatgtatttttaaaatacacttttttattatacagtcaagacattattaaaaggaatcttagaatcactacttgcatgacacaatagcatcaactatgatattgtttagaaataatcagagatatataagcccaaatatatgaacagttatcaattgaataggaattattaattgcatataagttcaattgaatatgagttatcgattggaaataatttcaattcaaaccttagcattgattaattaacatactttattattgattttcaggtattatacctaattttttaaatagcaaaactaagcttccaaaaattatggaaataacaaattaagaaattgtgagaatcaattgttaaaatttatatcttaactttttcagcctacaaagtctaactcaactttagtctgacttttaaaaatattactagggaagacagtaaaaggataaaaatgaaatgttccacctacataaaagaataatgttacgaaacattaaatctgtcgcagttgaaaacacatttgtgggaggaacacttacagtagagttaaccagactgtttcctctttttttcttcgtttaggttgagtttttatgagagtaaagttcataaaagagccaatggaccaataaatggcacttacgggtaatcaaatgctatagtgaaggcaaggtatttgattaccttaaaagttattctacaacatactggacattactccttctataaaagttgattttgatttgataatgaatactgtttttaaccacatgagagttacaaaataaaagtttttgctttcacttttattgccagtctgtcttgacacttgctattcaaaatagaatccatagtaccagcagcattgtcatcacatggaacttattaacaatgaaaatattaggcttccccttagaattacagagtgagattacacattttaatacaatcccaaatgtattttcgtgcacgttaaaatatgagaaatattggtctgaataagtcaaagacatctccaaacagtggaaaagagagaaaataagaggaatgcatttttaacattcatcaaattacaaaataaaaatttttgaaaacttatttttcctaaatctgttgtgaaaatgtggtgattattattttgtcctttaatatttttcaggaagttttatagaagcaattttgtgaaatatacattattttacaagtaaatagccaatactgagaaaagtacatggaaggtacccagcaatacatttacttccacaccttaaccttatccctctcaaaacttttcagtaatgagataaaatttcaagggtataaattctttgtgaattgcgatgcaagtagtggtttaaattgcattgtatataatttatgatgaaaaaaagtcttataaagagttatttgatccctgtgttgtatttttactcattttttggggaaaaaattacttctaatgactcttaaaatgcatatttgtaaatatatacaggcagagcttatagtcaactggtaaacactgttaatagcctatgactaaatgatcattcacttttcatgttataccagttgttctaatatcactcctgtttttagggaaaaggtatttatctaatattttttgagaattactctctaactgctttttgctatccataaaatgtgttaatatctatctctgcctgtcagaaagtacaatatatgaagaaaagtatttttgtattttttgtactgtaactctaggacttagattatcagtaaatattagttgaatgaagaaaatttctctacaaataatttttttaacaatgcactcaaaattaaaattgatcacaataaattatagcattggttgaaaccaacaaaattaaaattcatttagtttgttttttaaaaaatatttccacaaaagtgtacttgagctactattttgcaacagtattagtgagcccttaaatgcccctacattttagtaaagtgcactttatgcctatattattatcttctgaatttacgttatgcttttagaaagatatatatccatgacccaacattttcatctagtaggaaatatccttgagtagttaattatttgatacaagaaaacaaattatgaaacagaagtatctgtttctgtataacaaaaacacaaactgacaaccaaggtataactataaagaaaaatagttaaataatatatagcttacatactgatcaagtctaatttatgggaaaaatatagttataagtaatctaggaagtatttttaaaataatgttaatcaaaagggaagaatacagaagtattgcatgaattctgaacatatatgcatgcaagtatgtgtatatgtgggtattcaaaagaaaaaaaattgagatagaacaaaggagatacatgtaaatttgttagtttcaagtttttaaatgacatttatatattgttgaaaatgaacagaaatggcaagtgtgatgggcatatttgtaagctgaaggacacaattagtattattataaattatgtccatataaaaaagtattattacatgagaaattttattctggaggacataagtgaagattttatagaaaatatgataatctgatatccattttcaaacataaaaaaccaacatgggaaaagggtttagaagtagactaaagagcaaaattagaaacaaacttgctgagagtcagtgttaagacattaataacaggggatgcttggtgtaatgttaaacatttaaataaaatctgtctttagaatatgtaatgaactgaaacagtaagtactctgtaagtgggagggtataatggtctttggatcacctatttatacttttactttcaaagattccttaattcaattctctggacattgggctctaagtatgtaaactctaatagttctctggttctgatgacatctatgcttagacaagagctcactggagctgtacaaaaatttgagtattatacaagaatatttaattatgtacagaaaggcaacataaaaattattacagaattctaaaactgaaaggaaatttacttagtgtttcaatcaatcccataattctacaaggaaaaaaaactgaagttcaaagatgttaaacttattctaattaaatcaacagatgttatgttgtctatccagcacctgcataaggcaattttaaaacatctggcaattgagataaactatttaatggaggtcttcactagcaatcttgctagtccttaatttctatccatgtattaacttaaaacatcagaaaccaaagtacccagaacctattatctcagcatctttcagacatgctataatggagacagttaactctatttaacaatctcttgatgatttttctttctggcaggttccatactggacatggtaaacacagtggtaaacacagcagtcacaagccctttcttcacgtggtatggggtctagacaaatggccaaaatacaggtatagagagagtaattataagtaaaataagcattaccaggtcaaattatatgacactagagagtatgtgatgagggcaagtaacctatctgagactgggagtaaggaggaagcagaaaattttaggccgagaaaacatgggtggtgtcatttcagaacaattgggctgttggcataggtaatatacttcaagtttacaaagccttcaaggttttagagagggaaatctatgtcagcattatatttgtatataatttcagtgactttgccaagttgtggctactatttccttaattcacgattttataaactgtgagctcaggttacatctgccttactctttggcaatatgcccaagtctctaggatagtggggctcctaagtgaatgaataccaagtactgaatataattttttttttttttgctggcaaaggtgtgaaagagacttaagttttttaaagttctctttaattggactctactcattaatggaaaggaactaatttgaaacttgtttatttaagcaaagtgactgatctttcaaaaagaaccacaattcacaatatatgtgaacattaaaaagtaaccaacaagaaatatcccttcaacatatctttgaacaaaatgttcgttataaacaacatgtgagatatacacacttaaaggatagtttcacagcaccacataattttacactgtactgagtatctgtggcttttcatatgtaactataatgcccaatataatttcacatacattattgaaacagaaaaattgttgatatgtctgtcaaattgtagattctctattataattcccatttcatcacttcaaagataccccatgcaagactaaagtaaggagatacatgattaataatgcagatagaaccatgtatgatgagaataggtatgattaagaacttgaacgtggtgaattatgtacttagatatttaagtggtgggagaatcttcttatacttttgcatggatgggcactaaattatatggagtaggaagaaaatgctttgaggccttatacacgtcagttatttctacagcctcactagagcaagtatcaagtaatttacctaccctttgttatgctgtttggatgtagtttttccaaaatgacatctgaatatcattaagtatgaaatacttagcaggggttcctttcatattttcacactctttcgctatccttgagagatcagaaggcagagtttagtgtatcaaccaacagaatatgtgggaggtgggaggattagaaggaggaggatgtttatataaatatggaaccatccatatgtttggccctgttttttttttaaagtgctcaatgaaatgtatttaaaaggggaagttcaaatcccttttcatggcattctgtgagtatgatatcttttccagtatagggaatgtacaatacccaaatttttgtacagctccagtgaattttttatctgagactaagagtaggtgccttataaacatagaactattagagtttacacattttgagcccaatgtccagataatacaatgaaataaattttgaaatacaaagcactatgtaatcataattcaggtttccttttgttacttttattatctttaccttactcctataattaggcagagataggggaaggtggacctgaaatatggtgtgtaaacaaattaaatatatgatggcaaaatcaaaatgtttcaagtttttaagaagacaggaaaaccttctttatttaaaaacatgaagaccataagctatagcttatattattatgttattacattatattattatgttaacaaccaacataaaaatataccaaaaaacaaggcaaaatataacatgataaccccaatttattgttgtaagagaggtgaaatttaaaaaaatgacctaagaacacagattatgtgacttctaattttgacttaggtggcttgatctttagtcatcttgatagacaaattttggagagattttcattaagctcttgatttactgtaattattaaactagcactctatgagtgtttctagagagactgtgtattgtatcggtgcattttcacacttctacaaagaacctgcgatggggtaatttataaataaaggaagtttaattgactcacagttccacatgactggggtggcctcagaaaacataattatggtggaacgtgaaggaaaagcaagcatcttcttcacaaggtggcaggagagagcacaagagaggcaggaactgccaaacacttttaaacaatcagatctcatgagaactcactatcgcgagaaaactctggggaaaaccacttccatgatccaatcacctcccaccaggtacctcccctgacacatggggattacaattctaggtgagatttgagtggggaaaaagactcaaaccatatcatgtatgatattcatgcctgatccttataaagttatatttctttttaattagtaaatttgtttcctaagagatttaagagattcaatatcttaatttcttttgagttagatcagagccaatcattctcttttaatccattctactctggctattgatgaagtaaggcacatgtcctagaatggacagaccccacaacctttctttattgacatcagaatttgctattaacattattttacaggagaaattactataaaagttttccagcttctcctctacaaggcttctgttatttctctaatttttatttgttctcattttctccttttttccattttttgataaatgaataaaaataatgatgtaaaagaatattgttgtggaaagtgtgtacaaaaggaagagaacaagagcaagtccttttgcttattttaaaacccaatctgtactatatttccatttctatgtaaaatagaataatcctagtaaagtatctgattttgtgagtggtaaatgtagataatattaggcagaagcaatcccagaaagtcagtaatatcaatatcctgtatcatggtacaattgtcaaattgtttcaaaacatatcaaattttatctttattatatctttatgggatatgaaagacaattgttatacctattgttcatataaggaagcagttgcagaaaggtaaattacttccgcaacagcttcaaggaagcctgcttcaggggcaggaaaagagttttaaggcttttaatcctagtcccgtgcactgctttcttctgaggatctagaattcatattttaaatagtggaatatgtgttgacaatcaagaagcaacactaacttcatcgtttctaacaaccagtagtgcatgagttaatttccactaaggcattgcagaacactggctggacaagtcattcaacaatggccagaaaaacgaaccaagggatggaccatatgcatgatagaaatgactccaggtcaaacatctgctttttcagacatactcatacatgccatctgtggaactgctttttgacttgcaaggataggattgcagtatatctatataatgtagttacatacatttatgtaaagttgtataaaccatgttgtagccatattaattagtcatagcagattttaatatttgtggtttgggcacattagttggtatccatgtaatatttttaatatgaagatttatttacatcacattcctccttcttatgaggaaaatactaagaactatgaaaaactgtgagccactataataacattataacactgtattagtccattctcaccgctgctacgaagaactgcccaaggctgggtaatttataaagaaaagaggtttgattgattcacagattcacaggcctggggagaactcaggaaacttacagtcatggtggaagaggaagcaaacacatccttctttacgtggcagcaggaaggagaagtgcagtgggaagggggaaaaagccctttataaaaccatcagatctcgtgagaagtcactcactatcatgaggacagcaggggggaacagccttcatgatctactcacttcccatgaggtccgttcttcaacaagtggggattacaattcggattacaattcagtatgagatttgggtggggacatagaaccagaccatatcaaacactaacctgattaaagaaagaaattctctggagactcgcaggtacagctctaactcaaaatttcctttcattatctagcttttttccccctgaattgtatgttactcatctgacattcataccaactgttcttggcagagtgcgctcaaagaaatttgtctatgtaattaacaatatcttgtcaatgtagcacatttgtttagtcagtgtaccaataagtaaagaagagtagaattttttttctctcgtcatttagcccccacttataagtaagaacatgtggtatttgattttctgttcctgtgttaatttgctaaggataatggcttccagttccttaaaagctaaactgctctggcttcttaacatattcagataaattctcactgatgagataaaagaaatgggacatctgactagtagaaaggagagcagaaacaataaattaaactaaaaggtaacactagtggacaagagaagaacagagaactttttctgaatgttctttctggatattttcaggacggtgcagaaataattacaatttttgccattaatgcaccaaaatgatacttcaatggaattagtcactcctctgctttccctaattattaatcaaatttgataatcctaggacgttaggtaacaacactgcctttccatgttttctttgcaattaatataaacacctttaactcagtaatggaaaagagcatggcatttaatgggcaggacctctgaaataatctccttcatacttctcaaaatgatcagattcatattaagattaagagaagaaaacagtaatacatatatttatttagctctaaattgctgagatagaaaattttacctttcaagctaaatttttagtaattgcacacagatgctgaaattctatttcaataagcaaatgaatccccatttcacaatgcatttcatacctcttagatgaacttaataatcaaaggtaaatgagaagataaggagaaaaattaaaaaaaaaaatttacacaagagccagaatttaatcattgtacaagacacatctattgcctctcctctgtgaatgttggaagacacaggtggttaatacacacacaaattttatagtaattataatgttctatttttaaggacccactatataaatattatttaggtaaattattattgcagtgtgatatccatgtaataacatattttagttgcctctaatgtatttactgttcacaaaaattctaagttaaaaatatattgctacaaacagatgttatatataattagaaggtagattaaatgaaaatacaaatgtcatttatttatataggtgacacagtttgagaataataattgacataaatggatgtttgttagggatagtaattcattatataattccattaatattttcacaaaatatgtttgttgttttcagagaatgtaaagcctcgattgtagatgtctatagatgaatggggtttattgaagcaaaatagagacaggaggaccagtttcagtaatgggcaaatacaaaataaaaatcaaccaaagaggaattagtataaaacccaaagttagattaaaatgttgaggttttaaaaagcagaacctaaaacaatattaagcacagaatacaaagaaaatatactatttaaccaaaaacgaatagcacctagacttcttgggaaatttttgtgtaggtctttgaaggtgtgaaattgtaggacatctatctggtctatctgatgggaaatccatggtattattgttcatttgtcttaactgaagattagatgttgtaggaacatgctagaaaaaatgtggatgatcattttcattttcagcccacattcaggattttaattctttcttaagtttctttttttccttggaattacttgtatacttgcctgccattaccgattagtagctggaaataatattatatgtattttagtagcagaaacatgtttttttttccttatatacaacacacagatacatgaatactttaccgacacacacacacacacacacatacacacacataaacacacacagcttaaagtaggattttgccttaaaaagtgcctgatatatatttgatgaaataatgaaagaataaaaccacagacactaaatgttcaataattttaagataaatatatatatatatatgtatacttgacaagttgaaaattgtcaaaaatgttttgaaacttctccatgtcagcatgtgttgtaaaaatatatataaataataaaggctaatatatattattgcaatgaaccatgtcctcttcaaagtgttttacaatcattaatccttttctgtttgttgcaaccatactgagcaggtactaatgccatactcatgttacaaataaagaaactaggaaacgaagaatttcaaaaagtcccaaggtcacaaaacaaggaagtcatagagcttgcacttggtgacatattattttatatcagaacacaaaaatcttaaaaattatgctagattaaaattaatttatagtaaatttcattgagctaacaataaaatctgacttgctttaaaaaagcagcaattagtaatattagtaaatattaaaatgagctatattttgagtaaatattaattcattcaaaaataatattaatttattaattaatatggagttatacttttgagtaaatattaaaatgacctgtttagtaaaggaagttgttggaaaaatagaaataaataaataatatttaatactctttttaggaataagcaaaatgaagtatatctcaggaagtaataaacaagaggaacatgatctcaaaaatagttcattttttaaataaccacctgaatgtgagctaatttcaaacaatttgcacaaacttgcaaaaaacaaaataagccgaaatatcatgtgaaaattcagaaatgcaaaaggaattaacatcgaacaaaaattccaatttctttgaaagtatgtcaaattgtctataaagccatgggaatcattataaaaatcacaatcacaactcttatgcttgattaaaataaaaaggtcaatatgagttgttttgaaatgttttcattagggaaaatgatatgaaagcaaccttaatttgaaagtgcaaatatacagagtacatttagtgatttataatacataatttgtctgaaaataactcaagcatataagataaccatgtacaatttttatctacatggtgatgagaaatgatagttatttctcctcgtaaaattctttggactcatacagtactttgaaaatgtgttacgtttttaaaatcttattctttatatttatgaaaataatgttttatagcagaacttggtttcttgaaatgacatattcattatatttcatgattattgcccatacatatcaatagatattgaaatattccaaaggcacttacaaagactcttcttttttatacaggttttctaaatttaaagattaaaagaagaagagagatcttccctgtttttactgattagtgaatataatttttaggatttccaatgaaaatttttggttaaatttaagtatttattaggaaaaataacagattttaataaaacattatagaaaataagaatttttagaattatgtctacctaatttccaaagcctttgtaaattagaaaactgtttaaaaatctttaggaacagtaatccttttgtcatcatctacattatttatttgaatttcataaattcatatttcttatttaaccttcatgcatttacttaaccttcaaagcatttactgctttgtcaacaaatgcgcattgagtgtctgcgttgttccgggaactgtttatgttccagggttgtagtagggaataaaacaaagtccctgctcttattgactagtgttctactaaggggagataaaaagtaaacagcaaacatataacatgttaagtaatagcaagtgctttgaggaaaataaatcagtttaagggatattaatggatgaaggtgagtgccattttggaagagctaataaggatatgtctctctgataagacaatcttttagtacagaactgaatgaaataaggggcaaaatatgtaaggaagagagagcaggtgtaaaggccctcaggtgagtattttgcttgctaaaactcagcaaaacagcaaggagacctgcatggtagaataaagtagtaaaaagaaccaaaacagattaagcgcttagaaatcagttgcaagataacctggggtctctttactttgctttatattaaatttttaaaaataaattcaaacttacagaaaaatggcaaaaataaaaacatgaaaaaaataaccatgtagcctttactcagattgacctattatctacattttacaccatttgctttatttgtcctggcctccttacctccgtgtgtgtgtgtgtgtgtgtgtgtgtgtgtaactgtgtctgtgtgtattttctcctaagtcatttgagaatgaattacaaacattgcagctctttactcctattcttcaagatgaattttcttagggacattttcgtacattatcagagtacagttttcaatttcagtggatttaatatcaatacaatactatcatctatttttatttcaattttgcaaattgacacaataatgcccttctttgcattttttaaatctccagtacaagatccaacaaaatttgggtattgcatttagccgccataacattttagcttcctttcatctgaaatatttacataggctttctagtttatgacattgatatttctgaagaacatacttctcttattccttgctcttttaaaagaatataacttttattatttggggtttgtctgttgtttctcataattagaaagaagttatgaattctcagctggaatactacacaggtaatgtttggtccttataagtgttccgcatcagaaggcatatagtgtacatagatcccttagtggcaatgttccttttaattacttgaacaggtcaattttccccactgtatagttacttccccctttgcaattaataaactgtctgctaaaaaacattttcaggccatgcaaatatctcactgctcttaaaaagctcctagatttccaatccactgataatttttggctgatccaatcttgattatgtattatagatttattaccacatcaaccagccaatatttgactttctagtataagcaagagaactgcctctcttcgttgttatttataaatgatcattttatatgtataggcctttgcattaattttttcaattttattatgattattactttactagttatcttgatgcttaatacatttaatattttggtgctaaggttgccgtggatttagcccagtgggttcccattcaagctcctgtatgcttgtgactgtcttaactaaacttcataacttcctagcataacaagacattccaggatcttattcctggcctgtcctagttctagaatcagccatttctccaaggagccctcgtttctttccctagaaaatgttaagagaataaattttagtcactagttgtgctcatttctgtgagggtgcctctgtggctgggctctttcatcaaacggatctatgacttctgtaatcttcacctgcagtttgtaagagtgcctgtttcctacaacctcactaacagagtattttattaagctttccaattttttcaaactgttgagaaatggcatctcagtacagtcaaatttgtgtgtctattaccatgagcaaaatgaaacatcttttcacgtgtttaaggctattttatatattgaattgtgtgtttatgattttgcccaattttctaaagaatttgtaatcattttctcctcaaatgtcaaaagttcttcataaatcagaatatgaacactttgtttgtaatatatttcaaacatttttccagactgtcacatcattggcttattatgtattttcctttgaaagcttcctgttgttattatgtggtcaaatgtatacatattttattgtagctggatttttaggcatattttgatagcttttcctatacccagtatagaggaatttaataaatttttcttcagttattatatagctttacattttatgtatctttgatctacttgtggtttattctgatgtattgtttgaagaacagaaaatgattttacctttttctaaatagctatccatcttctctaacacaatctattaaaaagatcgcatttgtcctagtaatttgagataccacttttatcatgtattggatcttttatatacttgggtatatttctgaacatttttttgttactttggtatgagatttctcagtgtttatatcttcttctaactgattatcatttgtgcctgtatttttttttgcatttagtgttctatttgctaatttgcagaattcttattttttgaattaggtttatcattgcttctctaaagttttccaggtaaactactatgtcatttgcggataggtatagttttacttctcttctctattgtcatatttcttcagtttccttttcctgattgaattgactggtagctctacaatgatgttaaatagtggcaaaaatggtagatacccatgccctgtttctgaccctagtggaaattgctctttctcctttaatttcctcctttaaataagatattgattttagattgatgtatttatacaatattacattaaggaaatatccatccattcctgtttttccaagagtttttaaactgagtgttgggttttgtcaaatcatctttgagcatctactgagataaatatgtgatatggtttggctgtttccctgtccaaatctcatcttgaattgtagctcccttcagcctatgtgtatgtataaggtatatagaaatcataaatgaattttgtgtttagacttggatcccatccccaagatatctcattatttatatgcaaatgtttccaaatctgaaaaaaaattgaaatatgaagcatttctggccccaagcattttggataaaggttactcaacctgtatttcagtaatgcatgttatgttaaatataaatttttatgtagatttcctttatcagactgagaaattttccttccattactagttattaactttttctcattgtgaaaatgtattagtacttgtcaaatgtttttctgcatctattgagtgctcatgtttttctgtttattttttcttcaatgtagcaaattacaggttgtcttttaaaatctcaaaccaaccttctattcctgggataagttcaattggtcatgacatagtattctttttttttttttttgtagcactttactgattttttaaaagattatgaaaaataattaactgaacaaaaataattgctttgtactgtgtggtttcagatatttttagatgtaaaatgtactacaacaatagtacaggatgaaataatttaatagaactaaaatagtagttcacacatatttcccagttctattgtccttaattccttcagttacatctgagtttacattgagtattacttttcttaggcctgagggactttctttaatattccctatagttttgtgcctcatgtcaaaaaacaaaaaaaaaaattcacttagagcttacttgaatatgctttatatcgtccccaatattaaaatatatatatatatatgaatagcatatttaaagtgctgaaagataggaaggcatcctgtgaactcagagtgctatattgaaacatatatataccttcagtgcttctgttaaaaatttagcagttacattattatacgtttatgaatgtattttgttttgttttctagctgagtttacttttttttcatttttgattctttacagctttcctatgatgtgcctatgggtgtttttttcatcctattggaggtttactaaactttttgaatctgtagattgattattttaaacaaatttagtagtatttgggccatcatatcttatatatgttttttcattccattttattgcttctcttcttcttagactccagttgtgcgtgtattagacctcttgatattcctctacatatcactaagcctttgctaattaaaaacactttgtttctctctgttcttcaggttaaatgattcctgttcttttgttttcagattcacttatatttttcctacaattttgaatacgctgttaaattctcttaataaattattcatttcagatagttaattttaattctaagatttctaatgtttttatagctttaatttctctactgaaatttcattatttgttaactaattatgtttatctgtgcctttaagtcctttaacatgtttataactaggcttttaaaattcttatctattaattccaatacttgtgtcatttcttggtttgtttctgttgaatcctattttgtctgatcacgggtcacatttttctgcttctttgtatgtcaaggttttggtagttttgttttgtttttatggtgggctttatggataatatgttgtagtgggtttgtattatgttgtcttttaaaaaaaaagatttttgagtttttttacatcagaaactttactggcataatttacacctcttcagactgctttgttcttagttatttctatttttcttttctctttatttccaagagaaatgttatggcttggttctgacttttaagttttgttcttacttggatctctaccaatttcctaaaagaatcggtgaagtttatttattacgactggatttgaactccaacaattgcatggtctctggaagttttattgttttttgttcctcagttgccatttattgagaggctttgtgtacgctttccctgcacatatggatcttaggctttgactaatttcccagggaaatccccatgcaaacactcaagacccccttcttgacttcctcctcccttctagcatttctcttcttttcagtaccctgtccacaattccagctacatcctcaaacccacatttcagtctaaagcttctcaggtcaaaaggagccagatactctgcatgggcaccatctccatatgccaacgaaagctttgataaaagtaggtatcactttttgtgattttcttccttcaaggattgtaattttacatactttgtcattcaatcctgaaaaccttgacttatattgtttgtccacttttaaattgtttctggtgggagaatatgtttggtaccatttaccttttcatatttaacattttttgaagcttgtttaattttgaaattttaaaaaaatgtgtttattgtcacaactgagaaaatacaatgaaatagaattactagaactcttgacaacatcactcatacctcataccttgttcaaattcaccaatatcaatggtatagaatggaactctgcttactatatctcaatgcccatatgaaaataaacacaattagataaggatttatcttttttgtcttttaaagatataagctcagtgcgtacataacagatagatggctttttatcactaatcaagatataatttgcatcattgttagacaacacttatagatcaatttaattgtatgactgagcaataattaatgtaattatttcttatggattttttttagatttttgaaatcacaaaacatattcagcaaacaacttgttcttgttgcttttctctgtgtgttgggttcctctatgtaggactgctgggtcaaagggtaaaatacattttaatatatttccagattacagtttggaagcaattttctcccctcaaccatgtataagaatgctgttctccctgcctttttgccaaaagatatttggaagtttaatatatctttttcctaccaaattttttttaaaaaagtattcacaaaagccaagcttgactgatataaaataaaaggtggtttcaagtacagtgaatttttttttaaaaagaaaaaggtatagagtgtcctaaagatgaatgagaacatttgaaaggttacatagattagtttaatatatactgaagccacaaaaatgtgtaatacagaagagaaaagtgcatataagatttatcaaggctatatgtttttgttttatgtgtgcttgcattatcaaatttaatggaaacttaattttagtgtgaaattgattcattggcatatttacttgagagtaaacaacttttagaaaagaggatttgcagtcacaagttaatgatccaaagtctgtctgaaattattttacctttggttgaatatccatttagaagataatgatttttcccaaggtcacctacaattaatttgaaggcacttccagtttgattagcaatttcactgacatcattaacaaccaatggtccaccagcctaagaaaggttaaatctacaaatctattaaattccaaggaacactttgagtctcttttattaattttttatctttccttttgtgtatttttcataagacaagaaagtagtaagtagaaactcttgaagcctatgttgaccactgccttggcttaattttgaaattgatcaaccaaaccatgtcagaattttgcctctgcctcaaagctcaaaagggagaatttaaattttgtggtcaaaattataagcaaagcaaatatatcagtaagtaaagatcagtgagcttctcctatttatctttaaagccataaaaatgatattttattacgaatatatgagattgtcctctctatatgtggctctgtatacgatagcatgtttctatgaaatatttacaatatgtctctttacactatcattgttttaaaatatctgattcatagaatttcgttttagtttcatatcatgttgatatcaccttgttatatatagaattcgataatatttcaaagctatgggtactcagaatcttaattttaaaatacctgaaacaccatatatttaatctactctgtgctctagactcaagatatctttataattttggttgaataacattttattgttctctgtatttgacacattaatatataaaaacaaccaaattagtgtgagtatatctttattaaattatccattctccatagtatttttaggcattcctctaaatttttcagagtcaagttgtttcataggactgaaagagtaaaatgatgatattgtagatatttgtagaaagtgctactgaatgtaaaagtttgaagatagtgaaggaaagaaacaatgaatcttcctagaactgttttcttgattggaagacagataactcaaaagaccagaagatatatccttgttatacactgtacccagaatagaaattgtgatccttatagattcttcataaatgtgtaatactgatgccagtatcatactcaaataaccgaacatgcattacaagtttactaaggtttggtcaaaaagttagcatgaatgaacccaataacctatatctgctcctcaattatacacaccacaattatatcctctttaaacacacatggaagacaggtaaaagcttcacatgcacctcataaatctgcacaaataaaaatttaaaaaacaacaaaataacataaaaataaaattaaatatacacaatgacatagcaacacatgaacagaaaagaatcccccaagaatagtaggaagtggaagcctcacttttttctggtttctactgaagtagtagcctctccaggcttttctaactgccatttttatcctgtcacttaatgctttttaaccatttatcttcacagcatttgttagtaacttatgtacacagtttagatttccttgtatgcttgtgaggggagggatttttattgtcactgtacctccagcatctatgtatctcacagtgcatgctgaataaagattagtttatagaagaatatatgacatccatattgtataaagaactttcacaaatgaataaaagaaagactaattatctattttaaaatgaagaaatgaaaatggatacatgaagggaattaataaaatagggaaactaaatgccaagtaagtatagagaactataagcaaatcaagttttccttttgaatgtgttttttgaaattataaaatcattgtaatagtttttttaaagttgctgtatgggcttcataattgtatacttagacttaatcttcagattatactcaaagaaaataatcatattaaatctaaactgactgaagagtttattctctgatccaaaattaaagagctgtgtagatttcactaatgacttaaacatttcaatttggactaaaaaaaaaacacacaaaagaataataatttctgtgaagtttttatttgggtacggttgtcctctgtggcaaaggtaacagtgttaagaagagttcagtttgaactactgattaaagccaaacatcaagtaggtgtgatatgtccatgattcctgattttctgccagtaaaggtacaaattacactgtgttcatgctggcatgtcacagaaatttaaaggcttctctctgatcttttatgccctgcctacacctgattcatgggatgaattacttgagaacagttgatatttgtgaagtcttttgagggaaagtgcacatgaaatcccacattctaggaaaagaggtagatttgtagattccatttgcatttctaaaatctatcttggttttcataaaattttcttagttaacatttatgaaaagcattttatatataaaataatattcagatcctgtataaatctatgggatatataaatgcgataagaaattgttatagtcaacagctggttccatggggtaatggtgagcactctgtcccctgaatttagaaattgttatagtcacttcccaggttaggtacatctaacttgattttctttttttttttttaatatatatatatattttttattatactttaagttctagggtgcatgtgcataatgtgcaggttagttacatatgtatacatgtgccatattggtgtgctgcacccattaactcctcatttacattaggtatatctcctaatgctatccctccccccttcccccaccccacaacaggccctggtgtgtgaggttccccttcctgtgtccaagtgttctcattgttcaattcccacctatgagtgagaacatgcggtgtttggttttttgtccttgtgatagtttgctgagaatgatggtttccagcttcatccatgtccctacaaaggacgtgaattcatcattttttatgattgcatagtattctatggtgtatatgtgccacattagtatttaatatagcatgaaagaaaagctgtagttcagtatgtatccagtctgtagccacatccatggctagagtaaggtaataagaaaccaatagaaataacaaagacaactttgggaagatgtgaattatttgcaaatgaattaaacttgtacttattgtatattttccatcagtgagttttcttttgctactgaagagatatcaatatatacctcattctttatgtgaatatggttatcctcaccacagcagattttattatattcacttaaaattattaatctattgtctttgataaccaataatgaaccaatctgcctataatgtgcttttcttattcatgccatgaacataataaattctgcatatagaatctttatcttactccagcagctccataaacttttaaatattgggtctcttttgatctagtcttataatatacaaaggtataaatgcctagctttctgaagtaatacttcaatttttagtcatttattaatataaagtaattcctactttacttttagatatatttggaaatttgcccaataagttttattcagaaagacaacatttaaatcttcttttttcatacatggcactttgttgtgagaacctgaaagttagagatagcctacatcaaaatctaatacattagaccttctcaattacttagcatagagaagtagcatgtgaaatcttctattgaggtggcatatatgccatggctattcagagctgactttgggatcaagttattcaggttttggttcacttaaatgagaactttgcatgcttttattatttatttatttatttattttttgagacggagtcttcctctgtcatccaggctggagtgcagtggtgcgatctcggctcactgcaacctccgtctcctgggttcaagcggttctcctgcctcagcctccccagtagctgggattacaagcacacgccatgatgcctggctatttttgtatttttagaatagacagggtttcaccatgttggccaggctggtctcaaactcttgacctcaagtgatccattttgttgggtgctttatatagcttgttcatttacatctcactaagaccctgtgaattaggtattacggtccttgttttacaaacaaattatttagtgaccttcagtgattttccaaaggccagatttgtatctctgatacttaaaatatttaaatggaaattgaactagccattgtatagttagaaactgaggaaagaaaggaacctctactacacacactaaaattattaaaaggagaaaattattctctattatgtatttaaataaatttctcaataaaaatttacatataattttgtgtctttttatatttgagtatatttgtcatgacgcctgagtcaatttccagtcattgcgagggacttctagaagaagtttaagatgtagaaaaatacgtataatttaacatagcacatcatcagggtatctgagcattatgatagctagactggaaggtggtggaacaaagagaacatggacatgggaggcagtgaaatgtggactcaaatccagggtttgcccttgactgcatgtgtagtcttggtcaagttattcaacctttctaagattcttttttttttttgagaatgagtcttgctctgttgcccctggctagagtgcagcggtgctcttggcttactgcagcctctgctgtctcctgggtccaagtgattctcctgcctcagcctcccaagtaactgggattacaggtccctgctaccatgcccagctaattttgtattttcagtagggacggggtttcaccatgttggccaggctggtctcgaactcctgacctcaggtgaccggcccacctcagcctcccaaagtgctgtgattacaggtctaagccactgcgccccacagcctttctaagattcaattttctcctatatagagtaaaagtagaaatttttattttggatgaatctaatgataatttgattcgaatatataaaatatgtacatttttacttgtgaaagttgctattattattattgatatttttcgtatttaatgttgtttgaggaatgagaaatagattctatatgtattctaaatttagtttgtgaagagaattattattttaataaattaagaatcaattctgtgacctaaatcttctgattgaagcagcctaaaattgtgtggcacaaattatgatattccagtgctcatactccatgaatctgtgtaatttcatcgaaggcttcaggatcacgctgaaatttctagtttaggaaatcaggtgtaaaatgaaatggatatttacaaaagtcagagagaggatttttttgaaatgttgattattggtgaaaagcaaaatatgatacttccagtagctgaacctaacctttcaaaatccaagagcataaaataaggatgtagtttaaaattagaaaacactgtgtatcacacacacacacacacacacacacacacacacacacacacaccttttaggagaagtaaaacgggttagtttcataaacagagtcaattgttttaaaagggtaaagaaaagagagaaaatacaggcatttttaaagtttgggttttttaaaagcaagtatagaaacaaaaataacataataaatgaatgtaaccatgattagctaaacttaatattctgtacacaaactcattttggataaaaattgcattttcttaaatattaattacctttgcttgactccttattaattttttaaataactgaataaaattagagaaaattaaattttgtcaagcatttatatcctttgtgttttctgcttcatcaataaggaagacataattatgaaataccggaaatctcacgtatttcgttttctccccactccagctaatcctttactcatagctcagattaatttagagttactttagtaagaattatgttacatttattttttagaccaattcatacttttaatatagatttcacattaacaccgtaagacttccttgaatccctaagactaggcgaggtgtttttctttagcacggcactagcaacacttgttacactcttatggaacttacaatagatgaattcttgaaatatcttgtgccttagatataatggaatgactcatacctttaaaataagtcatgtaccatagtataattactaaattatttataaatgcccttcattagattacaaccttttagaggccaaagaccaaagttatctgttcccactgtatcatgagtaaaaagcacattgcctgcttcagtgtaggtgacacatttttatgaaaagagtacataaaacagtgtcacacataatgaatttctgcagatcctttcctatctttgttcctttgaaatattactaaacttttaataacatcaaccattataatgtgtcaactctgagaaacaatgttatttttctttcaaagaacctacacaagcttttatggtagatgcttattcatgatcttttataacattttgtaaaagaacatagattaaaattcacatttctctagaaagacatttcaaatgggtgttttaatttagaaaatgaaaaaatattttgctctcattgatattttcaatatctacatttatttaaagagagggaaatcaacttaagtgtataaacacagaaatatacatatacacacatattcactacatgtacccttacatacttcatatatgtctgtatatataaggtatttgacaaaatatatatacacttataaattaatgttgctgcattaaaaaagattaatgaaatttttcttcatgtacttatgttaattaccttttttcatctttatttatgtgatatgcactccatagtttgtaatgacaaacttcaagataacatttcaaagttatctgtgcgaaatgatcaaaataaagatatcttttatatatgatattatattgtggacagaaaagaaacattgtgggaatacattattattatggagataattctaacatttattaattggttattatgtaccagatagttctcaaaatacttttctataatttatctcacttactctgtacatccaatctacagagtaggtgctttttgtccatattgtatggaagaggatactgaaatgcagtgagaagaaacttgccttgggtcacattgcctgtaactggtccagcctgaacccaattccagaaagtctgattctctggtcccggtttctgaccaccatccatcccacattgctaaatacactacaccatgtaataaagattcaggaatcttcaacattaatggggacttaatatgctgtaagaaatgcacagaattttcctgtaaggtttcattcattcattcaattatattattttggttaaaataacgtttccaaagaaaaagaagttttaaaactgttaaaatgcagttattgctgttgggtatcactgaacctaattctgcagacttgataaagcattctaccatcggcctctaaaatttcatcagtattgtgcagaaatatatgcagagagctaatcattggccgtatgccaaaccccattctgaaatcagacagggaaatgatgtcacgttgtgaggtatattgttaagtagcaggtgtcctaatgatttaaaaatcgttatattatcttttaattacttccatacttgttttcttttgttgtttatctttgcctggatcctccctatactcttaagttcagtaaatatcaagtatatatctttctttttacttcaaaacaccagatcctagttgacactgtcaatatcttcttaaaaaaatttaatattcgctaggcagggtggctcacacctgtaatcccagcactttgggagaccgaggcaggcaaatcatctgaggtcaggagtttgagaccagcctggccaatatggtgaaatcccatctctactaaaaatacaaaaattagcctgatgtggtggtgcatgcctgtaatcccagctacttgggaggctgaggcagcagaatcacttgaacctgggaggctgagttttgcagtgagccgagatcgcgctgctgcactccagcctgggtgacagagcgaggatccatctaaaaaaaaaaaaaaagaaaaataattgatgtttattatatttcgggagaaaaaaagatcagaagtttgggaaaaaattcttgttgaaaataattttttaataaattgtaatagacagctttggcttgattaaaataaaaatatgaataagaaaaataaaggtcccaaggtagccaccaccatgttcattccaaggaggaaaatcttacatccagatgaaagttttcaatgaagaaagataagaagaattcttttagataaagttagagcaatgaattagtggtttagtgtacattatcatcacatagggaacttaccaacatgcagatacatggaccacatcccatcccatgcctagtaagttagtatatctgtttggagaacacagtagcctgcatttttaccgtgcccaactagatgccgaaatttcatacttgagaaacactggtttaaagataaggaaaatattaacatcagcagaaactattgtgtagaaacaaacttgatagtatgtaagaatatttgtacaagaattgtactaaatgtaatgtttagtgaaaagaaaaggtgtggaattgataatgccctgaatagccatcaatagagaaataattgaatacatttttttccattcatgtatataaggcaatcattaaaaatttgaccagatatttataaactaatctagttagactcccaaggtgtacagttacatgagaaaatgataagaacttctatacatgtgcatttgaatctatgtaattgtacaaggctgaggaaaaggttgaagggtgtaaaaactaggcaattaacatggattgaggggtttcggggtactggagaatagagaagaatatacagaaaaaaattaaaaactacatccaattaaggaatcatcgagacagaaaaatgaagaatataaatttctgcctattacaaatagaaaaaatagaatatgcacatggacaggaacaggatgtgataaggtaacattgtttcactcttaggattattggttacttcatcattgattgcaaaataatgaaacattgaaaattaaatggaaaaagagtatagaattttgatggatggcaatggtagtaaagccacttgtaagtgaaatgactgtcatccaaagcacatacatatatatttgtgtatcattgtgaaatttgctgcataactataaagaaatcaaaatatagggggacatgtgcaattttgtagtctcgttcttgggggtcagcaaacattttcaacaaagagccagacagaacatttattatgctttggagggcacatagtttccatccattacaacttaccagctctacccttgtagtgcaaaaacagctgttgataacatataaacaaaggagcttagctgtggtccaatgcaattttaaatacaaagggcatcaggccatatttggtgggagagcaatattttcagcttctattctacactgacaaaaaaaaaagatgattataactgtccacatctaacctgaacaaacgtgatgaaagcaagtgagagtaaagtctacttgtaaactgcaattctaatgcaaaatagtatatcattacttatgttttatgttttagtatatcactactttcctaaattaatgtatgtagttgtttcatctgtgtttccttacaggagggaggttatagaataaaaatgacatttttttctgtctattttgattacaattatagtcactagagagaaaaggttgttttattcttttgctgcttctgtctgcacattctgttaagtcatgcattgcttaatgatgggaatatgtcccaagaaattcaccattaggctatttcattgctatgagaacatcatagagtgtacatacacaaacctagatggtatcgcctactacacacctaggctgtatgatatagcctattgctcctagtctacaaatctgtatagcatgtgatatggtttggctggtccccacccacatctcatcttgaattcccacgtgttgtaggagggacccagtgggaggtaactgcatcatggggataagcttttcttgtgttgttctcatgataataactctcatgagatctgatggtattaaaaggaggagttccctgccggccacggtggctcatgcctgtaatcccaacactttggatggcccaggcacgtggatcacctgaggtcaggagttagagaccagcctggccaacatggtgaaaccccgtctctactaaaatacaaaaattagccgggcagggtgacgggtgtatgtaatcctagctacttgggaggctgaggcatgagaatctcttgaacccgagaggtggaggttgcagtgagccgaaatcacgccactgcactccagcctgagccagagagtgagactttgtctccaaaaaaaaaaaaggagttcccctgcacaagctctctctctttttgcctgctgccattcatgtaagacatgacttcctcctccttgccttctgccatgaatgtgaggcttctctagccatgtggaactgtgtaagtccaattaaacgtctttcttttgtaaagtgcccagtctcgggtatatctttattagcagtgtgaaaatggactaatacagcatgttaccatactgaatactgcagatgatggtaacagaatggtaagtacatgtacatctaaacatagaaaatgtatagtaaaaataccatatgaaatattttttaaaataggacacctgtagagggcacttaccatgaatggagcttgtaggactgaaagttcctctggctgagtcactgaatgagtctgagtgaatgtgaaaacctagtccattagtgtacactactgagaactttaaaatccagtacatttaggcatactaaatttatttaaaaattgttcttacttcaataataaattaatattattttagtataacttttttactttataagcttaatttgtaaagctttttgttttgtgataaagaatgtttctatgatttcaaatagaaaacatatgtaccttattttgttaaaaaatgaacagtacctggggtaagagccaaaaacccaagattacatttgtgatatgtgagttctgtgatatagggaaataccatgaagctctctggctcttccttagcctgtgaaatgtgtcagtgaagtctttttatctagggcactaatttcctctaataaaataggacaatttaagataaactggaaaagcttggggcagagttaaaaattttggaaaggagatttccagggaaaaacataaatctaagatacctacctcttcatgatgaaattggcagagcatttgggaaaaaatattacgacagaaaattatgcaagtgaaaaaagaggtgattaataagtgtgagtataggggggaaatagaggtttactccacagaggaaatatatatatttgttgacaagttgaatctccagtgaaggagccaattcataaacacccatcattgatttaactaaaaatagatgcatacttatgaaaagaggacaggaggaggagatagtacattgttaaagagtgaaactctcacctatataagaaaaatttaatagtacatgtttaaaagtagataaaacaaggaagagaagtctgtacatgttatctacaaatgtttagtttaactaccattggaataaaaaagtcaaaaaatgttaaaagattttgtcttgatggagctggactgaggaagtagaaaggtttgaatttaagaactaaattttcactataaacgcttcagtggtatatgatattttaattatatatttaattatattggataaaaattaacatatatagagagcatttgaccaggtgcagtgactcacacactttggaaggcagaggcagaaagatcacttgagcccaggaatttgagaccagcctagacaacaaagtgaggctccatctctaaaaaaaaaaattagatggtcatggtggctcaggcaagagggtcatttgagcccaagaggtccatggtggaggctgcagtgagccatgattgtaccattgaactccagcccaggcaacagagcagagactctgtctcaggaaataagtaaataaataaaatagataattataaaaacacattttaaaaatttaaaaaattgacaaatatttgtacatattcatgggctacatagtgatgtttcaatacatataattcatagtgatcaggtcaggtcattagcatatatatcatttcaaacatttatcattttcgggggatgagaatgttcagtatcctccttctggctatttactagaaactatactgtattattgttaagtacagtcatcttacagtagtacagaactctagaacttatttttcaattcagttgaaaaaatatgggtttctctgtaaactgagtcaccagcgaaatcttattcttctgtaattccataaattgccaaatactaggtttgttctaacaaagtgccaaatacttggacaattgctcaggtgaaaaatgtattgattttgaaattgattcaagtgtacgttctcctttcagcttcattgtagagctatatattcaaacctatactatatgttagtataaagtctatacctacagataagttgctattttacattgcgtccaaattgaatacagctagatttggcagtttgaaccaaagataattcatctatttcagtgtgcctgaactacataaggttctaagaatgatggaaaaactaggcaaccttgacataagtgcttaccaagttctttgagaatgcagataatattgctttttggaaatttttcagaataaaaggaaatatcaaagaaagcctttgaacaatcatatgtcaatggcatttccaagatggtggcatctccagaaatacttcaaaggagtatcatctagtctttttcagagtgccccctggaggcctaatcaagtaattgtagttccttctcacttgcaagtaaacaaagacaatagaacctcattcagtttttaaaagaggctcttcagtcactggcagcagcagccaggcaacagtaatttgcaagccctgccctttattaaaattcattgttgctttcagagttagagaactataatttgagagatccaagcaagactaagaagaaataacattttatataatcacttccaagagctgctatataattaaacacatgtgcaattaattttaagcaaaaactgcagccattgtgcagtgaaagttgctttatgctagccctggtttatagcaatagaatgaatatgaagtcaagtgttacgatttggcatgcttccagtaaatttacaattttgtgaaagcgccatcaatagagtattgtttttgctttactttacttttctccagctttgtggctctgttttagtaacagaacatgtggcatactagctgtggcagtttgggttatagctatagggtgtgtaataccaaaacatctatgttgaaatttcttttataaaataaaagcaatcctactcaactggagagaaaaataaatgaaaaattgcatatttgattttccataaatattatacaactattaaatgcattcataaattgaacgaatcatgcaatactctgatttacatgggataaattagaaataaacttcctgctctaaaggtttttttaaaaatcagcatacgatttttatttcaaaagtcacatgctgtctctgcacaatgctctggttgtagtaatagccaaagttgaaaagcagggctacctttaaaacattatcatatcatgtaattcattaaaaattcaagtttcattgtttttagattaagtgaagaatgcacaagttttgtattttatgatggattccctgataatatatagtatccttatcaaaaacaaaaatctaataaacagctgtcaatttattctttaactcaagttttaatgttgatttgtgtcattctgactcacataaggagtggaagagactggtggagtagagctccaatcataattttgaaatttgttatgactaatttcaattaacctttgactgtaagcccatgaggattttgaacttttataatatatgaggacatatattataaaatacagggaaccacactctcaatgaatttcattgctgtgttgaaatgatgctagcagtggttcagacaataaatatctgcaaaacccagctttgaaatgaggaattgtttttagcattttagaatccttttagcagagctatgaccataggaaaagattttaatccatgggtaaacctatgcaatgagatctagtttaaaataatacaaggagatctttcacatgaagttgtctctacaaagggttctgagagagatgcaaatagtctggagaggccctttcaattggatcttgcttcctggtgagttttctacttcaacctaattaattaattcaactagcacttactcagcactttctagatgctacagattgcacaatacactaggaaccattaatgaacaaatagttataacctctatacagaagaaatttttgttcttcataaataataaagaagcaaatatcctgttcagtaattattttgcataaacgctattaaaaactggagattaaaaaataaaaggctgtttgaggctgtgacatttaacgtaagactggaagaagggagcaagtgtagaaatagatttgcttcatcttcatttcgttatgaagcaaatctatttctacacttactcccttcttctagctcgttctgcacgtgtaacccagaacttaaagtataataaaaataataaataaataaaagaaatagatttgctttgtttcaaggaactgaaaagaagcctctttagctgtagtatagtgtgcactaagccaggacacctagacattttaggacatggatgatattataaacaaaatgagagtcagttgaaacatttaaactgggagtgacatgttatgatttaccttttaagattatcactcttgctatgtagactaatggattacaaggaggcaaaaatggaaataggtattccaagtaggggcatattgcagcatcctagtgagagacttggttggtttgaaataaggtggtagcaatggagattgaaagaagggcgcaaatgtgcagtatagtttgggggtagatatggtataatccacagatgaatcaggaaaaaaaaagaataagaggagtcacagaaataaggacaattcccaactttctcctttcaacaattggtaaaatgctgccggttattaagatggcaaaaactgggaagaaaagcatgaagcccattttggatacgtgaaatttgagattcccatgaggcatctaaatggagatgttcaacaggcatttgggtatataaatctgaagcacagaggagatttggactggagataattgtgagagttatcagcataaaatcaaacactattctcattactcatgttaataatcaaggccctgcacctggaagagcagctccagcaatgggaagcagcatcttcagctccagatacttctgtcctttttcctaacctttaataagtcatttttttaatgtattccatttcccaagaactttggatagctatggaaattataatttccatagtgatgaaatgcagcatagtgtaatgggaaaaaatcattcacctcacataaaaatatacatccattatttattaatgttgtggctttcagcaggctgctcaatgtctttgggcctctattttcccatcctccatgaaaatgggcagctaaaaatgccctttcaacctatagagtagatgtgtgcacattttgtgttggaaaaatccagcataaaatgtattagttaaaaaaataataaggcagtttttaaatttaaggtgttattaaatagagcttataatattatcccacccagatcatattgtatactagaaaccatcttatttaaaaatagtcatgccaatccaaaaatgcagacagatcaacagtaatctacttggtaccagttattctcaatgatgaataaaggctgtttcaatgttttgtctgttaaccatatcactctgataataatttttgcttaagaaattgaaatctaaattttacacaggcttgtacacaattgttgaccttgagaattgtctaaaatataacttatttataagttcctgtcttttagtcattgacattttgttaagaagctattcagataaagaaaatataaatgaaccgtcttcaatgtgctgttgttttcagttgcaaatatatactatatatatttgaaattatatatagttaaatatatgtttaattttaaatatatataatttaagctaataccatcatgaaagtacatttgtttccaattagcataatgagagtcataattaatactcaacatctattggaaattgaaattagaaagaaataatttatttcaagcaggaaattaaatatttgattgcttttttaagtaatttcagattacaatatctctaacgttggctctgtttaattcttttggggattttgataatcccgcacattttccaaatgaaaacaaggtattaattatattaaatggagaatagaaaaatgggctgcagtttccaaaatggtcagtagagagcttcagtaaggttactattaacacttcctctacttctttaagggagtaatgattaagtcatattaatatctaacattgcaaaataaataatcatttagtctgtccaaaaaaaattttaatactaagttaaaatgtaattatggacttctttttaaaaaaaaacaaaaacaaaaacaaacacaacccttctgagttagtgtatgaagtggaaggaaaagaaaggatattttaaaatggtggttagtcactttctttgtcaatttagtatgtgtatgtttatcagctccaaaaattggagctgataaacattaaaaatcttgctgaaggtcacccagctaataaatagcaaagctggaatatgaatcaattttggtctcaactccaattccacatggataatacatcacatatatagtatgtatatacaacatacacatactaaatttaacaggatgatggcatatgtgcagtgattatgatatgaagtaatccacgtgtggaagttattatctccagtttacatatacaaaagttggagctgatgaacatgaaggatcttgctgaaggtcagccaagctaataaaaagcaaagctagaatagaaatcaattttggtaccaacttgaattccacatgggtaaccactgcacaataacttgaagtttgcattaatctttttagatgtattacagaaataaataggtattcatgtatgattatcccaacattaattggtttatttttactatttttatacaataggaacaactacatttataaagattgtatatgcttctcaaatatagttagttacatgacaccagtgctgaatcctcttatggtaagcattttatataaaacattctctccatttagttctgtccacctagaacaatgttgtgctatctaataaacagataattaaagacattgttgaatatataaaataaattatattgaactattaagattgtcataaaatgattatatgatgtttacaattattattgacagaaaaatgatgtataaaatattctgtactataagatcgttttaaaatgtgtattttctatagaaaagcttggagataagcacatcctgctaattatctctgcatggcataataatgttcacttgttcataatttattataaagtttttctacagtaaatatacattacttttataagtggactcaacatcattacagtaataataatatatacatataagatttggcaccaaataataaccaaactaactttttaacatggcttaactcttcacaaatgtttatcccctgcatttgttgattggatccccatgggaccactgtctagtacagaactgttttggatttttttttggagtatttgcataacataatgaaatgtcttggtgatgtggcccaagtctaaacatgaaatttatgtttttatatgtgtgttatatatatatataggctgaaggcaattctatacagtattttcaataattttgtacatgaaacaaagttttgactgtgacatatcacatgaagtcagacatagaatgtcccacttgtagcatcttgtctacactcacaatatcctgggttttgaagaattttgaatttcaggtttttggattagtaatgctcagcctgtatatgaggtagatattattatcactctatttaatcagtgaatgtttattgaacactttttatgtcctgtactctgggctaaaatacaaaaatggacaaagtagacatagaccatgccttaataaaacaagtaagaaaattgttccacagaggggttaagtacttacctgagattgcacaaacagaatgtcagggcttgagatacttttaaaatcactttactacaagttttaagaacacgcttagacaaaccagtagagtaagaaataattatatgagaaaagtgaatttaaatcataggtgtcattaatgccaggaagatttcagtctttctgcaatgggaaataaaacgccatgataaatttctaagtgtgaaaggtactttaattgactgataggaaataattagtttaccacttgttcaagacttttttttctctagttgaagaagtctccttctgtcgtctctagtcttctcctgctctctgttccaattcagccttgattctcttttcataattacatttaaaaaataaaatcctcgtcatgctctttaacttttgtgaaagtgtttcatgtgctgttctgactgtgggctaaaatctaaggtaatcaacaatgtttacaaggttctttacaatctggccccaaaatgtctttaaagctttgtgtccatttgtctatataacagtatcttctaaagtctattcaccccaatctgcccacctttcccaaataagtcatgtgtattcatacctctggctttgcaaaatgtcccttcttctgaatagtctttcattccatctttacccagtgagtttttatgcataattgaagagccaaatcaaatatattttttcagttttccagtagaatgactttttttctttttcttgtggccccatgactctataaaaagaaaaaaataagaggagtacaaaaaacatttgcagacaaatagctaatagcttaagagagaaaagacaaaaagaagctatcatgcaagagaaaaattagataagtatctcgtggagtgagaaagggactgaagtttccgcccaatatttattagagaatgacatttcctaataaattaactgaaggcatttggcaaggatgacacctttcctcataccataagttgtcctctaatatctgtatgagaaggatgtacaacttatcctctgagaggaagtgaaggcaaaaaggtggatatggatttgttcccaaacccttaacactgagcactatatatgcatgtgtgtgtgggggtgtgtgtgtgtgtgtgtgtgtgtgtatatatatatatatatatatataaaatataggatatgaatattatatatatgtatccaagtaaaagttaaatagatagagatatagttatagatatgaatagtaaatacctatctatatatttatgtaacttttacgcaccattaggttctttctcatcatgatggtgggaaatgcagtctgttgtacattagagaatcctcctctttcatttatccagaatccccaaaattagagttaacagatttagcaaataaaaatacagagcattcctgcaatacttgagatatacttatattaaatatttacttatctgaaattcatgtttaactggacttgtattttctctggcattcctactcaataaagaaaatcataatcatcacagagatgattatttttcctagcctaccaattccatttgaaggctcagtttcaaaacaccttttttctgacttgtaataccaagggttctagatctcagctctttcaatagtctgcttctgttccagagacttcaacatcacatgtatttcctgaaatacaaaggtcgttaacaagcacctgaagcttgaaaaaaaaaaaaaaagcttggaatagggtaatgggcagtgtcatgggaaatcgttttcagtagtgagtgttttttgtaagaaagaaaggaaaaaaatagctcaatcacttgcttttgcagatataatataaaagacaatataaggacaaccattaaatgtctttgatctcttgatgtcagtgaagtagaggcacaatgaatgacctgtaattgagtgtggggactagaacagtgtaagagaagtagatggaagagatcaggggcaattgaagatggaggaaggttctgtaacctatgccaacactttaatgaaatatgtagtaagttgccaagactttaacgaaatacatagtaaatatctttcttggctcagttaaacaatgtgaaagctacttgtttgtaagctaggtataggccactgtgaaagattatagcaggattaagattatggaggcctattaaaatttactgcatcaatattaactattatgtttgaggggttttttcgaaaaatttaaaaaactttactttttaggtcaatttttgtttcatagcaaaattgagcagaaaatacagaaagttttcatctccttcgcctacacactcacgtgttcccccaggattagcattctgtatcagaatgatacatttgttactatcaataaatttatattgacaaatcattatcattcaaagcctatagattaccttagagtttactcttggtgtcatacattctccagcttttgacaaatgtacaatatatatctaccatcatagtttcctataaaataggttttactggtctaaaaatcctctgtgctctagctattcattcctttctcctctcttttttaacttcacttatttgtttgttgagtacactctgtgtgttatattaacaattgaaacaaatcaattgatcaatcatttcagaaatacatggtattactgacaactacatttagttacatattatagcaatgcatcttgtatatttcactatgtagttttgtctataattacagagtaattaagtttttagtataataacttaaaggcagcatggcagtgtcccctactgttttatcacgttaaacacctgcagatgtgaacatgtttaaaataatgttatattttggtataggtttttttcccccaaagaaaattggttcctgattcaacaaagttttatattttttccatttatggaaattaagtccttcaattctacaatattcatgttgctttttattgtttagacacatagtgtgtacactgaagtaaatttaaataaaaatgagtcttatttgcaggcatattcaatacatttgctaaataataactccaaatcttctaaaatattgtctatgtacacatttataaatatttcatacttattcataaacaagattgcatatgtcacaagaaataattcttttagatttaagattacatagaggttttaaagtcggtaacctactgcacagtatacttaatgtgatgtccacatcatagtttatttatgcaatttccaatgaatgtgtaagtcatagatgtggaattttgtgtttagataaaagaggaaacacgtggtctattactctctcctgaaacccatctcaaacattaaattgtttttaaatggtatgaatgcataagaatatagataatgggagataattaaaatcaaacagtactttggaagctggtaatcagatgaagcagtagtaacagagagaagtcattagaaggttgaatcttaagtcactagtaggaaaagctaagaagcaatctagtttatatctcagaattcctggaagtctaatgaattggtggcattaagaacctctaaaagaggcagtgaaagtcatgcttaaagcaggaagattgcttgaaaattcaattaagaagcaataagaggaccaaaaacatgcaactaggcatcttcccattttctacctcagctaaatattggaggtcttgtctctgaatgtggtaaaacagtctctgaatagtaggtctcagatacaattgaaaagagaggcacaatacgaatacgagatggaataagtgagtgtttccatgcaaaatattgacacatgctccacacacatttttcactacttaactcagaaagctgcagctaggtctgtattccctaagcaggtgatggagaattcttttactttgagtataagcagttcaataggaaagaaatgctgttataatgggtctcttaacaaagcaatcaagacaatcactacacagtaaagtacaaatgtatcaaatgccacacttgtactcagaacatttattcagcgttttacttaactacttagaaatagcaaacaaaaatcatctgatttctgaagaagttctctagcatagaagctaaagtccaaaacaaacagaatcgaaaaatttgaaagaaaaaggaggactataagaacagaagaaaacttctaaaatgaacaaacaaacctaatgtaactgttctctaaaatatataaaacttgaacatgattttctatagaaataagaacaaaagaaagctcttggctataaaaaatatatgtatatgaaatactcgatagggtttaaatgtaacattaaagaaaacttccataagggagagaaaaaagtcagagatataggaaatagaaataagagaaaaagtggtagcagcagcagtagtcatttaagtccagaaaagtgttcaaataataggcatttttgaaaggtaaattagtaacattaaggggagaaattagctaaacaaatagcttttttataaagcagaggacaagaatttccatactgaaaggaaattccatatcgaaagaaaattgaaagggtgctagacccagcaagcatctagaacaatttaggaaaataatgccttcattgtcaaatataaaaaaaacaacaactgtgaactgtaagaagatacatagatttttagcaacagaaataagtagctcaaattcaaagtgccagaattcagaatggctttggttttcaaaacatcaacattagcacagggccttgccttccaaatcctaatgtacatggtttccaaactatgaatctgaaaaaaattgaatatccaaatctctcaggaagttaaacacatcaacaagcaaaaaaacaatccaattaaaataggcaaaagacacagacacttctcaaaagaagatagagaagtggcaaacaaacatgaaaaaatgctcattatcactaatcatcaaagaaatgcaaatcaaaaccacaatgagataccatcttacaccagtcagaatgacaattattaaaaagtcaagaaataacagatgctggcaaggctgtggagaaaaagggaacacatgcattggagggaatgcaaactagctcagccactgtggaaagtattttggagagttctcaaagaacttagaactaccatttgacccagcaatcttattactgggtatatacccaaaggaaaataaatcagtataccaaaaaacacatgcactcacatgttcattgcagcactattcacaataggaaagacatggaatcagcctaggtgcccatcaacaccagaccggataaagaaaatgtgatacatagacaccaaggactactatgcagtcataaaattaatgaaatcatgttttgttttgttttttttttggcaacaacatggagatgaagctggaggccattatcctaagcaaattaacatgggaacagaaaaccaaacatcacatgttctcacttataattgggagccaaacactgaatagacgtggatataaagatggaaataatagacacgggggacttctggacctgggaaggaaagagggaagatgtgggccgaaaaactgcctattgggtattgtgtcagtacctgggtgatagaatcgttgtacctcaaacagcagtatcacacaatatgcccgtgtaacaaacctgcacatttaccctctgaatccagcataaaagttgaaaaacatttctatacccatagaaactatcatggaatttgagaatggtatgaacatgtatgcccacgtgcattatttatctcttaaacatccattctctggaagttcctggtgtttctctgtaacaaagaaagagaacattgaaagatacagaaaagaaaatatccaactaagaagaaagttgaatctaatatcaagaacactttctagtaatagaaacaaatgtccagatggagaagattaaagtgctctgaaaatttttctttaaggaattgaagttaaatgcctaaaacatttaaatgtattagaaagagatttaaacaattggcagagtttaaagttgtggttacactcaatatgaaataaatgaaaaataaaagacaggaaattgttaatgtcatggaaaacaaacatttaggaaacaaaagtattcctaacaatgaatacctttgctaagaacagcattcgcaaagttgtgatgttaacattcactgtttcaacaaaaatcataggaagagtaagtcgcaggggatcaaagtttgggatgataaaaaaaaaaaaccagagtaaatctttcttttccaccataaggaaataatttataatgctaaaaacatcgtcatagacatatgttttaagaggcagaggtagagatcagttaaaagggttgaaaagatacttacaatggcttcaaagtctaaccctctggctttgttttggcattctgttttcatttcatctcagtctttccctcagttattccattcccaaatggactcttgccattccatcaactctccatgcattctgtgcttcaaggtcattgcatttgcagttctcgtttcctgaaatgttttctcagactttccactacccttccttactttatatttctctttaacatttattattatctaataatacagtggtaaatattacatgcattattgtatttattatctgggtttcctctccaccacctgctcacaagtttacctcacaggctctgtgagaaaaggagtatatattgttcaatgttgtatctttgaagaccaatttttagcgttcagtaggtgtttaataaataagtgaacattagatagtattatttggttggtgcaaaagtaattgtgttttttgctattactttcaatgtcagaaagtacaattacttttgcaccaacctaataagtaaataaatgaataaaaaaaaattataaatttataacacatgaagagtcatttctaaaagcttataatggcaaaataaaagaatacatattattttaaaggctaaaataaagatttaattatgtttttaaagcacatgaattctttacatttcaataaaatatttccaaactatattatcccagaaaacaaaacatgattgcaaaaaggaagcagtctataattattgatgttctcctgtgtgagttcatgtgacttgctctgatttttcaacaggaaaagttagagaagaagagttctgaagtatgagctatttttcctttctgacatttcttgcaagattccatttcattaatagttttattatgcagaactcagttattgtcattcagaaacagtttggagatatataccattatagactttgcatgcataaataagcatattattaataatcaatggcaattagcacacaatacatttcctcttaaatttaattatatgcttgattaagagtgttttcatacttaattgaaataagaaagtccagtaatacttaattctcacttaaattcatattacaatcctaataactccagttctcactcaatccatgcaaaattcctattaattttaatcagaagtatgcttgctcactgaataaagcctgaaatacagttggataggtcacatcaggaaaaattgtctgcagtctgacagtatagaatgaggaaagagtctaatgcaagcaatcaaacagagagataattgtcataattggtttcaattaggtttttatagctttggtgaagcaattctcattgtattgtatcatgaactacaaccagtaacaaaactagttagcatgattagtaggtataatgcttaaaaaggtaaaatacattctaaatgttaagatctcagtaaagataaatgaactgaataacaatgtaactgcttcgttgggaaacctttgccattgttaaatgtaatgtggtttgaatggaatgaaatcagacatattcaataaactcaaggttcataaatacatattttctgaggaaaatgagtctgtgcccaaatgatcaccttttcagtatgaaccagtgaccattaaataaagattagaatgtgatgatattaagaaactcacaacatagttaaaatcagtgagttcctattaatttgtttaagtaacccaaataaatctcagtaatgatgatggtactcaaaaagaaattgaagtatcaatagtctcacttccacatgcttatggtaaatggcagagataggattcgaaggcaggtttatttgattttattaatggaagctttatcactatatttcattgtctaatgttaaggtcagctgcaacaaggcaaaccaactggaacaagcccttctacttgtttttaattttctcccatacttttagaattatccctgtagggaggaaaggttgagcattactctagaagggcaaaataatcaagatttattgtactccttgtcatccaagaaactcttatggccgtggttcccaattgcacactattactgcttgtataaggattattgtacttggcttcaatccagaattcaattattcccccaaggggattgagtttccaaagagatttgaaataatttgagatttctcatattttcctatctccccaatttttctttgaattaaaacaattctttaaccaaataaatatctggagcttagtatatctgagttgaagagtgaccattttaaagatgcgcattaaaagtataatatctgacttgattatggtcacaagtcaattgaatagacagagcatttacaaattaaagaaacatgtagaattcaaagaaacaataaaaggcaaaataatatgtttaaagacttttgagcaagtggtcaataaatataatagaaaataaaaactattgcttcctgtgtgaaggtaatcaccgtggactgaagagtttggaaaggctttatggagaaggtgggaattggtttagatcttgaagaatggaaatatctggataggcaaagaaaaaatgtggagatatttcaaatagtgtaagcaaacctgtgaagcaagaatacatgaaacatattgataagcagtgaatatttgacagaaatagagcatgtggctaggcaagcgtaaggcaattttggagaagtataaaggggtaggattgtgtaggatcatgatcatcaggtgagaaattggacttccttttatggacacagaagaattgtgtaggacagtttaaagggtagttaacctttaaactgaaataggatgaaggggagttacctacatattaggtggggtgattgaataaattctactaatctccatttcactctctttctcttttttaaaatgttagagaaaaacaaaaggcaaaactcaaccacatttctgagactctcttgtcaatgtgaatcaaacatgtacactcatataaaaatgaaacacgaaatttatgcacacaattttcctgaagactctgcctgttggtttcattatcagggttgtaatttaactacagaagtttccagtattttccagctttaagtgaataaaacagagtggtcatatttgtcacctcttgttacaactccttgatccttgaattacaattttaggtgattttttttccagtctcttttcactgttctgaggttggtgatgaggtgacagtgactctatgtaaactttactccagtggtgatctcagggtagcagtccccttgatgtagaaatttgctccttagttcagctaaaactggattcgcatcacatgaccaagaaggattaggaatgcagacacattgaaaggtgaggggaatggaatttactgggtgaaaaaggaaaagaagaagaagaagaagaagaaaaaaaaaaactcccagcaaagtgaaaggggttcctgctaacagccccccgcccacctcacagacagaatctcatattcatgagaataaatattgtatataactgatatccccctaaacagaaggtatgtaaatccacccttccaccaatattaattgaaaatccccaatgggaaccagttatattgtccaagcatgcatggtgtagagtagaagctggagtgctggtagggacaaattcttcattttctagccctctgtagagtgtttactcggactcatggcaaaagctcatgaacttctcccagcaacaactacgaggacttgggactagaaatttttcacctgaggggcatttcctgccttgctgtggaacgttaaataaagctatccatgtgaccacagggtgtaaaatgatcttgacacctgaaatactgtgctaagtaatgtcagggaacactctaattgtgtagcagtgccccgaagagttccataataaaatggaaatggtttatacagggtcgttctacctggagaaggcaaggaggggacaatcactagcagggagcctcttttccacaagagctgatcctggaactgtgtgaggagctgctgggttctattgacaatgggaaagcgtcctataaacggctctcaattgaccaacaaagggttgcttggtttatagacggtggttcaaaggtaaatgtacaacatcctgtttgaaaggctgctactttgactaaacaaggtaaaagtaaatcagcttggtgggctgaattacatgttgtttttccatcagtgatggaaaaattgaatggtggtagaaccttctctgtgagtttttactgacttgtgggtagtggccaatgacctggccatatggtcagggaggagggcaatagaaacctatcttattaaaaggatgcccacatagggcacagccctatggaaatttgagctcacattaagtagaacatgttgatggccatgcagaacccttttccatgcatggaaggtgactggaattgacaagcaaatatcccggagtgctctcctgagggctaatttggtccatgaaatgagtggatacaggagtgctgaatctgatcaggctccttttataccttctcaggcacataatgtcaataagaatggttttgtgtgccagcaggagagacagagggtgctgacagatacggggcagattccctggtgggaagtcctgaacatagcttgcaagtgagacagatgctggaatccctgggaagatacgaatgggtctttgtaggaatagacactgattatggactgggttttgcttgtcctgtgaaagatacaaatgccccgagtgctgttacaacacacatatacacgcacgcgtgcacatgcacacacacacgcatgcacacatgcatgcacacacacacaccaaaatatacagatttggacatctgactttcatttcttcagaccaagaaacatactctacagcccatcattttcaacaatgggcaaagatatatcctcctcagagaaagtttaatagaaaagtggaatggacattaaaacattggttgtctaaaacagggggagatgaaagcatgaagggctggcttacacaccttcatggacgtgtgctaatactcaacatgagtgggactaaaggagtgtcctcactagattttcctcagtttttctggttgatctgggaaagagggatggggaaggatactggtatgactatgtgattattgccaaaggaggagtaagccagtataatgattatacgattatgcttctttccttttctttcttcccacatcacctcaacttttttttctcctttccttacttggtaagtggtcctaggaccaggactgcaactacaagtgatcgaaacaagaatgatttctaaaagaaaaaacaaacacacaaaaaagaaccttctgccataattcttaagtgcctgatgggggtgggttgtgcctttacaatctggcaaaatttgagttaacagtgaatgcagcctatattgcctggtgttaaaaatggccctatagttctgacctatgtaaccataccctaagtaagtgttggaatgaactgctggggaagcacgtgctacccactagtgttgctgcctgcaatctagaccagcacagtgatgattctaacgtcccttccaaaggtgaaaaaagtttggacattgatggaaaaaaggagaaagagtaactggaaggttatggaataaatgaatgggttgtaaattgagaaaaacctaatattagttaacaccttgaaggagattcagagctagagaagacattgtttcttagctgaattatgccagatgtctgacagggtgaagctataggtttgtggagaccacatctgctttcggaagctgataagattgaacgaaagcctgcacctgagtggcctcagtctagcagacattcatacaatatgatagactaagctatttattaatgatgaactggagttctagtgatttggccatacgttttgagttgtatgtctttttgatgtaagggatctgagttcaaagactggggtggactccaatattgtgaaatatatattttatctttggcctcatttttttggcatacaactcctaaaatccttagaaactccaaagtgatgctaataaattgattgatggttggcaggttctagaaagcttcaaggttgaggctggccacccaaaagaccaagacaggagtagaggattgagattttcggccttcaaggaggggagagggtctaaaggttaagttgattaccaatgactattggtttcatcagtcatgcctctttaataaagcctccataaacacctcaaaagaatggggcatgaagtgcttccagatagctaaacatctggagcttcctgaagggtggcacttccagggagggaatgaaagctctgtaaccctttccatacctcaccttatgcatctcttcatctgtatcctgtgtaatatcttctgtaataaactggtaaacgtaagcaagtgaatccttaagttctgtgagtctccctagtgaaaactccactggaagattgtcaggcaaaggttccagaggcccagacttttgcctggtgcctggggggtcagtcttggggattaagccctcaacctatgagatctgatactattgccaggtagacaatgtcagaattgaattggaggacacccaattgttgtccactgcaaaaattgattgcttgcttcgtggtcagagaagttttctgtgcccattgttttagtgtcggagtagaggaaaaacacagtttgatttggcttttacacacacaagaacccattaccctgatttgatcattacacactgcatgtatatagtatcaaaatatcacatgtacccccaaaatgtaaacaagtaagacattatatataaaacagagaagagctcaggcataaattggccattttcaagaagagagtgaatagagtctaaattctggggacttacgggttggagaaaccaactgcttctgtatagcaggggataagaaggtttatcagaatctcatataagtttcttagtctaaggatggaaggcagccttggggccaaagatcaggtaaggaatgttgcatttccgtccaagcttattgtttcagatcacctcaaggtagctccaatgaaaaggcagtgtaagccatggtttgaacaagttgggggttgggaagagtgttccttggcaccaaaaaaaacctggaatcaaataaattaattcctagtaagttttcaggggtggttttagccaaataaattatatgagtcatctgcaaaactctggttgtcaatccccaagtcaattttcaagcaccaaacctgcattagcagaggtagggtataagctcaaagcactcctaaagatagtttactcttcaacacccacttcaaattttaccacagagaatgtggacaagaaagaactattcagaagaaaatgccaggggactacaggatgcaggagaaaggagcacctcctagagaacaggaccagggtctgccagggcagtaagtgcttcagaatctctgtccggcaggatctatgcatggccatgctctttaactgtggaatattcctctttatttgcctacccacatggggttatgtattgtaaccatctgttttctgctccaccaggtctctgttccatgaggaactatagtgggccttgatagaaaaacgataacaacaacaacaacaacaacaacagcaacaacaaaactgctgtgcatctcccagagaagtttgttgctgttgttgtttctttcccttaacatcttctcattcaactcagtagcctctaattcaatatttgcagcaacccagcttctccttatagacaaaggacaaaggcaatgccctaggggaggattgagtagcaagttggaaaacaaactgagtccctgatggcctgagggcacagtccagtctctcctagcctagagcaatgagagagtcacatgaagggaaataactggtatcttatttaagcaattcgttgtgagttttttttgtttttgtttttgttgtttttttgtttttgttgttttgtttttttttttggcagcatcagcagcagcttagcattgaccctaaaacagctaatttcaagtctttccaaagtgcaaccctaagattattttctgaagttacattctgtgtttccttatatgtatcaacctattcagaccaacgtattaaaagcaacttattctgcatatactgctcttgactacatcttggacattcctctctatgggtcttagtcatatgatttatttgactcttctgaatcctctccaactaaaaacttacttatctcatttcataaaatagtcttcctttagcatatgtatataatagttaaaattgttttttaaaaatcagcttatggaatcagttttattttttaatttccaggtcattaccatgtatgtcttatttttccaacttgagttatgtttcaacaagatagaaatggtgtcatgccatattttatactcatttgacatttgtgcctcgggcttcaataattatttggtgatggattaactgctaaaatacagtggcatttctcagtcttcatatttgttgaatatataattccagtaaattatccatgatcggcttaacacatctttttaaagaattaaattacctttatccaaaagtcttaatacagatacttgtcccaattctgtcagaggagagcctattcatatttttctattattctgaattaatctatcaaatgctactctgtgctaaatgcaacattattccatgttcagaaactttaatgtgagtatggctgctaatatgcctcctttttgtatttgtatttctttggttttggtaatattctggtagttatgtacaacagagttagcttcgaataatcataactttttatatttcatgatcctttcacccaactatgttaacacaatggtggttatagagtttacaaaacaaaaatataatatcgtttttgtaaattcattttgggtgataaaatttatttagccaataaaagggcacagatatttccaattgaatgggcattacctcttattcatgggtcaacataactaatgacttgtccttgtatatggtgcaaagtattttctaccttgtatttaaccataaatctacatctgatgctgaaatatttttctgtagtgccagtggaccttatctgtatccacaatatgaaaacagaatgacattaccaacatagcataaatgtgtatgtgtttggttttacactaacttttccaatgcttcatactttctttccttggaaatatatgcatcttaccctgagacttatctaaatatttttttaaaatgacaatagacttttctcctactgcttataatacattttaatcagtgttcattcctccctaaaatcaatccaataatctattttcctcttaggcagcccagctaagacagtactgtcttgctcttatttcttttctagcaaccagtaatttatttgggttccctttcaataagttaaaataataacaaataatgataataataataataacaaataacatataatagttgtccttttgattagcaactctgaacctttttgaagtttcaggatgacttccaaaacggcaaatgcggcctcatgtttgcaacatctccagcatcccagtgaggtctgtgacatgactccagcttagaaattatgcttatggaaaggaaatggcttacagaagtgaatggattttcacatagaaacagaattgaatcacataactatgtaatttgactcatacaaaatcacatggtggcaatgtgatccagtgcttattaaaacaagtttaaatcatgctattcctgcaactctcttctatactacagattccactctattattttgtatttaaacatttaattctatgagatctgtgtgataattaacttttaaatttttctactcaaggaggtaatgcaattagtttaattcttttttgcttggggacaacacagtgtgctaaattcttggtatacaaagatgaattagagtccctcttctcaagatgctcaaaatctggtgaggaagtaaatgtatatagaaataaatttcattcagttttatgtactgaaagaaaagaccatgaggacgttatagatgcaataggtgattcaaaacactcataaaatgtttgctcaaactgaagtccccaggtaaattccaaactataccatttatgtcctgtgtgaatgaaatggttcaatatttgtaataaagaacattttgtatcactaaaaaatttggaaaatggatttgtttgttaagtgtttggaagtctcaggatgagaggtactaggtgcaaaacgttttgtttcagcttgatgttatgctctcctaaattatttttaatcatctgggaaataaaccctgagattaattttctctaagaagtacaaacaacttgattttacttcccttagtagatataattttgcattgttttaaagcattgttaattgatctcagcaggatcatgcttcatctatttgactgaataattatgcaattctgtagtcaagatgtctgttatcccttttttaaatttttcattcccattttcaaggtaaggttttcttcctgataatttgtaaaacattttgcctttcgcaactatacatgtgctcccaacaaattgggtattttttttaaagaatgagactgttgtaacatgtttattagtattaatcacacacttttttttaaaaatttcttggtagagttttatttcatttatccaaggaaaccataacaaaaattttgttctcctatagtcctttatatatgctctctttcaagatttaaattgcattttaaacttacttattttccttttgaaaattatctggattttttagcctgcaattcattgaatatatcttttggtaactactgtgcttggaatggtgcttaatatatgataccaaataatagacaaaagaatgaagaaatcaatgacacctataggggactttctgtgaatttgtttatacaaattttctgctgaaagttaagattggaccttggatttcctttatgattcggagaggagcaattgaattttacccttgactaaattactatttttaaattaatttttaagaccaagaatgatctaacatacttcattacatttaatgaaaatttgatacttatgacacaacctctagaagatcataatataatcacatctaattttgatgtctcaaatacacaatttataataataataaaactgcaatttattgagttaataatatttgtctcatattgagtgcttgctaaaaatatacatgactaacatatactgttttatgtaataatatcaacagtcttataaaattggtattctcatattaaaataatatgcatacatcattttggctactaatttttttaaaattaattttgataatccgttttatcacaattttcccactcaacattgaattagtattaaattagtaaacttacacactttatatcatgcatgcttatgaaaatctctgctcacttgtacatttatagaatgtattttaattatttactctcaattactcttttaaaaagcagatagcaccccacgaccaaatatttaatgaggaaatagttctccttcatatttatgagcctatgaaaaggatatacatcactgcgtgaagccatctatgatcaagcctttcgaaatattttttcgcaatctagtttctacactaccctaccatttccatgaaacctgtcttcattgtattgccaaacctaataactattacagtactttgattcttatacttttctatttcaaatatacttgttcactgcccttggaaacaaacaaacaaaaactaactttttatccttttcagatcacaattaaagcctttctttatcaggaaatcctttccagatctcctcttaatcaatactaattcagatttctccattatatgcctttagtataacttacatgtttcgtttctgccacatgtcgcaatacaattagtattctgtaaattactcatttattacttttggtagccaccaaatcataaactccatgtctaccttttgctagactatatccccagagcattgctgatgatagatgtttaataaatacttgtggaatgaatatctgccttttgtagatagcaatatgtaattgtgaaatgatctaaggcttttgagttaggaaacctaggtttgaaccacaagtctgctatttattagtgggtggcctttggaaagttacttaatctttctgagtctcagttttcctttctacacaatggggagaattatacccataatgtctagtgttttgtgagatttaagtggaagaatgcccaaatgcctatcaaagctgatactcaacaatgaagtttgactttctcaaactgttaactcagaaggcaagggacatgctgtagtattaactagtacatatcatagagcaatgttagtggtaactcttaaaagcttctgatgaataaaatagtgtcagtgtcacttaccaagtaattgatcttttctttcaactaatagagaagagtgtcactgaactctacccctttaaacacaactggaattttaaaagtttatcttgtatattttccaaggaattattttgcaatatcaaaaatcttctacactttagaatagtctatgttgtcaaaatatcttcatatttgctgataatctcaatactgtgagaagagaagataaataaaatatacatatttccagccaaaaccagatggattttaattagactaaataatttgttatgcctagagcagtaaacttaacataaagagtctctgacattttcagagacatattttgagtacaaattcttcaggtttattttccagtgatctcagttcatcaacctgcccgctctaagtgctcaaccaagaatattgtgtaattggttttaaagtactgcctcccctactgcaatcccattttaatcattgtattatgggacgttagaagacaatttttcagattctataattattttgtgttagtcacctaaacctcttaatcaatatattactgtcatctgctggtaaaagaagataactgaagtcttttcagcaactctgctttcaggtataataatttgcttcaaaaacacattgagataacaagtataatgtgtctagcttgcatgtacatctgatgaattacaaaaaaattcttcattatacttataaatctgttttccttaatttatatattttaagcaacatcatcacttactgtaaatacaacatacatttaataattattttatattttgcaactctgcttttaggtataattatttgcttcaaaacacattgagataacaagtataatgtgtctagcttgcatgtacatctgatgaattacaaaaaagttcttcacttataaatctgtatttttcacttcacttcacttataaatctgtatatatttaaatatataaaatctgtaattttatgtattttaagcaatatcatcacttactgtaaatacttacaacatatatttaataattattttatattttgatatattgaacatggttgagtaattcattttcttttcttttttaaacatactttatttttttttttaagtttgggtatatgtccaggatgtgcaggtttgttacataggtaaaagtgtgccatgatggtttgctgcacataacaacccatcacctagatattgagcccagcatgcattagctcttttccctaatactctatccacccccgccctcccagtgttgttgttcccctccctgtgtccatgtgttctcatttttcagctcccacttataattgagaatatgtggtgtttggttttctgttctgaaattcaaactctggatggctggcagaaacattatctaaaatctagtctatcttagcaatttctaaaactttttattacttaaaagtaaatttaattcaaaagtttaaatatgcagcactacttagttttaaaacattaagagtaagaagagaatgttcaatcagaacataatcttttttgatggtgggttttgtacttcagttagtgacacatcatacttgctttgcctttgaaaatgcacatagacagcatagagagaagtcctgaattaaagggttggaagaagacaaaaatataatccatgagcagtggttatagaatcaggattgattaaacctgaatgtaaaacatcttaactgtctttatgaattactcagttaacagaggatgatgggtagatatttctctatatgaagatgataaacaggcacaaacaacagcaggactttcctgaaagtgaagtccagatatgctttaaaattgtcttctttgagtttcattttgaaataacctaaatttttatcagttttagaagtaattaagcgataaggcaggagattaggtaatctattaagattccattcaatgttactattcattcactacttcacctgacatgatttccattttgctttaggtactttattctggatacatttatttgttcatttaaatcaaagttaatttggagtccaaaaactattcagagctttcttctctttcattttattcccccacctagttgcttcctgtgacataatttggaaaccacttttctcctagacatataactttatgataattgaagtcctgaccttaattattttttagagggtggaaggaagaggagtggattaattctaaggccaaaagtggtagtttcattaaaagtatctcctttgttattactatattcagaggattgaattcttattcattttgtcaaaacttattaacctcactgtctcttggaacaaacatctcatctattaatcaaataattttccaaaaaattaagtatttcaaaataaactactgttcaaagtgtttctttaaaagttgctcaaaattcacagacaataaagttgtattgttttactgaaaattcacatatagctaatgtcttggagaaataacaaaataaaaaattagaaataactttcattactgacactaaatattttacaaatttaagtttagaatgtattattaagaaaattgtctattgaaaccatttatgtttagtaaatattagccaatttcttcacttttctagttttaagaaacctaaaactacatttttaaaactcaaagtaaatattttttctctaaaatatatggatgtcctgtgctcaatacatttttcttgattaaattgacctcatactggaaattaatctgtgatttttcttttacttgctttgaaaagtttaggcaaaaaattaatgaaagtttaaaaaacactctcaaaattaagctatatattgtgaaccattttgtattttaatatttttgcttaatattgacatcgatattttaattattacaatggtttgtaattatttgaattaacattgtaatattatatagaatttagtaactgcacaaatgaaataaatatcaaagcaaaatgggaaaatattttactttttattgcaacatgactttcagcttattattttgcaagaacagtagttcccatatagtcttaattagtttcccttgatataactacttatggaactgcagtaaaatggccaaaactaagaaattaatgtttgcacaatactattaactactgactttactcaaattggaatatcttttagttcattaattactgtttgtgtttttattattatttgtagtataaaggtaatataacagtaataaaataaaaatttagaaaacaatatgagaacaaataacctctaatatttttaatcctgaagttctgctattttcaaaaaaattttttcatttaatctaaagttggattttttctgaattgaatattatttaaaaaactcttatgtttgtatacttgtttagttttcagcatcaactaatagaataagaaggtgataggtaaaacattctgatatatcattttccatatattttgcctattgatctaattaaaatgttacaactgtttgcacttattattatcattcgtagtatacactcaaggttaataacaaataatagagttggaattctagctcaccgtccctaactttaaaaattgtccatttactactccactgtatttttctcatttaaatgaaataaaggtttccatgaaaaatgtgtattttatctaggttcatggtttaagattaagcactgaaggactgaagataatattaaggaaatgaatttgcttattactatgttattagaatgtaactttgaaaaagccatgtgaatgatattatcctcagttttacttatctgagtaaatattaatatatgagtaatgctctgaagactaagtaatataatatctaaaactttctagcataaagaatgaccaataatacctctgtgataaggtttagttttcttcccatattcactgtcacatgtattggaatagaagacagttcctttcagtgactcttctccaaagaaataagaatatccatatctacatatataattttatacatctaaaacaataaactgcttattgaaataactgtaaactctccttttcctcctttttaatagaattgcagagtagctcttgtggaaatcctggtgttccacccaaaggtgtattatatggcacaagattcgacgtcggggacaagatccgctacagctgtgtaactggatacatccttgatggccaccctcagctcacctgcatagccaattcagttaatacagcttcgtgggattttcctgttcctatctgtagaggtaaaatgaaaacactttaaaaatgagagttgttatcagccagtgtatttgaaaaatgtgtttggtgcctgtttcttctacggaatctaaaggatagagaggccaggcatggtgactcacgcctgtaatcccagcactttgggaggctgaggtgagtggatcacttgaggtcaggagtttgagaccagcctggccaatatagtgaagccccatctttactaaaaatacaaaaattggccatgtgtggtagtggacgcctgtagtcccagctactcaggaggctgaggcaggagtgttgcttgaacccagaaggtggaggctgcagtgagctgagatcgcgccactgcaccccagcctaggcaacagagcaagactctgtctcaaaaaacaaaacaaaacaaaaacctaaaggataaatagtctcatatactacatgaaaaggagagaaaaatactaaattctagtattgactagtatctctttcacattgcttgtgaaattaggtagtaaattatatatctctatatgcatagttatgcatgcattgtgtatttatatgctttcatatttatatttaaaacatggagtttatgattagaaatttaattaggctgtcaaaattgttttgctttaagaaatattgactgagtctaaatctttctgatagacgacagcatggaaattttcgaaattaattatgctgcatttgtttactatcaatactattaagattatttgtatcatggggaaaacacaataatataataatgtggacaaaggttcaaaatacagagcttgggaaacagaacgtgttcaacattagctaagcacatggatggatttttcttacaaaaattctggaggccaacattgtgtttcctctgggcttctttttttccttagtaagcatatgcttctgtaattcctccatgactgggatgtgggaatgtccaactgcccatctaaattactttgtagcttcctcccaaacatgtcactgcaaatacatgcaccacaacctcctggtaattagacacaacaagcttcttatcccagctttgtcaattgccatgtgagttacctcaggaaaatcagttcaacaatttgagtctcatttacctcatttaactaatgaaaacaaaacaaaacacaaaacacctgttccatttcttgtgaggattaaataagataagctacactggctgcttagtaaaaatgtctgctatatgttggcattctttcaatgttagattccgttgctgcgtatgcttcaactactacggctaccacaattaccgctatcattactgctactgctggtgttgctactaatattgaataactgctattagctgtcatttatttaagcactataaatatactatgaaatttataagcattatcacttaaatttcactataataggaaactgaagctcagatatttaaaaataattgctctagattactcagctggtaaacatcaagaactatgaagagttctgacattttactctactttcaagttaaaactctttgccacagttttatggatgttgatgaaaaacacaagactgttgagtcagaaataaaggatagtttattactcacagcagcactaggagcaagaatagcaggatttgtgccagtttcccaagccctaattctcatagaatggcatgaagagtgtgagaaacctgcacaacatactaaatggtattataagagatgaaccatgagcttagaaacctgactcttttataatgggcagtaggccctcccattctttcctctggagggagcactatctccgtctctcaaggctgtaagcagagttatcctttgctctggtggaaaacactatattctccttggctattttctgtacagaaggataaccaggtacaaaaaagcaggataactggtacctgtgctcacaagatatgcagaaacatgagcattcaatggagaaatgtctcccaaaagcaaatgggctgtggtaaagaagcaaggtctgaaatattctctcaggttccaaagcctgagcttgttacctttttgatacatcaccaaaataatttgtgtctctgtttaagaacttttctttataattggaggaattggatattatatggaatattatatggaaatcagcagaaatgcagtctttaaaaaaaaaaccataaaactccctaaatcagagacatattaacattcttaaaaaccaagtagtaagacacttaaaactaagaagtactttgaagagatttcaatggagcattctcaacactgcctgaaaatgaatctctgttgttaggttccttcatctcaattcagacaatagcctttggaatcagaaaggccttattctgaatactgattctgccacttattgactatggacttagagtaataattgaattattttggaagctattttttttttagctatactgggatgaagagagaggcagacataccaaaatcataaacctgttagagtttaatgtaatagcattcataaaacatcagttacataccaatttattacttatgttagctctatcatccaacttttcctcagcacctgttactatttcctccctaaagaaaggatatacagtcaacaaagacaaatttgaaatggaataatatcaaatgtccttctgttcaaatctaaccctaaaaccaatgcttctattgcttttttttttttctattgccattttagtttcagggttaaactctgctaccagagtatttacttccctactcttcactcccaggtcccagcaagatttgaccaccactctaacttctatgattttttaaaatctatcaaaattggcacccactatttttgaaaatgctacctgattaactttagtctacccaggtcacttttttttctcctcagctgtaaaactaatgaataaatttactgatttgtatgtatttattaagggccttccttctgcaaagcattatgttatgtgctgagaatcaaaagattgattaagacacattttctgtttttaagaacctgtggtccagtggggcagacagtaatcaagtaattgcagtaatgtatgatgattgctttaatagcagaatctgtagagtaagctaggaatcttgataaggaaggtattaatatcgcccattgagtgcaaggaatttcagctagggacaacgctttaagagaagattttacagataattgctaaaaatacaaactatatagagcaagaacattttgaatgaaacaataattcatgtagaaagtacagattttcctttccagcctcaaaattagttctcacgtgttactaatattcactggctaaaggtagagtctaagtcatacttcatagagcacatgatctaactttctaaggtgtgatttatctctcactaaccaatttttttcattaaaacttaaagaatggagtactgtatatgcagtgtgtgtagttgtcattcatttccaaagaaaagatggcagactactcagttcatgccttccctctgcttttctttgccacttgatagcatttataactttgcagggggctgatgactctgtaatgatctactcattgctttccctggagtttacgtagagtctctccttgatgaaacctttgcttgtagagagttcttttgatgcttcctaacaatggtagtttaattaagaaaaaatgtattccacatcaacctagagggtatggtgtaaaggttttgtgtttgttcacaggcaggatgaattttatcaacaccatctggtagtatttgtaaaagtcaactaactgcctgctgctgggctaagcaacattctgtacaaagtgaagcctaattcctatgcgccaagtcttgaatgagaatacctggggcacatgatgtagctttagaatccttcttaacccagttctcacagatgaagtggcagatgaggtgaaatggttatgctattcctatgttaacaattccaaaattcataattatattttgcattcagaatggcaatataatacacataccccaggaaaaactaatagaattgtatgtaaaagagacacatacttttgatggaagagttaacatattaagatttaagaaggcagtcataggaaacatatggctaaattagaaatgtgaattttagattaaccaaagaaaattttaaaagagtggtatattgtattgatgatttgagtatatttgtggccaaaaagaaagaacttggaatgcatatgagggctcagggaaaggactgatcaataaggggatgtgatgctataaaatgttgacagagtttactgtgatctgacaggtgagatagtttttggagaagcttggatgttagtgatgtagatgttgtatggtaaattattgctgagtgacctaaaccatatatttacagtacatctaagcaaaagggctaatgaggaaactgttgcctttgacaaagaaaaataaatcttccaagttttattcttggaagactgttttccacaatgtgttagagaaatgactgatgaaataagaacagcagcttgatttgtcaccatattatattattctcctgccaaaaaactttgatcaacaattttctggatcaaaatgtaataccaaaacatggaattgggctgagcaataaaagacaatagttggagaagaaagaagtaggaagctttagcctagtaattttttaaattttatataccaaaattcctccaaagaagtagtgacttagttaatgaaaggatatttattatgtttgcttgttccctgctctgtatctggaaattacctcacaaaggcagtaggaaatcaaaaatgtcatttattttatgcatagtaagtcccaattacatatgagtaaatgctgaaatgtgatatcagaaatatgatactaaataaataatagataaggttattgataaaactaacttaaagaaaactgaaaagtactatattgaaacaagacacaaaaataatttggtgccatatttctattcattcccatatagtgcttaaatataataataaattgtacttcgccaaaatgaaaatatattttaagattttatgtactcaatcaaaacaaagcccagttttatctattcactgtaaagattattttttagcattttttgtagctaaaatctgtagttttttttttttttttttttttttttttgagacagagtcttgctctgtcaccaggctggagtgcagtggcacgatcccggcttactgcaacctctgcctcccaggttcaagcgattctcctgcctcagcctcccaagtagctgggacaacaggcgtgtgccaccacactgagctaatttttgttttttcagtagagacagggtttgaccatgttggccaggtcttgatctcttgacctcgtgatctgcccgccttagcctccctgagtgctgggattacaggtgtgagccaccacgtccagtctaaaatctgtagtttttaaaaacattttattacaaaccattgtaaactgtcatctccttttttcttaaacccactcccagaaaagacaatgtgttattgtaactctctgaatcacagagagagtagcgtcagtggtaacctcttttacgccaaagaagaaaggactcaaatgcactattgaatataaaaatgtcatgaaccatgtattaaaagttcttttcgaggattgaagcattgacggtttgactgagttcattttcaaacatattattttaaatattatttcagaaaatgttttagcacagactttgagttccaccaccacacttgccagtatctgagcaatattatttgggcacattcagctttcattagctgtcatttcacatagagatctagtttcttaatgtgagcagttatatttgatgctaatgaagaaaacatgttgtgcatgtcttttaaagaacaagcaagttaagcatgaattgtttggtaatggaattattttatcagctcaaagcctgctaacaaaattgcagtgatgtcaatccacaaggaaaacttcacaagtgtcacaggtcacttggtgctgcttcaacactccctggaaaatacaggctattcaatcaacagtcagatcaacactcaatagccctatcatgcaccttaatcttgttttgaaaagtacatttgtgttataaaataacgtacatgtcctgattagactgttttagtagtatctaaagtgatggagtaaaggcaacatgatttgtctttaggggtagaagacctacgagttgatttatatttctgccatgtattacctgagtgtgttatttcttatgtcaaaaactgagtatttttacttatttcagaatggtgaaggttaaagaaattagattaaatgatagttttgaaaaatttatttaatgcttaacacatagaaggtgctcaaaactatctaattagttccaaacacataaaagtcaattattttaaaaatcttatagaagtaatagctatcacttgttacgtttgtatttatcgtatttaaaatatctattgacagttaaacatgtgcctgggttcagaaatagtggagaatatttaaaaaactaagatagtcaagaactctggaaagagtagactctagactaataaaagccttggtttgcttcatattctgccactgagaagatataaaaccttaacctatatatttaattttttagacctcagttttctcacttgtatactaggggcaagtcttacttatagtattaagataaggattatattagttaatgtatgtaaaatacctaatcaatggtattcaacaactagtaataactacgttatttttatcatgttcacaaccaaaagaggacaaacatactaagagtcatttgtaaagttatatttttgaatatgataataacactgaggtatgaagtactgaaaaactaagggtaccagagaatggatgtatctaggttctgggatcatacaggcagtagaattaattttttcagcattaaaaggaactttaagcctcacattaccctaaaaattaggtgtggatcagcaagtattagacatcgtttttgaaaatatattttccaaagttaacatagcatttctgagttatccatgtctggaagttctcacatttgaagtatattcaataattaaacacatacatattttactttatttttcacttagtattattattttttgagacagagtttcactcttgtcgcccaagctggagtacaatggtgcaatctcagctcactgcaacctccatctcccgggttcaagcaattctcctggcttatccttccaagtagctgggattataggtatgcaccaccacatcaagctaattgttgtatttttagtagagatgtggtttcactatattggtcagcctggccttgaactcctgacctcaagtgatccatttgcctcgacctcccaaagtgctgggattacaggtgtgagccaccgcacccagccataaactcatatattttaaaaactcactacacacaagtcacatttctaagtataatgattaatgaaacagctacaggcctcatgaaactcaatctattgagttttgtatttgaatatgggagttttgtatttgaaaggtgatctgggttattgtctaactgtgtatagtctaatttcatgcaaaaagatccactggtgttcttatataaacaatatgtgttggccttatgtatgtttcttatgatcaaggaagaaaatcaaagcttcctgttcttatcctgccatcacccttgaccccaccatggcaacagtcagccatatatttaacattgacttacattatgttccccattttgcatttgtgagttgtgttttctttcattcacacaactatttactttttcccctcatcttgtatgcaatagctaaaacatttttgttggtttactctattgttcaagttttttattccttcatctatcattcttattttaaactaatccattttctttgacgataaagagaccatctgtgtatttttttagtattatatgttacgatagtgtaaatttagagatttttatttcttcgatggaatgattttaacttcattctctttctgtgcaattcctagaaaaatgtcagctgtgtattttttaaatcaaagaaaaacgtcagtctctttttgaggcaactgagtcttcattgcttacacaaattctgtgtaactttgagtcttttgtttctgggaaggcttttgtttacttggagttttttgtttacttgttttgacaaataagaattttaaagtaaattttctaaatgcaaaatccagattgtttagggaaagtttacatttttgaagaagctataacaaatagtttaacgatgttgttcccaaaattaaaacagaattttataaacattaagtaaatactcatttctaacacaaatctacattccacaatatgtagaaggaaagacaagttatattatctttgcgtccacaaagcattcatatgattatataggcccatgtcttaaagagaaaatgatggggcatgcttagccaagaatatattgacagcttcagaatcccctgtggtgaaatagactgttcaatgcatgataagaaccttgaaaagcaatcatctaacttcctgctaggatataaactcagtgaaccacagcaatgaccatctggtattcttttgctctttgcaaagccaccactctaaagacgaagcaaaatgaattagaataaaccaatggaggaaggagaatagtagccaccaaagacatttaatgctatgtgacacatattttagtagactcattccatgtgaaaagtcctttgtgttttgtgctaagaaagcatagtaataggtatttttacagcaatcactggggagggatactttgtacacttttggtcttgttctcttttttttcctgtgtaatattattgatcactcactaacgtaggaagttaagtaaaagatatacgtggttgaaccattcagtgatgaaagttctttcatatcattaataatagagaacagaatttaaattctggaacttggatgccttcaaaaactctaatttttggtctaaatgtgcatgaaatctaaaggctttttataaccacttttcttaggctttttccattgcatatctgattcaaaagaaaataaataattttctttttactccataatttttatgtatgtaaaactgggtctaaatacattaaatatttaaggagtcagggaggaattgtttttttttctttttttttttgcactaattccttatattttgaccaaggcaatttccatttactgctcccgacatttgttgaagttactatagtattcaaagctaaattattaaggccacttgttatctattaatatttaatttatagctaactctaaaaaagcagttgatgcagcaaaaaatatgatatatgtagctaaataacataaagtggaattaaggcaaactataataaaagaaaataacaggagagtaagatgaaaccaagagcaaggttaatttacaaaagtcaagttctgaattcttgtatctttgttagaatcagcattatatttagcttttatttttcttacaccctaaacaaatctggaaaacacgattagtttatagtctcacaaagtaaaagaaaataatttctgatgaaaaccaaacttactggacaatgaaatatttctttagctaaacaacgcaaagaaggcacagtataatttaaggagctacattatctacaatattagtaatatgagaggaaaattagcttctcaggtcaggtttgtattacctctttttactgacatataaacaatgcctttgtattgaaaagtagatggagaactgcattggagaattgtattcacagagtcagtaaaatcaaatcatacatgcctaatgtcactggtcaagtatgagtgatgtataacacaactgtctaaatttagttctgacccaatttttatatattttcaaagtttgaatctctttgttaattcatacatttggaatttgccctgcaagttagtcatctgaaaacagaatcaaaagcataatgtttttgcattaatattatcttaattttttctacagtttaatatttaatggatgcctaatttctagaataagtttctttatatattttcacattttatatagaaaattcaatattaatttagttaacaaaaaaatttatacttagcactaatttctaataactttttagttataaatataatatcagacattaatttcaagcttttctgaagttgttatatgattgcatttctcacacacacagctctttctaaaatggcttttgttgctgaatccttgtatcttccatcaaatttttttttctaaacaacggagatgaggtcattgacaatgcagttgcatattttaaaaatcatcacattacaaagtactaacttcaaaaaaattattgggcattctattgttttatctctatgttttttcaaaacacagcatccgatggctgaaatgttaataagatatcaatattatagcaacagattttcatattataggagagataacatagttttattatatttgtattattttaacaaatatctattgaatgatgatggagaagaggtcaatagctattgctgattttcaggagcttttatagcttatgggaagcatacataaataattacatactagtaaggagtaaaactccatcttctaagaaagatacaaatataatgccatggaagatcaaaggcatctgaaaattttaacgtggtgtgaagagtattaatcttgttagagacttgaagaataacttatatgtttatactgtattgcctctctctttttatctctagcatttaataagcactctctgtggaccagagacatttttgaactattctatgtataacaacccttttagtctttgcacccaggctataaagtggatggtattcagatccccattatataaatgggaaaactgagccactgttaaggttaaagtgcaacatcacacaagtaataaaaggtaaatctaggattggaattcaagaaatttggttagagtaaacaagttttttttttttttttttttttgatgtggggacggagtttcactcttgttgcccaggctggagtgcaatggcgtgatctcagctcactgcaacctctgcctcctgggttcaagggattctcctgcctcagcctcacaagtagctgggattacaggtgcctgccaccatgcacagctaattttgtgtatttagtagcgacagggtttctccatgttggtcaggctggtctcgaactcccaacctcaggtgatctacctgcctcacgcctgggattacaggcgtgagctaccgcgcctggcctagagtgacaagttcttaaccgctattgttattcttcttttcacattgtcttgattatacaacttcctctttccattttttctctaatctttgcctgtataaaggcttaacatttttccttaaataaaatcccaccaaccacccaatcaaacatttttaattttataacaacctacactcttgagccagtgtccttctgctccactttaattcaatttaacatttattaatagtaatctttccttgtctttttctctcttcataaaacactttcttgacctttcaagatgtttcaatgggtgaaaattgaaaaaaaaatcactttctaggattcaggaacaaatgttatttagtcatgtataacgtgtagagttatataagtgttaataattttggtaaagtaacaccttatttggggtaactaaaagtgagttgactttggctgataaagataaatgtagagaaaagaggtgacaatttcaagtgagaagattggttgcaagcatctttcaaagatattttgaacaatttggaaactcagacaaaagagtctaaaacttatcctctaagctagtgtaaactattaagtgtatttgatttttttagagacagtaaatatgttcttatgacataatggcaaatactgttccggtaaaagtatctatcataaaaagagagaacaccagcaatatataggtttgttctccattttggcagaccacaaaaagttatgttagaagtggaggacagttgagcaaagtttctatttgccacctcaacaataataatagcatgtcatatatttaagtttatatactataattttaagcataacacaaaaatgaccttattttacatttctaaaaacttatcaattaggtattatgattttcatcctttcttgtatccagactaaagctagtagagatttaaaaacctgccaaactttacactggaatagatattacaacctagtaaaccagaaccattttctgtaacagctttctgatattctagaacctttgcaactttccaatgatggtaattcttcttacacaaaatgctttgaattcattgaagcaatgctataccaattacttgcctttggtgtgaatctatcatcactgacttagataaatccggattcatctcctggcatgtgaagatgctcagagaatagactaaaattcccattatcaaggaaaaattgtagtgactattatattgaccttagtaactagtatgaatttagaaacatgctgcagttggtcctcaaacattgtaaccaaaggccagatttaattccttctgggactatcttttcttccccataaattttagcaccttcagggcatgttgtattttgattcaacatccgtccccttgaatatagcacatatgattcctggatcatatttcagatgacttctttcaaaatgagaggaattctaggtaatattcagagaccaaagaatgttattaggcatgttggagtagaatattcatggaagacggatttattatttgcttcctaagcaatatcaaataatccccaaagggaacagttcagttatttttgaataatttatctttatgcgttcttttaaaatttaactaaatttgattttagattaatgaataccatgagttatgttttatttttatttataggctgtggactcaaaggtcctggggaaatcagtttgttttatacaatgacattctaccaactatcaaaagttagaattctttctagtttaagctgttcttcaatatataatccatagatgaggaaatagttaaatataaaattaaacatttaaaaagtagaataaagtgtaaaaatgcctaaaatattgccttatgactgaacaccttgaatacgttagacgttttgaattcaacacttaaaaatatattaccatcatttccactcttgtaactaaatctaagccatgcatttaaaacatcattattgattataattttaaagaactgctgagtcttttctaggttgttaatatagaagaaaaataataagattatttcttttgttattataatatgaattatgacttcacaagttatgctcctttaaaatttgttacaaagtcatacatacatataaacaatcaaaaacatttgattccataactttaaaaaactcttgtttctataaatttgtgttttcaggaaatgtaagatatatttctcacttattgttatttacaaaagtgtcaattaccatcatctatttactctttcacatatgagtttttagtgttacttttcctgagcaccagtgttttgattagcttatgggagttggtggaaatatatatatatatattctgacttggctgccagccagagtggatagtgaacagaggccacttccattgttttttcatcattggaataataacgcaatcaatttatatcccacagagttaatcaactgatcaactattaggacaaattattattgaggagtagtttaataatttaatgagaaattcagtctatttcactgatttttcttaattaaattcaggttaaatcctatagatattataatggatttctatggagatgtttcagataaagtgactttaggaaaaagaataaagcttgagaagtacatatgaagaaaccttgaatatctttttcattttaataagtaaatattgactaattatggcttatcagaatatatgaggtcacacggtaataacctgacaaacttagttgcttaattgcttcagaaaaatgcagatgggcaggagagatttacttactgtagtcacaggagaactcagggttgtaatggcccaactctgaattttttcccataattgctattttagaaaaaaagaaaacaaaatacaaatggcaatcaggcactactttttaagaattttggtcaggaagtgccagaaagtatacacacatattttattggccaatattggcacaaacacatatttatatgtctataaacatcttaaagtatgtatcacaaaaatatatataattatatattctacatatcttacatatttttacatattatacatatttttattgcacaaatcagaaatcacacgactgtaattacttcaaaaaggtagagaagtcacaagcctaacacaagcctagaagatgaacaaaaatatttgtaaacatttattatactcaccacatggctttaaggaacagattattttgtctggaattcctaacaaggcctttccttttcttatcttaaaaagaaccatcaatattgactagtacactaagagatctcaaagatgcttgagtaatgtcaacaaaaactgtttagaaaacccttctaggtttcaaaaaatatttggcaccgtcttgtttattttttccgtcacatttccccctaaatgttgcaaaagaaagattgctacttcatgtataaaaatatctgtattgtttatatcgtttgtacatttaaaattttatatttataaatacatgtacatctatctatatctatatctgtatatatacacatatacaaaaatatatataaaccaaaatcagaatcagaatacaaaatgtattctgatcatgtaccttttcatagtataatattttcatactgttcccaaagtggatagttaaaaagatctgtaagtttaggcttgcatttatattcagggataggcattttaacttttgaagggatgaaagaaaataatcactccctgtttcaatttgttccaagaaagaaattcttgcaagctgaatttgaaaattatgaactttgacagagtcaattcaagtgatggtattctattttattttattatcttgtattttatcacttgaaaaaagtaaaattcaaaagccaaacatattgcatggaggatcttcccttatgatacatgtacttcatgaaccttatcatacatgcatggaggaccttccgttatcatatatgtggttcatatttctgtctccttttgctgcccctacactcatggtagcgttagtgatgtcagcctttcttcctgctggactctgctgactgcttcttgttttgttttctttttcccatctttacattttttttttttttggtctggaactgttggcataatgtagttttagtacaaatctgacttattcaatcagaattttcagcacacttagtgctggtagcaatgtatatttttttctattctgggtatttttgaacaaatactttctgtgtgaagttccacccttctttttctacttacttatattttgaaatgatttcaaaattcttcatgatgaaaggtgatttataagtatatcctaaagaatcgcgttttcccaagaacctcactagaggcggaaatgttatgatttaaaattcagaacaatgctttatttagcattgtaacttttcagaaaatagcataaatttgatttctttgctcttcttgacgaggtagccatttttacagctgtcacaaaattagatttaaattcagcataaggatgttatgtattcagagagagctgtgcttataatacatatctcatcctctgaaaatttaactacctctgcattttgagcagctatttctgaaatgtgaaatgcaaacatagaaatcgtataaaatgtaccattgttttcttcaactctatcaatgtccagtggatttagtgattttttaaagaaagaaaaatctaagtaactttaagtgttaacaacacataatgttgtttcaaagttaattattttggcaagctgtatcacatgaaaaactaacatattgtagcacacagaagtattccatttacctttgaagaaatcaaaaagaaaaaagaaaaaggagactgttatgagattttgctctacttgacagcttagaagtcagcctgccacagtgtcatagaagctggcaaaagacatgagactcttgggtcagagacaagggactttgttaatcaaagcacagcaaacagcatgagctttatagtcaaagcagttcttcttgctcaagttgcccttttagtaccagaaggcaacgtaaagtaccacgtgtggtttatgtcacagctgaggaatcctaagcatagcaaaccccaatactctatgtttaattttttgaagaactagcacaccattttccatagtgactgcaccattttatattcctaccaacagttcagcagggttgcaatttctctatatcctcaccaacacttgcagttttgtttttatttttgttagtaaactaatgggtttgaggtactctcttaaccctacctaaatacaatacaaacaaaccatctctctctctctgtctctgtctctctctctctctctctctcttttgagacaaaatctctttctgtcacccaggctggactgaagtggcccgataaaggctcacttacagcctcaacctccctggttccagtgatcctcccacctcagcctcccgaatatctaggactatgggcatgtgccaccaggcctggctaactttatttatttatttatttatttatttatttatttatttatttatttaggtgagattttgccatgtttcccaagctggtctccaactccttggctcatgtgatccaccttcctcagcctcccaaaatgctgggattgcagacgtgaaccactatgcttagcctattctctctctaacatccttcagaatagagtagtccacttctaggagcagacattgtgaaattacagtaataaaaagagaaagagtagacaagaacttctaacaatatattaatttttttttagtatgctaggcattggggatacagatatataaagcaacaacaacatagttcatattatcacgaagagaatagtctggtaaagaagacagatattttcaaataagcatataattacaaattatgagtgatataaaggaaaaattctataaaatatgtttctattaaaaatgtctgctgtcagagaagtattaagttattccatatgatcatagcttatgtagagatattgcagttgtatccaatttaacttaccacctatttctatttggcacactaggcacctgaatagtgagataataacacactgattcttataaggttaataaagtaatgtgcctttcctagaaatttttgcttacctttctattctaagccatatttaggcagcacagcttaaaatgttgctttttgtcttgctcccagctgtaaagtacttaatgatggaaaacaaaagaaaaaaaaattgagcaaatgagtgaccacccacaatcctgattctctaactcttgattccaggaattaaaaaaacaaagaaactttcagaatcattatagaaaaccacagcagctgaaaggcttcctgtatccaccttccaacagtttttatattgcctgcatatctctgccagctggaggactgagaagcctaaatcttgctattagtcactcagtattcatcagttacatactgaatatatctgtattaaactttctaccatacatattaggaacgaacttattttcagaaccaacatgatcttagttatgcatttttccaacataaccaagctgtttgatatctaaaattataatgttctcaggattacctcgttgaaattaatttcaaatatatattcacagtatatagatttgtttttccaactgtacttctacttcaatcccccttttgttctatgatctttaccttgaatacttgaccctgtggtcttgccctcaggatggtatcttaaagtcttcaaatattttgcacttcccacccttaatagttttactattggaatttatgttattctttgtttcataaaactgccatgagtatgtgcaataattatttcagcaaatacaaaaataaaggccaagaaatgagctaacttttattgaatttctatgtatatgtcaagcgttatacttggggaagctagtccattggactcttgttgcagttgccctgtgaagtcatccttatttacaattaaggaactggagaatggttcctggatcaagtactaacagaattgttgattagggcgatttttacaggacacttaggttgtaatcattttctgtctgcctttaaaaggtagcctcttttcacacttcagtaatagctttcactctttacttgttgctttacagtaactattaaatttttattcttactttaattgcagtcttgcttggtctcaggcaaagatttggaagatagtttattatatttcattttctgttattctcttcactgccagtccccaaagtagcttgtttattaaaaggaaagaaaatgcacatttattttaactttctgaggaaaatgtcctgatcattaggacacaaaatagacaaatttatatttcttatgttcacatgtgaattgttcgggagcttaacagttatggcagcagaaggaatagaaaagaaggatatgacaaatattgcacattccaaaatttctccatcaaatgggaaagacatacagtatacaaaatatttaaacatgcctagcctcttttcatccttttaccaaagctctgaagtagctattgttgtttcagcattccattcttttatccactctctgcactatgcatcttttcattctgcagcaactgcgcaatatgtttacttctgttattcactatattcattcttctactgccctgaatacaagagtttatttacataggcagctctactgtaagattttgagctccctaagattgtattctgtgtacacaggacttatcccatagtagttactcaataaatatttgttgagttaaaatgaatttcagagattaaaaaaaacacattgttttcaaaggtcacacattttaggtgatagtgatgcatttggactcaggtcttctgaatataaatctcagtcttataattccaattttgatgccatcggttttctttaataaatttcagtgaccaaaacattgatgacattctcaagcaatgtttttatgttggtcacattcagacattctataaataatcacccactaaaaaataattacactactattaaactgttttggtttgtaagtatttggttttgtaggtaattttcctcttaaaagcagtaaataacttactcatctctgtacataaaatttgttctgtataaaattttttaaattacgtgaaaacacaggtccaaataaaaaagaactatacagagtaattggcatcaaagtatataatttaaatatgtgcaccaaacttaccatttattgggatgtagttaatcttattttgaaattgatatctatttcagaatataatcagtgtgataactgactcatgcactggatgggttttttttcttctcataccatcacaagcttaacggaaatcttgtaaatcatctaattcagtatttatgaacataaacaatcttgaagaaaaaaatggcatacattttttaccatggactccaaatacgtgtgtagaggagaaagtcaaaagagaatagctttgatccaactcaatttgagaaaaaaccattatatgagcagcatcaacatttgactaaattctgttgcacccccactacttttgaacacttatgcagctgtgaattcacaacctttaatggcaactctttcactttttggacaactctaaatagaaaccctctcttatgttgaactgaaattcctttaaattccatctagtgattcagattgcctctgaatcatttgttgccaaacaatgtaagtgtcatatttttatcatgtaacagatgaaggcttttcaaatgttagaaaacatttatcatagtcccactgcccattatcaagtctttcctactccaaagcaatcattgtttgttcccttaattatgcctcttataataattatgcatcttggcatattactctttatctattgaattctcacataatagatgagattccaaccaaagaaagtgcctcaggctgaaaaggaagtgagtgatgcaaagacaaattcccttccttccttccttcctttctttctctcttctttctttcttctttctctttccgtacctctctctttccctcccttcctccttccctcccttccttctttccttccttccttccttccttccttccttccttccttccttctttctctttctttctttctttctttcttttctttctttctttctttctttctttttctttcttttttcttttttctctcttcttttcttttttctttcttttctcttttcttttcttttccttttgtattcttttgttttgttttgttttcttttcttttctgaaagagtctcactctgtcgtccaggctggagtgcagtggtgcaatcacggctcactgcaacctctgcctcctgggttcaaatgactcttatgcctcagcctcctgagtagctggaactacaggcatatgcccagctaaattttgtatttttagtagggatggggtttcacaatgttggccaggctagtttcaaactcctggcctcaagcaatccactcaattggcctcccaaagtgctgggattacaaacatgagccactgcacacagccaaaagtcaaatttttttaaccaggcaaagtgtattttgaaaaatgctacctagagaaaaaaatgcatgctataaactagaatgagctttaaagattaactagtcccatatactaattttatatcattgttgttaattctatttaaagcttaggttaaaagggattgggttaatcatgtttcttactcctggaacattgtcaccaaactttttttgcagcactacaagacatacggatgcaggtgttcacgtgtgaatatgtgtatactgagttgtcttgaatccctattccatatttctatgcatctccccatataaggaaccactcaaatgtgtttgttccatatccttgatttttacgtatcttcgtgaaatagagagtattttatgtttatatgcttttaaaagttacataagtggtattatgctatagatctcttgctgtttcttactgtttactcagtagtgtgattttaagttttgtctacttgctccatcttggtttcacaatcttggatgaaacatctagtatccccaaaaccttcccaggtggactggatcagagtgtctgaggattaagctagttttaaaaagctcttcaggcggttgtaccaccatgttatgtagtttcacatatagtggtcccactgctggacacctatattgcctcatactctaaaaacccccatgtaaaagttactctggaaatgtactcaaggactgtggggtcatagttacaaatgcattttagatttgactatttctgagctgttcttcagactggccacatctggttatatttccaccagtaatgctttgaatttcctgttatattttgacaaaaccgggcataatcaaaacttctaatatgtgtcagagaagttaggcatttttctcaaaatcatatcataagataatgtcagaaataaactgcaattttaaataatcttgactctgtaggtagtctcactacatcaaagtgtctgtagaagaacattgtttgattctattgtcaatactctgtcaaaatatgtcggttataaaactgactaaattcctctactgaagagaaacttctgctgaagttattttaaaatcaagcaaatatgttgtctcttgctattttatattgtcattaatattgtttagattattgtttatattattcttgccattatttttgtttgtattattcttgtcattcctattgtttatattattctcaatatttcatattatgttattattatttaatacagtgctgtgcatattatttgtatatttctggtgttttgtcttaaaatgtaacaattgcaatgattgactcaaagagtttccattggcttcccaaatgaacctttagcacaataatacaattaagatagtaataatgaatatatgtgaaggctaacattcaatacaaagattagaaaatagataatagtatttcacataaagatgagaactaatgcattatatttggctgaaacagaaaagtgaatgtggtattgtgttagtgaatcacagagcaatgtgataactttgaacctattaacatatggaatttttcacctactaacttcacttttcaactgacttactttactaagatccctaacattttatcctaaatatttatttattgattaatgggagattatttgatctctcaaaagatatcttttaatttttatgtgctaaattccctgattatgattttatgaaatcctatattttctgcacatttttaatgtttgattttgctatggactgtgcttatttcagattttatactcatccaagaagctaatgtcacaaatacagatatagaaccgaaagaacgatgtcagttctaaattgtttacaatactattccccttctttacttgtcatggcctgatctgttcaatcctgacacttaaattattggcattaatacatatagtggtaatgaataaattatatttaatacaatgtgttatgtatttattagcaattaagaataaaacatgaaaatcttgtcctttcccatattcattttctattaatgcatagcaaaatgctacaaacatagcagcttaagacaaaagcaaaaattatctcatagtgtctgtaggtcaggaatatgcgcatgggttagctggatcctctgctcagggtctccaccaggctgaatggttttgtcaacagctgcaatttcatcttccaagattattgattgtcagaattcggttccttatagcttaagactgaggctttcagatcctagcctacctatttctgccacctaacactgtccttaacaaggcagtttgcttttttaagttcaacagtagaggatctgctgctgcatagtatcacttctaagacctcacctgattagatcaggcccaccaaggataatctttttcctaaatttaaagtcagttgactaggaaccataattacacctacaaaacccttttgccataaaatacaaaaattatcacaaaagtgatataccattgtattcacaggctcttctcacactcaaggagtggattatacaaaagtgtatatctctgtagagtatgctaaagaggaagaaacttctgtcttctttgttactatagatatgctgcctattacagtgccaccactaaatattagttgaatgaatgaatctcctcacaactagttaattttgtaattgtcctaagaaaatatttgttgcttgaaaaaaaaatctttctcacataatgattttcagagtatttaatgcagattgacctatttgttaggaaagtagcagtgttttactaatgaattctgacccaatcctaaattttggctgaatttctgtattgatggcatgcatttgctattggaacttgattcagctcacagatggcttcacagctgttacaccttggagattctaggaacctttgagggatagcatatgtgaaaactcaagttattaccaaaggagtttcctcccttataaatagttaaattatattttagagaaatataccatttttcattcactagctaaaagtaaattttgggattacaccatgtacaatcacaagacttgggtctggttgacattgcacagtcagactttgagatttatttttaagtaatttctctgaaaaaatatctcaaagctttggaaatgtggggaattgcatacatgtcaaggaaaccaaaataatgcattgtatctcaaaaagaaggtcttgaatttgattaacaatatcttgagcagagattttgaatttttccacaagcagtgcaattttataagtagaaaataagtgattgcatagtatatctgtattagtaagtaaaaaaataatgagggaagacaatgaatctgaaagatgcagatgcagagaccagatcacatgtcctatgttaggaatttggctgtggcaataatgagaaagcaaaatacagtcagaggctacaaagttatggtgagcattttccgtgtcctagatgtttgtataatatgaataaaaatataaaatgcccctttaagagtttaaatttaatggaaaattttggaattttgcctctctttcctaaattttgtcattcaattaaactgaaatatttacctgctcctcagaagattttgatcttgattccataaaatacacattttcaggattttgcaacatatttaaccggacactgtttacttattttgtctcttgcagatattcacatatgtatatatgtgcatatatatgtatatatgtatgtgtgtgcataaacatgtatatactgattatacctgtagaaatctttagaaaactgtaattaaagtaaatactgttgcttcacttgagatcttagtgttatatttagttctgttttttataaatatacaattatttggattatttttatgaaggtaaaatctattactgtaacatgcatgaagaaaccaacaaaactcttggtttgttttgttttacaggtgtttacaggttttgttttacaggtgtttaaatatgtactctgtcaaaatttccacatagggccatgccaagttgatagtatcagggtgggcttagtgttttttgtattaattcattgctcattctttaagccactatttgttgagtactttttctgtactaggctctggaaatatagttgtgaacacaacaggaatattctgtacctttatggagcttactgaagtgtagaataagcagataaaagtataaataaaataattacacagaagatacagttacatttatcataagagctatgaggaagtgatacagtattctacgagagcatataactgatccgcagggttgtggaaggcaactgaaggaaatgactttcagactttaatttgaagagtaaatagataaagatgacatggcaaaaggctgtgaggagggaggtagggtcataaagagagcattttaagcagatggaataaagatgtgatgaaaaataagatgaaaattatttggtatttttgaggaattaaaaatatctggcacatttggaatagtgagaggctgtggaatggaagatatggatataaaactctttagaaatgagaatatgcatcaggcattgcaagtcattttaaagattttttaaatttatcctaagagcaatgggtaactactaaatagtttgagaaagtgggagtgtaaggtattatatataagaattgtaactgcattattaaagattctatgaccaagaatacagggaactaggggctgggaggaagtgatgtagtgttctaaacaagagacactagtggcttggataagagtgatcagagggagaggtaataatgtgctgagtttgagatataattaggaagggaattaacaaagatttgttattcatgagtgttatgtgtgaatggtaaggccttatcaaggaagagaacacaagtgggggtaaatggaccattcattgaaatgaggaatgacggaagcgaaacagagacacctttaagacagccaagtggcaaagtaaacacaaccctctcccctccacacacctactcacaccaaaaagagtaagttatattgatcttgagctgagaacagaacagtagtgtttcagctggagttgaaatctaggggagcttttgaaatatggactgggaagagaagcgagttcagaaccacatccaaaagcgctgaagtacataaagacctacaataatggagagatccaaaatactaagatcataaaaaagcagagacatcagaaagaccgacagaatataatatcctgaaagtaagaagagagtgttctgagaagaaaagtgtggcaaagtcaactagtaagttttaagttttgcaaccagatagaagaatgagacaatgaaaacttttatgcaatatatagtttttgagggcaaagtctatgtcttatatttctttatccccattatctcttacagaactcaataaaatgctataaactaaaataaaaaaatagctaacaaccatagaaagcttcttttccaataatattccttttatttctctgtaaggaaaaatgctagcatatgcaaaccttagtttatttattagggagtgattttaatcatactaaataattcatatttaaaggctgctaaggccataaaatatataatgttgcatgttgtatttcagttccatgacatagttaaacattctagtagtacacagtgcaagtgctcagttgtgcatatcaccttttaagtaaagtatgcccaatttagtcattaattaaattcacagagattctggccctggctgatttttattatacatgaatttatttttatcaactagcaaggaacactttttattccttatacctcagtatttctggagacttcataatctttttcatattcctaatgctttataattctaagattttcatattaccaaaaaccactatatgttttcgtgtatatggccagtataaataaaatgacatcagtcagctggctgcaatatatgtttttagtgccagatcttcttttccagccacatttattatttacccactcaaatttgttcattctggcttgcataccttcccttgaaggtcttctttttctttggtaatgcatattctttgccttcttccaaatgttgaataaaatgtaccttattttaggaattattcaaattaggtcccaatcctgatattaaatttttcattgttcatatattccagttaggcttttaaaagtgtattctctgatatattgagctagagtgtaaatcaaatgatgtgttcatctatcagagtatgcatattgttgtgtcactgatactcttattacctctccaggctaatgaaatgcaaaatccaggggcacaattcacattacatgtagacaggatctcatattaaagtgtcacttcctaccccccatgaagcatgtggttacattgaggctgacaaacacagtatacactcatttttttattcctggatatttgacaagaggaaacacaataagcattcactgttttgcttttgggcttcattttctatactctaatatatttttgagttatgttaatatatatttaatttcacttcaaataaaccttaatatatttacattatatatttacattttatgctatgtttcaggttctttaactgagaaataaaaacatcttttctcctcataaaatatttggtcatggtgttatggtattaagcacttaatttgtactcaacaaatgcttattgaaagagttaatagataaattatttcagtggaaatacaatatattataaactgtttcacatggattctctcccactaactatgcctgtgtggccaacagcagtcaatatagggaaaaaatagggactcatttttgccatctgcaaaatgaggatattcatttatccataaagacatctttattaagtacctcctctgtgtcatgtaccaatctagaaaatggaaatctaaattgaacaaaacaaggcagaaattaataaaccaggtaatatacaatgttttggactttattcattcatttcaataagatattattaagtaaactggtataaaaataccattatacctttggttgactaccaagataaatataatactaatattactctccatcaatttatattttagtgcaaaatacgtctttacaattatgatacatgacaaatagtaaaaatttccatggcaacactaatgataaaaaggtaaggaaattaagaagaaaggagagaattgtgacagttgaaaataggcccatgtgatttcataagcccttgtaacaataggatactgtgtttagattgacacttgcagagatactcaaaacacttgtgataaaattatcataaaaagaatcccatgacagcattgctataatacattttgtaaggccactacatctcaaacactgtgattgcattacatctcacttgaaaaaggccaagtctttacaatagccttcaaatttctacatggtctgcagatcctgttacctcactggtccatttcctaccactccccaacacccactccattccaagcaccccaccctttcctttgggattattccaccctgccaagtatattatcagttctgcacacagacacttctattccctctgcttggaaaatccttccccagacatttgacaaatcactcacccttgcccctcagggctctattaaatattacagcatttgatagaccttctataaaataaagcccagtattatcatcactttcatttcccaatctccagttttattgtttctcacaatctttatatttgtaaataatactatacttttatttttgtttatttctcttctcccctactaagctccaggattgtatgacttggtttgctttgttgattgttttctgattccagcatctaggccagggccttacacatagtctctttagatatttgttaagtaaattaatatatattgcgccttaatatagggacataaggcattaaagtaaattggaccagataaattttctattgcttactagggggcacagagtaagaaagcaacagaaaacagatctgagtagttcaaataagaaaaaaaaatgtatttgaagaatattggataatgaacataattaacggcagatctaagcatctaagccttgaaaagagccagactatttccggaaatatgagaaacaggatatttcgagaattattgagtacaagttataaatctgtgcatctttaatcaaaattctagttccaaatgaaaacaatttggtttaacataactagaatgcctgtctgctctatggccagcagagttgtggggcacagatttggcgaatattatgattgttgatcctatcaaaactaactagaaattgaaagggcaagctctaaaaggaaacataccattaccagatttttgggaacaatgatgactgagagaaatttacatatagttactgcagtctctgaagctgagaacatatttaaggatctcataatatacaaaaatgtattattttgctttaactttaacatctaatattggcaggtttataaataataagtaataattatataataaataataataaaaataactataaataacccttttaacccaagtagtaactaaataattatcacattttatttttaaattaaacttttgttttgagataattgtggattcacgtgcagttttaagaaaaattacagagaaagttcatgtatccactacccagtttctaccaatgataatgtcttgcaaaatatagtacaatatcccatccaggatgttaatatttacataatcaagatacagaacttttccatcaccataggatattttatattgcccttttatagccaaactcattcccaccccagccccctacttaacctcttacaatcactaatcaattcagttctagaattttgtcattttaagaacgttgtataaatggaaacaaagtatgtaattttttgggattgacattttttactcagcataattccctggggatgcatgcaaatttttgcatgtatcaatagttcggtctttttcattgctggcattagcatttgatgacatgaatgtactgtagtttatttaactacttactcattaaaggatatcttcactgtttacagttttggctattgggtatatgaggttttgtgtgaacataaattttcgtgtccctggtataaatgcccagaagcacaattaccaggttgtatgttagttgcatgttctgtttctttagcaattgccaaactgtcttctagagtgcctgtaccattttctgtttccgctggtgatatgtaagtgattgagtttccttgcattctctctgttatttggaggcattactgtttttttattttagccattctggtggatatatagtgttatttcattgtggttttaatttgcttttcccaaatggctaatgatgtctaacacctttttgtgtgtttatttgccatttgtatatccttttcagtaaaatgtttattcatgtatttttttgccattttcaaattggattgtttgggtttgttttatcattgagttttgagagttctttatatattcaagatattaatctttgttggatatatagtatgcaaatattccccaggctgtaacttgtaacttgttttatagttttatattttgcatttgtcagtgactcattttgaagatttttttaaaaataaaatgtgagatttaggttaagattttgtcttttgttttatttttacttttaatttttgcatgtacatagtaggtatatatatatatatatatatatttaaggagttcagaagataatttgatacaggcatacaatgggtaataatcacatcagggtaactgaggtagccatcacctcaagcatgtaccctttctttgcgttataaatgatgcaattattcttttttagtgactttaaaatgtacagtaaattattgttgaccgtagttactctgttgtgttgtcaaatactagatcttattcattctaattatatgtgtctacccattaaccatctctacttccccagctcctctccctgctactgccctttccaggttgttttgttttttgactctggatttccagttgctctagcaccatttgttgaaatggttatctttctttcattgaactgcttttatagctttgttgaaaaatcacttggcatatttgtgtaggtctgttgatggattccctactctgttctattgatctgtgtgtctgtacctctgacaataccacacaattgtgattactatagctatatcacatgacttgaaattgagtagaacaattcatccatttaattctactttttcaaaataattttagctattgtagtccctgtgtcttttcatataaattttagattaagtttgtctatgtctataataaaaacatgttgatattttctatagatatcacagtaaacatataaatcaatttagaaaaaattgacatctttattgtgttgagtcgtccaatccatgaatacagcctctccatttacttagttatttatgatttcttccattagcattttataattttgggggatacagttcctgtactagttttgttaggttcacacctaagtatttcaacctatttgtatgatttcaaatggtagtgtatttttaaatttaaatatctgcatgtttttgctcatatacagaaatatacttgatttctttatttatattttatattctgagaccctgctgaagtactaggagttttgttgtagattccttaggaatttctatgaagagaaacataacatctgcaaatgttatttttaatcctttgtgtttatcgtattactgtactagctacaactgtttttaatgactggagagggtgggcatttttgccttgttcctgatgttatagaaaattttcagcactaagtacaaatttatctataggttatttgttaatgttctttgttatgttgagaaagttcactgctattctttttttctgagtttttttaaatcatgaatgttgaatttagtcaagtgttttccttgcattaactgatattattataggtataaaatttttatcatttagtctgtaaatatggtgaattataatgattgacattcaaatatttaaccagctttgtatgcctagaatgtgctccagttagtttatcatatttgaaaaatatgttactgagtttatgtgctaatatttttaaagaatttttgtatctgtatgcatgagggatattgacatactgattagtagtttttttcttcttttttggcatagtttttttctagtttgatatcaaaagatactatcttaataaaatcagtcatgaaatctctcctgttctgtttttttggaagatattatgtataattggtgttgtttttctgcgtttggtagaattcctcagcaaaagcatttgtacttattaaacttgaagaagtctttttctggactttttttaaaattatactttttatttccttaattactatagcacaatttcatattttacagttggtaatttgtgctttttgaggatctggtgagtttcatctatgttatcaaatttatgattgtaaattcatagtattttctacttttttctatcttcagggtctttagtgatatttcatcttccattccttatgtcaataatttgtcttttttggtcaatgctattgattttttaaaaatccttctgttttattgattttctgtttttaatttcattggcatgtattctttattatttacttacttctgcttactttgaggttgtttgctcttctttaggttgttgaggtgtgaatttaatcaatgatttgagactttcctcttttataacatatgtttggtactgtaagtttttctctctagtgcttttgtttgcccaacatattttcttagattgtttttacattttcatttagtttaatgtgtttttaaaacatcccttgaggctttctctttgattcacagtttatttagaaatgtgatgtttagtgtccacatttttgaagatttttcttttatctctgagttatagatatccggtttgattattttgtagttacagataaattctatataatgttaaatattttaagttagttgtgttttgttgtattgcctagaatatgatctaccttggcatatgtttcctggttacttgaaaagaatgtgtagtctgctcttgtaggctggagtcttctatgaatgcaagttagatcctgttaattggtagtgttactgagttgttccatattcttattgattttccatctagttgctctatcagttgttgagaaagtactgttaaaactcccaacgataattgtgttttttaaaaatttttcttaccagttcaatcagtttttgctttacacacaaaaaaatttgcagcattgttttttggtgcatacacatttaagattactatgttttcttggtggattttccctatatcattatatataatgtccgtttctgcgtctggtaattttcttggctgtcaaatctaaagatgctccttgactatgataacacgtagtaagttgaaaatcttgtaagtcaaaaatacagctcagagggtctttggtcaaggaatcactgatgcttgaagtctgaaaccttgtgcttgcatattgcatttgcaccataataaacccaaaagactataagtcaagccattgtaaatctgagactacctgtattttatctgatagtaatatagccactcttgttttccattgataaatatttccatgatactgctttttctattattttgctgttaatatggctatattgttatatttgaagtgggattcttataggtagcaaatggttgagtcctgctttccaatcaactttgccaatctctttatattgtttggtgtatttagagcttttatatttaatgtaattttgatgttaggacgtaagtctgctttctctttttgtttttcattttcttttctctgttttcatgtgtttatttgagcatatttgtggaatgctgtttaaatttatatactgcatttttagtgtatttcttacagttttattagtggttgctctaggtattgcattatatttacataatttatcacggctatgtgcatttacatatataaaaacatatattatatataaatacatgtaaaatggtgccgtcattttagcagttcagctgaattgcaaaaactttacctctccttatatccctttatacccctgcatttacagtaaatcataaatttcttctgtacatatatttacaaccagtgttacaatttttactctggccatcaaccataatttaaaaaattcaaggtaagaagaaaaatctcttatatttattaatatttttgcttactcttttattttttccttctaatatttcaaattttgttattttacttttattatttgctatttagagaccttagccattcatttagggtaggtttactgctgacaagtcttttttatgttgtatttcagtctagttatttctctgttcagattgtgtgattttttttgtttgttttccaactcactcattccttcttttgttcactcttctgttaagcccatccattggatatttttaaaggatttctcaaaaatcttaggtcttttcctttttctctgtttaatgatatttcaaatgtaaataaaagtatttgtaaacataatacaatactaaacattatataataattaaatttcctttagtattatgtgacatatatatatacatatattcagatatatgtagtatgtgacatatacagacacacacacacacacacacacacacactaacacgtttagttctgagaacgactttaacagggaattgaaattcagagaccctaaataatttctacttgatcacacagctgaaattcaaatatagctgtctctcacagtaaaatgtcttcttttgcctgtatctgaaatcccatcacgataacacaaccccttatgaatttgcaatattctttcaggtcttttatccaatgcctattattatagcttataattgtatttgcagtaaatataaaagcattgaagttttattaagaaagcttacttcaaatcatcttcattattaagatgtataatgaatttatctttagcattggaattaacctctagatattactgaaacctattgacttatttgatgagaactacaatttaaaatggcagcaaaattactagcaaaggaataaatatgtgaatttgccagcatttataagctaaggacaattaatctgtatttttattttgttccattttcagtagttttaaaaattcaatttttttagttacaactagtgacactgaccctcaaatagcctatacatcactaaaactatacatgtccacaattatggatgacatacttcaagacagtctataaataccacaggtttaggaaaacactttgaataataattacggtaaattgagtgtcctttgagtgttttgaaaagtgtggttttaggtagaatcaaataagtatgattttgccaaagaaaaagacaatttggaattacattagggaaaaaaagagcaggagcatatttgatagggcagaacattgcaatatatcttcagaaatgttaagtaagtttgttatgagggaaaagtatttatattattcacattgaagagtgctaaggagaagaagttgagatctatcttgggactcattgtgtcattctatagggtttggatgtaattccaataagaaactgagtgttatgtgaatggaatatgaagggtcagttactgctttggtttgaatgttcttgtccccttcaaaatttatgttgaacaatattgggaggtgtggtctttgagaggtaattgagtcatgatggttctgctcctatgattagaattaggttatcatataaaatggcttaatagagggaaatggtctggtgtgcccttctgccttctgtcatgtgaagacacatgtttctcctgtatagagaatgcagtaacaaggtgccatctttggaagcagagaacagacccttgtcagaaaataaatgtgctggtgcccagatactggatttctgagactccaaaactatgggaaataaatttctatttttataaattactcagtctcaaatattttgatagagcagcacaaatgagctagcacaattgcattgggaataaactaaacaagacaaattaaaatacatgtagattctgaattaataaactctttttataaacatataaattcaataacatagtctttattaagtgataaaacaggatattaagtaatcctaatatatcaattatagactaactctatttctagacaataccaggtaaaaccgccatcatttaaattttttaaactcttaaacttagttaacaacgttgtattgtgttgagactacaagtatctgttgatattacaactgagaacttgatacacttggactctaaacattgctgtctgatttctaccttcattattcttggcaactttatctgaatctttattactccctccagaattgtactctcagtctcatccagtcttgcttaggtatatcttaatatttgttttctttatcacagaggaaacctactaaactttctcaatatctatacacaaatttatttctgtgtaaatttactctctgttttatccagagaatatttcttcttccatttataggctgtctgcttgacttatgggtgttgttttttcactaaatctgctagaatccaacctaatattatattctataaaattacctatttttctgacttcccccactatctatgaacattctccagtatccccagtcttaaaatccctccttacacttgtttcctcaaacccatcttcctttatttctctttctctttatgctgacatacctgaaaatagtaaatgcttgctgatttcccttcctcactttccattcacctctttaatctactaaatcctggtttctgcgtctaatcctccatgacaaactagctttgcctatgtcgccgtgatcatttaataaatctagaatgttcttttttgttttcatcctacttagtttctgtgacttaaacatgacaagaaaggcactctaagattttgcctttgtctacctcttcatctaacaccatgacctttaaaccatacaatatatatcctaaccataaaaaattactcacagttctgtatagttctactgcctaatatggtagccattagccaaagttagctgttcaaatttaagtatgtattaatagtagctaaaaattctcttcattagtcatactagccacagttcaaatgctcaataggcacatatggctagtggttaccatagtggataaagtgcttggtatcaaatacttacttgtctgcgatggctcagaaaactttttagcatctcagtattttctgtcacaagcactgcttcccactaccagaaacacttgaccattccttgttttccaactgaactcatacttaatttgttctcacagtgcttatatgatacgtaatatggtcaaatgtctttctcccatactatgtcttaagtttctcaatttctatattgtgcctgtttgcattctcaatatctaacagtgcctgatatatttttgacactaaaaatactgttagatgaatgaattaatgcaacaataatcagagaaactcggagattttagttaaattagacttaaaatacgtattttttaatattttgaagttacccgtattttaaggcttaattcaaatttcttaacacttgtttccacagaggtcagtccaatagtgacctgtggggaaaaggtccagtctcctcaaatgattctctaagagttcctaatttgaaaggatccaagtaattggattcttctaagaaaacgaagatttggctgaaaaatatataaataaattttcaatgaattgctcttgggactttatttttgtctaagcattgggaaatttttaatatttaaataatacatattttaaatatatagtgataagaaacacacatactctcactggaaggtagcatctaattcttcttaaactcaggtaaattatatggtggttagaactatagtctactcaaatattcttttgagtttcaaaaagccatttttgtcatgcagtcaactcatatgtaggagcacaatatatattaatttatatgaataatcaagaaaattatttaggctaaaggaacaactggagtcaaaggactggatttgcaattgagctgacacattatttaaattgtctgtatttatttttattgtgtgcatctaaactgaaataatttttatttattttattattcctaatttatcagcaatttataaatgatatttatatttcatttgtgtgtacatataacaagttagtgtggaaattataatctacagcctaatatgtgtcaggtatacaatgccaacacttgcttttcaaaacagtctgctctggtttcaatgttcttacctaaactcaagttagcactttcattcctagtacagcaatgttgggaggttgtgcctttaagaggtgattaaatcattaagatggcttaatatttttctcatgagactggattagatctcattgtaattgattagcttcttagggagtgagttgttacaaggtgagattcctcctcatgtttgatcctcatttgctcacatttgctcacctttttgcttctctgccatatcttaatgcagcacggggccttcagtggaagctgaacagatgccaccaccttactcttggactttccagctaccagaatcatgagttaaataaacccctttttaaaattaattacctaacctcaggtattctgttatagtaacataaagcagactaagaccacatccaacctggagtatatacatatgtaaatataaaggctgttgaaaacccctacctggtttacttaggttatattacaaaattataaatatttcatatgtgtgtatgcacatatataaatataggtatgtgcatagctaaacacacaggattcctttaaaaagattacagttgtcatctatagttcatatcttataaatgagtgactgtgttcttacaggcttttctaaaccaaatccttcgactgtgtgtttccagtttaagattgtgaatactgtgtgatgcaatgagatgagcattgatctcatctgaaatcatgctcttaaaactaaaatatgtctaatacatatagaacattgggtcatcatagagcactaaataaggtacatagccttttaaatcaaaataaaagcctcaagcctacatgaagcattccttctaagagttgagtttatacagaaaggagtagtagaaggaggtaatataggaaagtgacaaaatgctggaaagactttgcctattttacaatttaacccagagcaagaaaagtattttggtatttgatcacatatgaatttattaatccttctaatcactacagtttgcaatctgtaaatgctaatattgttcactttgacctccttgacattttgttcaaattgtggtaacaaaacatataatataaaatttaccatcttaatcattttcaagtatacatttcagcactcttaagtacattcacattgttatgaatcagatctttagaaccatttcatagtgcaaatctgaaactctatacctgttaaacaactcctctttaccccctctgcataacccctggtaatcaccattctactttctgtttctgttaatttgactatttcagatagttcatgtaaggagaatcatacaatatttattttgataacggatttatttcactttataatgtgagataaggttttcttccttttaagacaataatattccattctatatatatatgtcactttttgtttatccacttattcatccatggacacttgagtcatttccatatcttggctagtgtgaatagtgctgttatgaacatggatgtgcaaatatcactttacactctgctttcaattcttttggagataaacccacaagtgggattgctggatcatatggtagttctatttttaatttttccaaggaacctccattctattttccacataagttgcatcattttacaatctcaccgactggcacagggttctgatttattccacatttttgccaacacttgttattttttgctttgatgttgtttgttattgtttttacagtagcaatcctaacggtgtgaggtgatatctctttgtggttttcatttgtattgttctgatgattagtgatgttgagcattttttcatttgttagttggctatttgtatataacctttggagaaatatctaacaattccttcatccatttttagtgaagtttaacttatcttttgttgttgaattttagaagtttttaaaaactcttgttatcaatttcttgtaagatataatttagaattctttaaattttttcagattgccttttactctgttgattgtcccttttgattcacaaacatttttaattttgacatggttctatttgtctatttttgcttttgttgcttctgattttggttttctttttatttcaagaatgtactgtgaaaactttatccatcatcctgataatgacttaagctagaaatttcagaatgatcttcatgttttctttgtaagaaatcctattactcacttggttaaaaaagtaaaaaccctgaggtcacaggatacattttgcagttcataacaaaggcatatagcgtaataatttagactcagtgtgctttttcaacctgattacatgtaagcccccttccctattcccaatgcacagtctcattgggcatttcctgtttccaaaatgtgtcttgcatattcttgtgaattcttgtatttttattctttgggaaagcttctgtattagttcgctttcacactactataaagaactagctaaggatgagtaatttatgaagaaaatagatttaattggctaacagttccacaggcttaaaaagaagcatgactgggaagcctcaggaaacttacaatcatggcagaggcaaagaggaagcaggtacatcttagcgtggtggagcaggaggaagagagagaagggagaagtgccacacacttttaaatcatcagatctcctgacgactcacttattatgacaacagcaagggggaaacctgtacccatgatccaatcatctcccaccaggcccctccctcaattaacatgagacttgggcagggacacaaattcaaaccatataattccaaccctggtccctcccgaatctcatttctttttcacatagcaaaatacaattattcattctcaacagtaccccctgaccaaagtcttaactcatttcagcattaacccaaaagaccaagtccaaagtgtcatctgaggcaaggtaattaccttccacttatgtgcttgtaaaatcaaaagcaagtttgttacttccaagataaaatggaggtacaggcattgggtaaatgcctctgctacaaaaaggaaaaattggccaaaacaaaggggctataggccccatgcaagtctgaaacccagcagggcactcattaaatcttaaggctccaaaatgatctcctttgactccatgtctcatatccagggcatgctgaggcaaggtgggagaattgcttgaggccaggaatttgagaccagcctgagcaaaatagtgagaacttgcctagatgcaaggggttggctcccaaatccttgggcagttctgcccctgtggctcttcagggtacagcccccacgactgctttcatgggctggcattgagtgtttctggcttttccaggtgcacggtgctgttggtggatctacagttttagggtgtggaagacagtgtcccttttctcacagctccactaggcagtgccccagtggggactctgtggtgtctccaaccccacatttcccttctgcactttcctagcggaggttctccatgaggtctctgcccctgcagcagacttctgcttggacatacaggtgtttccatacatcctgtgaaatctgggcagaggttcccaaacctcaactcttgccttccatacacctgcaggcccagtaccacgtggaagctgccaaggcttggggcttccaccctctgaagcaacaattcaagctgcatattggccccttttagccatgactagaggtggagtggctcagacacatgacaccatgtcctgaggctgcacagagcaagggtttcccgggccttgctcaaacagccattttttcctccttggcttcttggtctgtgatgggaggggagatctctgaaatgccctggggatattttcccccttgtgttgactgttaacatttgactccttgttattcattcaaatttctgaagcaggcttgacttactccccagggaaatgatttttttattctaccacatggtcagttggcaaattttccaaatttttatgttctgcttcccttttaaatataacttcaaatttcagaccatctctttcatcatgtgtatgagcatacacttttagaaacagccatgttacttcttgaacactttgctccttagaaatttcttcttccagataccctaaaacatctctctcaaattcaaagttccacagatttctagggcagaggcaatatgctgcctgtctctttgctaaagcatagcaagagcggccttgctccagttcccaaaaagtttaacatctccatctgagaccacctcagcctggacttcgttgtccatatcactatcagcatttcggtcaaagccatttaacaagtctataggaagttccaaacttccccacatcttcctgtcttcttctgagccctccaaactgttctaatgtctgttcattacccagttccaaagtcacttccactttttcatgtacctttatagcagtgtgccactccaagtacaaattttctgtattagtctatcttttcactgctctaaggaactacctgagactggataatttatgaagaaaaaggtttaattgactcacagtaccacaggcttaataggaagcatgactgggagggctcaggaaacccactatcatggcagaaggtgaaggggaagcaagcacgtcttactgtgatagagcaggaggaagagacagaggaggtaagtgccacagacttttaaatcatcagatctggtgatgactcacttaccgtcatgagaacagcaaggaggaaattcctccccatgatccaatcacctcccaccaggtgcctccctcaattcgacatgacatttggatggggacacaaatacaaaccatatcactctctatccttctatttgacaaagtcctattgatcatgtgaagccttaactactttttcctagctttatttttctctgatctgtcactattatgtgcaaatttacctaaattcacttcttttttaagaatacatttataatgcgtactaagcacattactgtgcttagtgtgacagtgcctatcacaaagagcttaataaatgtaagctgctattattttgatcatattttaataaattgataataatatgatagtattattcattatatccttattgctattatatatatatgtaaataagttagattttcagagtatcataaaattagcatatataagtaaaataaaaacataaaattattataaaattactggctgtatccttcttcctatctttgtaaaaacaaatttatggcctggtaccagattccaggtttcattatgtggtcagaatcacctgagatacctcttcagcatcatcctccactctcccctcccttatttgaattggctaattttataatcatgctttaatattacacgtgtgtgtatacttctctatgaatcctccttgggatagctggctctctccatgattctcacagtgtcctgtgattttacatgcaatttataactttcaactgaacatgaagtttttgagagtatcatttatctttctatccttaaagcctaacacagtgcttggttttaacaggctatcaataaatatttgctgagtaaatgagaattgcatgacaaatttccatctggttgcccatgttaataaggtgaactaaatttccttttccatactaatactgttccgtaggaaagcctgagtggcctggccttaaattctttggctggctctacatcttatcattggatctctgaaggaatatagagcatgtttccctaaatctctaagctatcatctctacgtattatactccctgaatcccaccctagtgcctctaagagaagtacttttgccttcaaatggtgggaatatcccccaagaagaaataagtcaagcctattgagctgcagtcactgaatttctgttgcctaagctatgctcacaatatgaaaagggaaacataaaatatgtgtaaaattgaactctgtgtatatgaaaatccaatcttcattatgcattttaacattgtttctgtatgcaacagttcatacgtgcctttaccattgctgagaaaatataaaacctctactgattacttccaaatggaagagagtctagtaacagatcactaactttctcaaatttctttaaatgtttcagtaaactgagtatttgagcagaaatgcattttgcaatttgataaagtatcatactacccaatttgacatataaatgtatgccatttagttgactttttctcgatgcctcaaaaactgtattcgcttagcaccacacactacttgtaagcattcaatatgtagctatgtattaatttgaaagtaagaaaacagacaatgagagcagtattttgaaattggtcctgaaattataagcagttattggaactggtttatatactcaaatatgtttggaatttaaataaggaagcctctgtctgagtacatattaactatttattttgcagtttttaaacatattaacttcttttttgtgtttggaaatatattttaaatatatgtatgatttgtatcaatgcatctaggtcttccttctctgtataattttaataaattctacatagtgtaatacagtatgttaaaaattttgttttgacataagcattgcataataaagttctacattcaaattttattttctatctctattttttcagtatacaatctggtatacaatgagatggtcataaaattttgctcatagaaaaataaaaaaaaattttatggatttttaataggtaagcagaaaactataaatgtgtatttttttgccttcctaccttcctttctacctcttttccttcctcttttcattaattcattcactcattcaaaaacatgttattaagcttctttagcactttgttaagaacaaaaatttaccaaagtactcaatctgcttagttcccaccttcatggggcagaacagaaaaacaacacataattacaaaaattgcaaattgttgtatgggtcatgaaagaaacaaagatctgaaatgaagaataatgtagatttatttcagacgaggtagtaagaaaatacctctcttagtgggtgatgtttaaactgaactctaaaagataatagagaactttcccaatgaagagtgtagtaaggaatattctacgtagaggaaaagtcacaggcaatgacttaaagtttgacctgggttgaagtgtttgactaaatgaaagaagagtacagtgtttgggttgcagttgctagcaaaataagtgaggcaatattggaggaccacatcatgaaggcccttggtacttacaggaaataattaagatgttgatccaaatgtagtcaacatttttgaagcattataggaggggagtaacatgttttaattatatgcttagaatttttatttttctgctctacagggtatggattaaaggagattagaatttttgtgaggagacacattaggatgatcagtaattaaatatgatgaaagcctaggtgaaaggagtaaacctggtgatgtggagaagttggcatattcaggatttattgaggatagaatgagtaggacttgctggtgacttaggtattggggaatggggtgagggaaagtaggagacagagggtttttcttggagcaacagggtagttattggtgctggtggtcccaagggcttgaaatacagcctggtacacagtcagcactcaataaatgttacatgcaaggatggctgattaaatgaaggaatgcataataaaaggaggtgaatgtggaagaaaattatgaccttattttgttgataccaagtttgaaatgcttgtgacagatccaagtggacatgacaggtgattgtgaatatatgattttggaactccaatttctagtgtgtgaattattcttcattcgcaatctcctttcaacaaatgttaactagacacctcttgggagcaaggcactctgccagtcaaaggagaattgtaagataaggcacagctctgccctcaaagagttcatttgtataatatataaatttatatattagtataaagtggtgttgtggtgctatgtaaacacctaagtagaaattgtcacctggtgtgggaaagtgagaaaatgattcttaagggaatgagtaagattatgctggaagcaaaagttaagggttatgtagttaatgaaaaaaacaagaggggaaggaattatctaggaggagaggggaaaagatgggattgacttaggctgatggtaggagagagcttcctgtgttaattgcagggagggagaggtgtggagggaaggggtggaaataaccgaggcttgcagggtaaacagaatcctctgctgttttttaaattaattgtagaaaattgaacagtcaataacaatataaacaacataaaaaaggagtggtatagcccacccagttttccttccccttcctcctccttctgcttttcctcctattttatcctttggccaatctacgatactatttcctggacaatctgtctcaaattgtattctctcatcaaaattgcatttattaatgtcatcaaaattgcctttattaatgtcatccagattggtacttgttgtctattcttttaacatcaactttataatatttatttgcaattactatattatttgtttaaatatagatatcctttatatattttcaactatatacatcaatataattttcacatatatatattttttgatatatgtatgtgcccatgaattttcaagtatttttccagtttgtctccccttggacattaaaaggccacaggaaaaagtctgtagtttttccttctgtgcttctttttctttctctcattctggccttgtagtgtgagattatagagctggactgcctgggtttggagcctagctttattgtttctcatctatgctagttatttaacatcactagatttcatagagttgttttgaggatgaaatgaaataagtgtgaaaaagtttagtcaattcgaagagttatacacttcctatgccttctcctctcaagtgcgttagtattaaaatggagataattatactgtaacatcagtacaatgataatttattgcatctttaagtttttcttcttgattggatcataacattatttttcatgcatacctatcctattacatgtctttttaaaaaataattactgagcaatctcctttgatctatctcactccactcccatttctaactttagtgttattctttaataaagtgttcaaagaagtttctttgttccataactccttttcctctccttctcatcagacttccccctatccagtcctccaaaactcatcaatgactaaaagccaccaatgattttcaagttgccaaatccaatatccaatgctcagtctttgtctttaaacactttctttatttagtttcagaaacaccttactcccctggtttaatttcactttactggccagtccttcccactcttctttactactgtatttatttctcatctttctgaactctcagttttatgatatctaagattcttgatcccttctcctctttattccttttctctcactccctgtcttgtctccctcctatcctctcctgagttcttctatatcaacactcatttcccatgtactgtaacaaagcttcataactttaaattccatctctatgctgataatcctcaattttttaatctccagccccaaatccttacctgaactgtagaagggaatattctcaagaaatgtgtagctaggattgtgtacagacatatgtgacacatgtgatagtaaatatagatacacagatgtggcataaacaggaggatcatgcaaaccagtgggcccagtccacttctacttggagcccttgtgtaatcattgtgtacaccctttcactctcaaaaaaattccttgttcaaagactaagttatgtgcttactccttatgcaggaatagatttctgagttatatcctgaagaataatgagaactttatctagcagaaagagaacaaagactcaaaacttaagacacagacatggaacagcatgctatgtttagaaagagacaccttccagtatgtttgtagagctttgggtgtcatatttatccgtggacctgcagggactagaaaccattgagaattttaaagactggtatgattaaatattcattttagaaatatgactctgggtatacttatagaatagactgaataggaaaacatatctaacagaaacttctgttattttcataggtgagataagagcaataatgcaggagtatagaggtgcaaagataaaagatggcaaatatgacagattctttacacaacaaagtctctttttaggcaagtgtccttattaagcttttcaactaccacaacatgtgatcagccatactgatcactgatgactattaatataatatatttgcaattcacttattttcaaggactgtgacttctgatccttagtcattcttcatttatccaacatatcaccaaaaataaaatagcctttatggagaaataagaaattcttggcagataattatgaattatgataaaaattcatgataaaaatgaatcccatagggttttttttcttttttcccacaaggtttatttaagaaatataatgagaaagagtcccatcaaacttttcctatataatgtctttattattatacaatgatgtctcgttaaataatgtgagaaaaaaattattttgatgccgaaaaatagttgtgcctatgtgtcttatggagtctataagtaatgtaaactgatcatgtttattcctctgagataattcttaaaatgtgaacctcatttagcaaaccatgaaggaccttgcagtatgcattttgtacaccatccttatccttaccccactcttgctttactgtttctattattctttttgcctccatttgctcttttcattcctatgacattaatataaacaactagctactatatgaatggggaggaaagaatgaaccaccacgtatttggtacagatgcaaagaaaggatatgagaaaatgtaggccagttcccaaatatttctcttggataatgagtttttgggggctttggtagatacaaaaaggtgattgcccagtatggaattaaattaggatgggggcagggtaaaattagtagtagattagtagattttttgagagtaagatgtccttaacacatttaaacagagacagatattttatatatagttggtggaatggatccagagctcaagagacagatctgaattcaagataagccagatgggatctacatccactaagatagtaaatgtatgcttatgaataatgcactctctacccacaaaaaaggatacctcagccacacagagcattccattgcaaaggattcagcaacacagtgctctctctttattcctgatgctcaggactagaaccactggtttacaggtggatattcaggagagcaagaaaagtgaaagttagaaacgagttttgatcctatgcctaaaactgaggaaatttattaacaattttagtgaccaacttagttttctactaataagaatgcatgtgaaattacataaataacttaagaaagaatatgcctgtgtgaagcatttggatctacttcacctggctgagttcaaaggaactttatttgcaagaataggcaatagaccagatttggcccagaagccatagtttgctgactcctcatttagttgatattgataaagcataattttcaaaaggacgaaatcatgactatcatgccaatataaaatgaacacttgtcaaatatattttggcttattaattaatgagggaaccagtaacatgttaataccattccaagagcatttgagaagctaggcatttagaggcaatcacaggacaaggttgctggattagatatgaaactggttattacctacagaggccactaaccataccttggaattatattttcaatcatacaatagttaactggcatttcttggagtgaaatctaaaagctaacatgtgacttcactaagtcttcattatttactaatagtaaaatgttggtcagctaagttaattgtgtaagcccatgggtgggccaatgacgtttaaaggacatgccagaccttttttttttttgccttatttcctagcttcctcctgcctgacaatatttcaaaataattaagaaagtaggaaatcatgttacaaatgtttgtattaattttgtattgctgctgtaacaaattaccacaaatacagtgtcttaaaacaacaaaaacttatcttacaattttgtaggtcataggcctgccacaggtctcactagcctaaaagcaaggtgttatcagagctgcattcctttctggaatctgaccattgccttggcttttccagcatctggaggctgcctcaattccttggctcctggtccttttctatcttgaaaacctgaaaaagcacatctctctctctctgattccttcttctccctcttcttcccccaatttaaggattcatgtgattagattgggcctgctgaaatattcctgggtgatctcataatttcatcagtagccttaattggattttaattgcatcaactgattagcaaacttaaatgtatcttcaatgttaataattatcatctgtcatctaaagtaacatattcataggttcccagggaaaatatctgttggcagagacattatcctgcctaacacacattgttcacactatttatctaaacatggatgcttctactttttcatagtgtaattggggcacgtttattaacaactctgagctaattttcccaaatgtaatatagacttatgaataagacttaaataaacaataaaagtaaaatatccaacagtttgcatagcatatatgctcaatcagtgaaactactaaatccaatgtatgtgacaattagctatgttcctgtagactttgagtagaaatgaaggtattgtctcaagaagaaaccacacaattggtataataggtacttcatttgaaatgatgtattttcttgatgtggacctaagaaggaaaaaagtcgtactgaacacaaaatatcaaaactacgtaaaggggtacctttttatacatcacgttcttttctattctctggttaattttttaatagtaacaacaaaattatcccctcaaataatccagattcagattttaaatattaaatggtataagaggtatttgaagaaatatttattttaaagtattcatactttagttataattcttttgagatcttaaaatttagaacattaaacaatatataaagaactgtaaacaaatccccattttttttcagaagtggaacgtgaatgctgtctaactgtgtgatagaatattttttctatgttttaaccaacaattttagataataagccctttagggaaaggatttacttcttgaatatttttgttcattgattgctcagtttggaaattttcagccattatgtagtattttgaggttagagctcaagcctattcagccccagactgagaaagagaccaaactgttttattccttagggagaagctcccttggtgtaggtctaggattaaatagcacagaggattgaagattttacgtgatcacctcattagtagcatttaaagtaatggtgatagttgtttctaacaaatccacctttgtagaaaacaatggtacactcagaagcacataataatatacactggaagcattagcacgccaccctgaaagacaagagaagaagatgcttccccctccccccaccagtatttaacacagttgattgtgcatgactaattcttttgttaatcttgtctggtgtcaatcttttggtttttagtagaggtttcctttggggattgagcagcacacatggctgacctgcatgcttctttatctccagggctctaataaaatattagcacacaaaactaaattgatttggaaacataaggcacaaaaaagctggttttatgcaaatgttagcactgtataaaagagcccacggacatcactgaaagtgcagcttcacttcactgacaggctaactgacatttggatggatgctaaaattaaccatttagaaaaacgtaagcattgttgtttctgaggccctgcgtgtaaatgtgggtgtctaacacccatgtccacctcttatattactatacagtcaaaattttatttatcatttaagataaatattatccaaaaaggctgaatatccagaactcatttacatttggctttggactccataaaattagtttgtattccctaaccacatggcaactgacatcctgcaaaggtgacccagatatgtactcagtggcaagatttcagaggaagaatacacagctcaaaatctacagctgggatactgattagctataattttggataaatgcattttggctatagtaagttttgttgtagtagaacctgacacatatcttcttacaataacaccttgcacaagattggtgctgaaattatctactaaatacataaaacgctgcttacttttatttgtagcataaatcatttattaaagatattagaatttttattttctttgttcacgactttgaattttaaaatatttatgtatgtatttaagtatgcaaaaatacagacactaagcttagaataaataataaaacatgcatataaatctatcattgaaggacaatatttatttaattcatttaactttagaaaacaatgaatatattgatgcaaatgggaggattacagttgttaatgaaatgaaaatatttcaatataagttttgtcaactatagtacaatcataaaatttcacaggagctttctgtatgtcatattgcataatctcattgaaaacatttaaaaagtcctgatacttgaagcagattgtagatgaattcattataacctcatttcttagacttttttggagtatgtgtatatatgtgtttgaacatatatacatacattttacattgtatttttaggctgatgccttccaaattgtaaatttaaaaacgattaggaaaattttttttatttgtgtaatgagtatgaatattgagcttggattattaaataaataaatttgaacagactctctttaaatccatactttagagaaaaatccaggacaataatacaaaaatgcaatagaaatgttataatgattgttctatatgcataaaccaataattctgttattacaatttattaagaacaccaatcaaaaatttaatgtgtgttttgcattcccattatttacccagtaagaaatgttgcaatatgtatttaactattttttcctatttttaggaatttaactatttttcctattcaaattcaaatatagaagataaatttagatagaaatttgctgcgaacattgtttattgttgtcatgtattcttcagcctagtcaggaaggactttctagaaaaagtaaaaaggacaatgcttgtttttatgtctttggtttcttttcctcctttgggcatctttttccattcttaactttcttcactttctttctatgtttttaacatctcaaactgcagtgtgttcaccgattaaggctattctcttagatggctttttttgaaacttgtctccaccactttttaactacatgaacttgggcaaattactaactttttgtgactcaattttctctcctataaaataggaaaagtaattgtttcattttgttttcttagtctcttagagctattgttagaattaaatttgatgatctattttaaaggctcagaatagtgcctttgtttacacaatacatattagccattatttaccaaattgtctagtctatataacgttttattaaaaatctgctttctcctgaatttcattggggaaaaataggttcaaagtccaactgttatttaaaatatagaattcaggagcagagtgagaggtagcctatttttaagcaacccagctctgtagaactcttcaaattatactaaaagtgctctcatactttgcctttctcacagggcttcttatggacaaaggtttgctacatttttgttctcactttctattctcttcttactactcttattttgtagcagaaaatgagaaacaagcagaagcagtgaacctgtcatttaactagtagagatagcaagagcgaaatgaaatctatgcgactgagagtgccttctcaatcccctgctgcggcaattttgccagagggagtaacaagtcaattgtgccatcaccttgctggaatcttcttactgacaaaaataaaacttctaggatactgataaagaagtcagaaaacctgaaactgagactgctggaaacattaaagttaataaaaatgcactattaaaataataatacatttctaaaaattagatacagggtgtggctctgttacccaagctgtagtgcagtggcacaatcctagatcactgcaacctcgacctactgggctgaaatgatcttcctgcctgagcctcccaaagttttgggattacagatgttagccaccatgcccagtcagtaataattttacaaatataacaccaatccagaataggcttaagtaaattgatttaggtcacactattagtgtcagatttgtccccaagtctttctgattctagagcagtcacttttaagctcagcacattactgcctctcaaataaatgtccaataaattttatggacatattgagaagcaaaaaacatatttaatcagataagctattctttagatatatgccataagtcagcctcattctaggtatgtaagataaagttgtaactaatgtattagtaatgtagtcaagagttgatggcatttatattctaaagtcaaatgagacaacggtaaaaaaatctattacataatgggatattgtaatcgagactgatgggggattgttttagctgacatggttattagtcaagaaaagcattactgatttgaatgacatcatgtaatcaatcataggaagaacttggggacgaagctacaactcattccagcagtaacccaaaaagtccgattccaaggtctaatctgtgacaaccaagtcccttccacctatgagcctgcaaaaccaaaatcaggttacttacttcctagatattatacaatggggatataggcattgggcaaatacgcctgctccaagtgggagaaattggccaaaacaaagggattacaggccccatggaaatccaaaatccagcagggtagtcaaattttaaagctccaggatgatctcctttgatcccatgtctcacatctaggtcatgctgatgcaagaggtgggctcccatggccttgggcagctctgacccttggctttgtagtgtacaacacctctcctggctgcctttacaggctggtgttgagtgccttcggcttttccaggtgaacagtgcaagctgtccgtgaatctgccattctggagtctggaggatagtagccctcttctcacagctccactaggcagtgccacagtgagtactctgtgtggtgactcaaacccaacatttcccttccacaatgccctagcagagattctttatgagggctccacttccacagcaaatttctgcctggacatccaggtgttgccatataccctctgaaatctaggctgaggttcccaaacctcaattcttgacttctgtgtaccctcaggctcaataccacatggaagctgccaagggttggtgctcacacctgctgaagccatggcccaagctgtaccttggcccattttagccatggctgggacacagggcaccaagtcttgagcttgcacaaagtagcaaggcccggggcccagcccacaaaaccatttttttcctattagccctccaggcttgttatgggaagggctgttgtgaagacatctgacatgccatggagacatttttgccattttttggtgatcaacatttggcttcttgttaattgtgcagatttctgcagctggcttgaatctcttttcagaaaatgggtctttcttttctgtcacaccatcaggttgcaaattttccaaacttttatgccgtgtttcctcttgaatgctttgccacttagaaatttcttctgccagataccttaaatcatctctctcaagttcaaatctccacagatctttaaggcaggggcaaaataccatcagtctttttgcatagcaagagtgacctttactccagttcccaacaagttccccatctctatctgagaccacctcagcctggacttcattgtgcatatcactatcagcatttttgtcaaagccattcacaactctctaggaagtttcaaactttccaacatcttcctgttttctgagccctctctaagtctctaagaagttccaaacttttctacagttttttgtcttcttctgagccctccaagtggttccagcatctgccatttacccagttccaaagttgctttcacattttcaggtatctttatagtaagtgccccgctccctgtaccaattaactgtataagtctgttctcatgctgctaataaagacatactgagactgagtaattaacaaaggaaagaggtttaatttactcacagttaagaagggctgaggaggcctcaggatacttacaatcatgctggaaggaaaagcaagcacatccttcttcacatggcggaagaaaggagaagaatgagaatcgagcgaaggcataaactccttatataaccataagatcttgtgagaacttactatcacaagaatagcgtggagaaactgcccctatgattcaattacctcctaccaggtccttctcatgacatgtggtgattatgggaactacaattcaagatgagattggagtggggacacagccaaatcatatcagcttccctgtagaaataaattatgtttttttagtgtattaatcctgatataagaaataccataaacagggtaccttataagccacataaatttcattctcactgtcctggatacagggaagtccaagatcaagctgtgggcagatacagtgtctggtgaaggactactttcagattcatagatgatgccttcttgctgtgtcctcacatagaggaaggggagaataagcacctttggacctatattttctaggcactaatcccattatgagagctgtgtcctcaggacctaatcacctacaaaagggccccctgtcctaagcaattgcctcagaagataagatttaaacatattaattttgatgggacacaagcattttaatcatagcacattattagacatttactcacatctgtagcaaaagacattatagacataataaccatatctcaaaataacacaaagtttcactagagataatacagttaaattagtgacacgtaccactgtcaaacagtgaaaattaataaactataattacatgcaaaaatatggatgaatgccacaaagaatagcggattgaaagaagccagactcaagaggacatactttcagcttccattttataaagttcaaaacatgcaaaaataatctattatgctataacgtagaaatgtgtttatcttcaggatggaaatagcaaggactgagagggagtatttgggagatttctaccattaggctaatgttctcttcttgatttgggtgttagcaacaaagctgtgctcattttgtgaaaattcatcaagctattcacttagaagttttcagcacctatattgtatttaatttaaaacattatcaaataaaaaggagaacacctcaaaattatatattctcctagtcagctaatgtagtgtgagatgtctcacagatcttcaagggactggtcagatctattcctcctctttctgaattccctgagatgctgattagaatctgaccattatttaagcattcagaattttcctaggtcagtgtatctcaaaggttagcaaggatgagattcacctggaaggcttgttaaaacgtccattgctggacctcatctccagagtttctgattctgtaggtacagggaagggtgcaaggactatggtttaagtaacgaaagtaggcatcatctcagccctttatattttatgaaagctctgtctttatttgtgcctactttcatttttaaccttcacgctctccttgatttcccaatccacttgatgctttttgcaaactttaatattacttcatttatgaaagtgaggatgattagggtatgatttttctcaaaatttccaatgttctatctacctctgtttcaaactaggctgccatcagaaacacctagagaacatttaaaaatacctataattcatctccaaccctaaaattcctactttttgtaaaaatattattggttaataatggggtctacagtaggatgctttttaaaagtcctccaggtgatgctaatgcatgataagaataaaaaattactgtactaacccatgcataatagctaatctatacactgtggtcttctttatcttttgcctaggtcagggtctttctgcacctgggatcccttcagctgatagatatctctccaatatctttccaaggtccaaacacaaatgaagccaacacatactattctcaatagcaagacacactaaatttttattgctttattctattatctcttcctaacagtaaattttccctcttcccttttcaaattcctcagaaaatttgtctttgtttaacatttctattcatttttctgccatttatttctcaattgactggtctcgcttcttttcacacgttctattgaaacccttttcctaagttcagcagtggcttcctaatagacacataattgttcacatttttaaagtagagtctctccatgacatttgacattgttattaactcattctttagatatctttttttgtctttcttgtgaaataatttgattattattgtacctgtctagccacttctctatctacctcattgcctcctgtttctctaccaattaatttaatattatggtttcccaggtttccactgttcatactatatactgtttagtagaagatgatgtctactttattgatttcaattgtcctccatgtatatgatgattctgcaatttatgtcagtcggctcaatactcttaaccattcaactgcctgtggagaatatttaatattcaaaaagcatcttaactagtttgggtagaaattatcttttccaaaaattgtgttcatttcaaagaattgatttcatgaattttagtttgaggggttattgattcgcatttgtagagaagactctcagaaactctagcagcttgaagcagttacttaggacaagtaaaaaggaaaatttattgaaacatagagaacttttactttcatgactgattgcaagtattgtgagacagaaacaacagtatgtgattatttctctatttccttggcaagactgaatgtcccagccagcaacacagttaagatggtgccctgaagctaaaggctgtcctataggaagtatgaaaatgtgacttaaatcacatctaaacctagcctttaaaaacattatttgttgcttagtatggtacatgacacatagctattttctatctttttttctactgtgcctgcctcagatgtaatcattaaatgtggaatagaaatttattcatttcctcagaggaaagagatgcaacattactatgttcattgctgtatttaattttatttgcaaatttcagcaattgcactgaggtcagcagtttaaattactgctcctaatatgactatggatgattggattatgattaaaaactatatacatagcatgcatccctgtatctataaataaaactaaaacaaaatattcataattcttagtctaggaaacttgcagacttcaaagtctgaggtttctccacttagtgcactgtggccagcatctctggctccaaggagcacatagtgcagtgggaactcctgggaggagatatcaagaaggccaaaaaataaggcaaagttaaatttcaaaggtggcacagtcagctgtggcattgcggggataaataggcctttttgtgttcttttaagggaaggcccccatgttatgggattgcactgtgcacaaaagttagttatgcagttttgatcatgttaaaaggccagtactccacttgcaaaacaaaatataaaactaagccatttattgaggtggtcagaggactgtttttagcattggctcagaaacaaaacaaaactaaacaaaaaatcccagctggtttaccttaggcaagtcacttaaacactcttggaacaaagttcaatcttcagtgaagtgagaactgtgattagcactatttgggaggttctgacatttggacatgagaactctccttttactgttatccagccattgaaataagcttcaattttctgcagtgacttcggtctcatgactacttctcagtccaagaactgggctttctaggaactcaggacaattgcaactggagttgcaacacaaaataaagagcaactcttgctgaggacactcacaagtgtgtgtgtgtgtgtgtgtgtgtgtgtacgtgtgtgtgtgtgtgtgtatatacatatatatatatatatatatatatatatatatatatatatatatatatatatatatatatatgttttattgggtcagttgtgtatatcattgcattctgagaggtctggttgcagaccaaagtcattgaactggcaagctcttatcctagggtaatttgtagtcaattcttggtatccaacctcattttaaaagatgcattctcaaaaactgtaatcacatacataccatggaatattactcagcaataaaatggtataaactattgaaatatgcaataacttggagagatctccagctgagcgaaaaaatgtaaaccccaaaagattatatactgtatcatttcattttataagacattttgaaatgaaaatcttgaaaatgaaaggcagataagtaaatgattgccagggattagggagtaagaagaagaagaagggaagtcagtgtactttaaaaagagcaacacagccaggcgcagtggctcctgcctgtaatcccagcactttgggaggctgaggcgggcagatcgtttagaggtcaggagttcgagaccagcctgacaaacatggtgaaaccctgtctatactaaaatacaaaaattagccaggcatggtggcaggcgcctgtaaactcagctactcagcaagctgaggcaggggaatcacttgaactcggaagcagaggctgcagtgagctgagatcacacctctgtactccagcctgagcgacaaagcgagactccctctcaaaaaataaataaataaatacataaataaaaggagcaacgctaggaattcttgtagtgatgggcccgttctgtatattgactgcaatggtagacgctcaaatcgacacatgcgataaacttgcatagaactaaacacacagtaaataaatacaagcaaaactggggaaatgtgaataagattggtggattgtgggggcggagggggaaagtgaatagtcactggctaaaaggtaaaaagtttcagataaactagaataagttttaagatctattgcacagcagggagtctacaggcaataacaatgtatatttcaaaataagtcatagtaaatttcaaatgtctcatctccaaaaatgataaataatagaagtgatggataggttaattggcttgatttaattatcccacatagtaaacatattataaaacatcacgctgtaccccataaatatatatataatcatgatttgttgattaaaacaatatttaatttaaaaattctttgaaaacttctgacctgggaatgacaaagaccatgacttcaatcctgtctttttcccttgtcccatgctgtggtctaaatttatgttcccccaaaattcatacattgaaatcctctctccatagtgatgatattaggaggttggactttttgggaggtgattaggtcttgagggcagaactctcatgaatgggaatagtgcccttataaaataggcccacaggagctcattcaacccttctaccacataagtacacagcaagaaggcaccatctctgaaccacaaagtgggtcctcaccagttactgaatctgccagtgccttcatcttggatttcccagcctccagatctgtaagaaataatagcttgaatagactaaaacagaaaactggtaccaagaagtaaggatgctactgcaacaatacctaaacatgtggaagcatcttcagaactaggtaacaaatagaggctggaagggttttgaggtacatgctgaaaaagcctgcattactgtgaatatccattcattaagggcaatcttggtgagggttcagaaagagaagaggggagatgtagagaaagcctcaatcttcttaggtaaaaacttagtcattaaaaaaatgtagaaatatggatggtaaaagcgattctgatgaggtctcagatggacattaggaacatgttattagaaactagagaaaaggtgatccttgttataaagtggcaaataccttggctgcatattgttcatgtcctagtgttttatgaaagatagaagttctggttaatgatgtaggatatttgcatggagaaatttctaagcaaagtgttgaaggtgttgaaagtgtgactttgcttctcttgaagcttataataaaataggaaaagaaagaaatgatagaaagatggaatttttaataaagggaagtggaacttaaggatttagaaaattgtataactgtccatattataaaaaatgaagatgtgtacaggagagaacaggaagggtgtggtcaggtgaccctttgataaagagattaatatggatcagcctggtgctattaattgagaaagtggaagaatgatgtcaaaggcaatttggagatcatggggctgccattcccatcataaggccaggctacaagagcctggggaggagaacaatttcaaagaagggactggggatacttatggaaactcagctcttgctgcctgcactctgtttccgtgcttctcagccactcctggtgtagctttggtgggtcctagaacgacatgggctatgtctagcaaagttatggggtcatggctgccttcatttagattgcaaaggatgccctgtaaagaaagctgtggaactcagaaagaaaactgccctggaagtgaagccaccatgaagagtttccactaagtcagtgtccagtggagccatgggagcaggaccaccccagagaatccagaccagtagactgttgggtatgtgatttcagctttggagagctccaggcacagagccgatttgaagatagggccacaacacagaactgtcacgggagcaaggctgcttgaagccttaggaacccaatctcagtccctggagggtaaacattgagccaaagaatattattcttgagctataagacataatattgtttgccttgttagatttcagtcttacttgttacccctttcttctttcctgtttctccctattggaatgggaatgtctatcctatgtctgtctgaccattgtattttagaagcagatatcatttttgatttcagaggttcacagtcagagggcaatttgcctctgcacaaatgataccttgagtctcatccatggctgatttagatgatatcgaaataggactcttgactttagacttccgacttgatactagaattagctaagactattagagctattggaatggtatgaatgtattttgaatgagagaaagacattaatttttcagggccagaattggaaaagatgttttatcctcaccgttctacagtgttgctgttgtcataaatcaagcgttgctgttgtcatgaatatgtgtgagtctttatctgaactcttcattatgttccattggttaactcttctatacttgtttttaattctccattgttttgattatggcagctgtataataagtctgaaatctggttgtttttcagctgtatattcttctttatgattgtttgagttagacttagctctttgcatttccaggaaattaaaaaatcagcttgtcaatttacacatgcacatttgccagtattttgattgtgactattctaaagccatagattaatttgggagacagcatattcatttgtttacataggtcttttgtattttctctcaagaatgctttaaaatattttgagtagagctttacccagctttttcatgtcttagtgccttcattcctaggtatatgaaattttattatattaaaaatggtattttaaaaatgtcagtctaattgtttgtctctgatatgtttttgtatatttccttctatttagttgtactgctaaattcactcattaagtttggtattttatcaatgactttaaaaaaatgtcctacatacacagttctggaatctgcgaatagttatgttgccctttcttgaaattaaggatggagaatataaattaattaacaatttccacttgctgaacagaggtagagattttccaattatgttattttgacctgcaacatacataaccttttttttttttttgagatggcgtctcgtcctctcactaggctggcatgcagtggcgcaatctcgattcattgcaacctccacctcccgggttcaagcaattctcctgcatcagcctcctgagtagctgggactacaggcacctgccaccacgccccgctaatttttatatttttagtagagatggggtttcaccatgttgtccaggatggtctcaatctcttgacctcgtgatccacctgccttggcctcccgaagtgctgggattacaggtgtgagccaccatccccagcctcatatcttgttcttaaaatgtatttagcaactcaccccattgttttactttgttttgactttttgctccatttaacatactattcctatgtttttgaactgtgatgtattctttgaaattctgtttattctattctgtagattctcagagatcagaatccaaattgatgatcaatttaaatacttatattcatttatttgttcatttcatgtttaattcaataaattcacttggagtccctactatatatgtaggtatagtagttttaagtaacagatataatatgaacaaaaagggacataagccctgcctttatgaagtttacagtgagagggaggcagacattttaaatactgaagtagaaaagagactctgccatcataaacatatagccattgaagctgcccaagaacacagcctccatccagatagaaacttgacccatgaacaacaagggtttgaactgcatgggtctactaacacaacccttgttttgttttgtttttcaataaatacagtcagccctccctatcagagggttccacatccacaatgaaacatggttggaaaatacagtatgggatgtgaaacctgtgtatagggtgggctgacttttcatttccatgggttctgcagggtcaactacagtacatgagcatactcacattttagtatcataatagatcctagaaccaatacctggcggaaactgggggacaattgcataacagtattcaagggactgggcctgatggcttgcacctgtaatcccagcacttttggaggccaaggcagaacaggagttcaagaccagcctgggcaatatggtgaaaccccttttctacacaaaacttagccaggcatggcatattgtgtaatgccgtttgcatgacccacatggtcaccctggaccccatggatcaggccctgcctgatgccaccaccaccacttctgtgccaggcccccagtgtgatgcgacttgcatgatgctctttgctgtagtgccttttaatggcatagctttggcaggtttggagatgttcagaataggcaaatctatagagcctgtggtggattcatggttgtctaaggcccagggggaagggagcataggtgaattggaggggacgattaaaaggtgtgagatttcattttggggtgatgaaaatgttctaaaattcattgtggtgatggttatacaactctgaatatactaaaaggcattgaattgtacactttcaatgggtgaacacatgtgagttatatctcaataaagctattttacaaaaacagaaaaaaaaagaaagagaataaagaatgtggataacaaagattgcaattctatctcaattcactgacaacttattaatcagaattcagctacatggcctcacttagatgtgaaaagcactaaaatatttgtcctggctggcagctgcctcccagcaacacctcataaatggaagtggaacatgaatttcggatctcagctagtcgtctctaccacatcaagatgcaaacaactctaagccttttgtaactatggattttatattttcatcaaatttgtaaatcctttgaccattaatctttccatagttttccatgcttgcccctgctccacaacctttttggaacttcaataacacatattcaactgtttggtattttcctataggggatatctgttctttaaaaagaaatcttgcttttctcttagctgcattctgaatagtttctattgccatgtgtttaagtccactgtgttttcttttgtactgtctactcttctatgaggcccattgagtattttttttttaatttctagtaatatattttgtgtctcttaacgtttcatgtggtcatcttttcatatcttccctttctttcctcactgtggtcactgagttcagtttttctgaaaagggctaaatagtaaatattttaggctttgctgtggttatatattctctaacatgtattcatctttgattttggttcgtttgtttttacaatcctttaaaaatataaaaatcattactagatcacaggcaaaacaaaaaaaaagtctataagccagatttagtctggggtatagtgtgctaacccttgttttaagtagttgaatatagttatatctgctataaagtccttattttctaattccatcatctccatatgttttggtctgtttctaatgatttttctcttggttatgagtcacatctttatgtttattgacatggctagtacttttttttttaactgtatattgaacattgtgaattttaagatatttagtgtctggatttagttatctttaaggaatcttgagctttcttctagtatgtatgtattaaaattacttttggttcagtttgtgtcttttgagatttgtttttaagctttaagtattgcatttttaagtggccttaactctaggcatagtttaccctctctactgaagtgcaccccttttgagatttctactgaatactccattcaaagtggactctatattctagctagtggtacctgaacaaatctcagccctgtgtgctttgttggaaccattcatcttacacattcctctttatgtgacttcatgaaatttcatccaattgcatgcatttattagtatttagcaaacactaatgaagagaatctaatgtaaatcttttgagtccttttcttctgcagagcttcctcctctctagaactttgccctatgactaacattccattgctcatgcttcctgaattctatgtactgagctgaaagaaacactatgctctacttgtaatccctctccttattctatggtccggaatgtatctccttagagaaagccaagtgataatagggctctccttcttagtttttctcctctcttagatcacagttcttcatagacctggtctaatgttttaaaacagttattatatatatttttctcagttttaatttttaagtcagtaatgtaaatttgttccctcttgctctttcatgtttattacttgatttaatttaaatatttttttctccaaatctttaaataatttaagttttattgaatgaatgcctatatttttgtcttatttagagattctgagaagtattttaagctgtatgtttaaaaacacatacttattaattactttcttcagtgcattaactgtctctcattttctcaacatgtctctttggaaggtaaatggaaattaatgtaggatatttgtaataagcatatttgtgcattcaaaaataaaccttcaaagctaaaatgccattatactttgctctttttacttctcagaggtgtttatctcagtgaatattgaatatttttctttgatctgttatacatgtttttcattttaatttcatctgttttaatatgaaaggaactgaggtagcttgactgaaaaataaaaatatgagaatctttaatttccttcagaatcattgaaaatgcacttttgttttcttcataagctgggaaggtattatttgttgtaccgtgacaaacataaaacaaaattatcaatctgaagtgttatttaccagttatttacccagttgctcaattttcttctccatgagaaaggggtttctctttaaacacaagaatgcaaagagttgaactattaaatgtaagtagaggcagttacacaaaattaactactgctccatatatgtaataagatggctaattaatgacagtgtaatatttaaatagtttgcctaattaggcacacaacagtgatgcctgtcttgggacgaaataaaaagcctcacatagatgtcagtttcacttgagtgctgatggaaattatagatttagcaaaggagaattgtagaaaaaatgttccatgataaaatttgaaattgaattgaatgcttagcatctggaatcgaccaagtgtacttctctcctacaatttacagttcatttctctttgatgataaacaagcctatttcctgcaccccacccccaacactaagctatttcagcagaaactaatagcaaggtagagcatagtatgagatcagtattggaaaagatgtgttacagaaaaccatttgggtgttttatgaagctgtgtttatttttttattaacagccatgtttggaaaagttccaatttatattatgttcaatgaaatggtgtggtctcatacccaaagccaaaacaaggtcatacatttacaatatctaaataactgtcacagagattaaaagtaaataaaaatttaattttaggaaaaagtacatttgtgaaatcatagtgaactatttttaaaaaccttttcactttaatacaactaatctttattttattttgttatgtttctccctgctctataggtaagagataaaaaagcattatttatgaagtttacataaattcagttattttaaagtataataaatggtgttatttgatgatagatttatattataatattttaaacaattaaaatgatgtttactaacatttttaacagccatagtttttaattaatagatttaaattcactaagaacttacgagggaattgataatattgctcctgaaaattggaataaatccaaattccaaaagggttaatagttttagtcctcattcttaaaattccacattgtctttattgatcccattagctgaatttgtggttttcttcatgttttacaacagattgactttgcaaacttcttaacatgcaatttgctaacatctgggctatgtaaatgtgtatacatatacatatatgaaaaattaaatgactttaaatcttacaaactttatacttttcctagaacaagagtagagaatccaccattgtttttattactcactgtattatctgtatgttaagcaaccacattcggaagccatcacaacttctagttaacctcaagggaagtctaaggtatttaatggcattgctttactatttaggtgaaaatatattattcttaagtcttggcctaagatggatgttctgattattttgtcatcatggtatttcttctgacatatctagaaagaccaaactaatcttttgaagataatgagataaaaataaaataatatagtcaaaacgagatgttttatctttaggcagcaatgaagcatgcaagaatttgcgtggactcttgattcagcctcttaatcttcatcagctatggccttcctctcttatccctccatagagcaactaaatgatcttttgataacctaaatccaattatgtcacatccccactaaaaacactttaatgttccattactatgaataaattccatacctttgtcagaaatgtcctgcaaggtctgacccttagttgcccttccaattggatttggtaccagatagcccctcgccctttttactgtagcacacaggcccattaccttggtaaaagtgtcagtgaagctgcaggaacacccttccctctgcttttcatgtagttactgcttactattttgctttgtgtttctggtccagcatcacttcctcaggaaattcttgttccttaattcgataactagttcaaggtcccaaacatacagcattagtactaaatgttccttcttcataggacctgacagaaatgtaattttatgtattcactttgtcatttgcttagagcctgactcactaatagaatactccatgagaacagggatcatgaaaacgttttatagtcattatagtcagagagattacatggtttcctcctggcacttggaagatctcaatgaatactttttggacagatgacaaaatgaataaattttgtttcacaagaagtttatacaaataaccaatatgatcctatgtgtatcttgagcctctaaggagatggttctatggaacaaccttctgtgaaccccccactttctgtgaattgttggatagaaaatgctgtagacatcatttattaatcaagcaagcctggaggctgtgacagagtaatgatgaaagaatagaaggctctatcctgtcatttacaggatatgtaccaactcattttgaacagagaccaagccatggtatttagcagaaagagcacagcactggattcaagagtttcatggtttgttctaatgctgccttttacttgtcccaaatccactataagttctttttaaattgacttaggtagtatgttctgctatgaattcataattacagaaaatatgttgttgttttttttaaaatattgccttgaattcagcattcaagtagggacaccaaaccaaaattttttttaatctaacatttactgaagaaaagtttacctatttcaccattttgtcagatactgattctatgatagtctctgtcataacaaacaaattaaacagaagtgttgagcatagaactcagtacaagagtcgacatgaacattggtttgaatgctggaggaactgagtccctatccttgttttcaagtgaaaattagtcatacatttgaacagaaattattttgctgtaaaatcaagatttccttgaagtgagttgttttctgggttgttctctcttccatgtgtcaggagtgtagagttatttatcagcattgtgagtctaggttgaggaaattcaaagagatcatgtagagaaattgatttctatgccttggagcttacggaatataatatattattattattaaaatgatggataaagtatttaaatgtctattgtgaacccaaaggactgcattttgaaagaaactgcatttccacagagggtgaataaatgggtgtgttttcatttgactaaatgcaggatttttgtgagggagttctggcttggcatggtcttacatgctgtccaagaggccaatctcaaaaggtgaggagacatttggaaagaagatgaaactgtactgttctatacccatagcatgagacagaaatgtaagcagccagctggagagacacagtcacccacagtaatggaactgatggggacacctctgtggagcccatgaaagggcctatgagtgaaagaatcatctttctttaattgtctgtcaaagcccttagaaaccagtgccaaattagtgttaggaaaataagaggattcagatcctctgatccttcctacttgtaaccccaggaggctcatagagatctcagtgagaaaggggaggatgaacagaaatactagcagggaaacaaggaaggagaccgacttctccatctcacctctgccccacctctgctccatctgccacaagtccaaggtatagggagcaaagaagcttaatcaaaatgaagttaatttctttttggttacccaggactggatatattaattgatggattgtgattttttaagttaaatcatttatttttaaacagacaaaagtaatgtatatttatcatgtacaaatgacgttttgaaatatgtgttcattgtggaatggctacattgagctaattaacgtatgccttacttcatatactttttatttttgagatgagaacacttgaactataatctctaaactgtgggatttttttctttaatctgagtgtgatccagaatgttatgtgtctccttcagattttatccagaggaaggaaaataaatagctcagtgagctggtttaaatagattgtgggccagttaaactgtgaatatatgctagtgaaataatttattatcaaagcagtattcaatgttggtcttggtacttgagaagggaaagaatagaagtgatttatggttgagggtagagacggcaggacaggattactagaagatttaggtcttgaaggcattggtaaaaatatttgtagtagtatgccacatggtctagacaagacaactagttcatttcagttatctaacaaacttaagagagaaagagcacacaataaaatttttaaaaaatatatttagtgtgtgataaaagttaaatatattttaagacgaacatacttacatttttgatttatagattatggaggtaaatggataaagagcaagaaagaaaaaagctaatactatttgatgcatataatacagtaataaagttgtctctaataacaaagcaattttttttatgttctacccatcatggaattgaatacaaagatattgtccatctccatttgtttaggttctggagctatcggtcacatcaaataataattggtcattatagagccagagttttcctcaaaaacttgaaggaattccctgagttggccaaggcaataacataagtaataagacaatttatttcacaagtgaacttgtaacttattagcttgactggcctaaacaatgttatagtaaggcaaatgccccagcttcaattcctttatgaaacaggagctttttcttatgtttgcataccaaacacagctactcatataaccacgctgctagttcctaccatcagccaaaagtagactagtggagaatctatggccccaatttggaaactcagaatcacagttccaaatgtaaggttagtcaaaaagttatttatggtgttgtatctatgtacattatatgactatttagtaaaagatacattgtttgatttcatatgaatatatttctaaagttatattagttaccctattatttctctgtaaacaaaatatcctggatatgtgatatatttttatttgagttgtatttctacaaacgtttttcaataacttctgaaacataccattgacatgaactatattatattgtctcttaaattatgtctttgtgttgtacatacttgcattgaaaaaccaaaaagctcttccgtcaataaacaaagtgatcaaagatttcccatcacagactttaagatacatgtttcctttgtttaactcactttgtcacttaaacatgaaaataaaatcttgattctattttcctaatgtctaattttagagtgtagattttttgcttacttttattgctatttcaactaattgttataaaattgttaagatatactttatacttgtatatgtgctgatacattttttcataaaattctcattttatttaatctctattagtatattatgcacttggtatcacatttgaactgttatttttatccaaacatattgacttgctttacttacaactgaacaattgcatttatctcaataacttacaactgaatattttgtcatttttaacagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggtaagtaaatagcttctattaaccttgcattgatgttgttgaagcaaactaaggaacaaagaacaactgaatgtggacttttacaggtttggatatttaaaagatcttacaggaaagttatgtgaagaggttgtcagagctgaaggatatttttgaagatcgagctatttacataaaaaatagatgaaattcaaaacttgtataaacaaataaaagttattcctattgtaatctacagttgtgttttttagcatgccagtccaaacttgatggtttctctcaaattaattgaatagtcttggaagtaattttcctttgtttaagcagacttgttatataccttgttatctgaaagcaaaaattaaacaccatcatctgggggaatatggtttgtttctttagaaactcaaggtatggtctaatgaaacctgcaaagtattcagaacatgcttttaagacataatatttttaaagtaaaatgcttctttatgctattttaaaaatttgtatctaattatatcattgagtagattatgattcagtaactgagtgaaagaatgaataagatgacactgataaaggaaagagataggtaaacactagactagagaggatcttttaagccatgtgaagatttgctaagaaccatgggaatttatccaaaacaattacttgaagatgtttgaatatccaaatgattattcttactgaaatgaagagattgatttgaagagggactcgattcgctgtaggaagatcacttaagagatgattgcagtattccaagaaaagatcacggtagctggaattagagtcatattaatgaggtaaggaagtagactgagttgagagatactgatgatgtataatcaaaaggactttgtaatggactggggggtgataaagaaggcagtattgaaataaaacctagttttctgatctgaacaaatggtgaaggcagtagtaatattcactgagttggaaattgttgaggaaaggttaagtttggaatgagaaccctgtaaatattgagatttgttttgaatatatttaattggaatattcttcaagatgtgcaattaaagccatctactagacaactatatttcttatatgattcaataatttagagtagaagcacaacactggtatttagttaatattgatggtaagtgaaccaataggcaacaatataattggatatatagaaagaggataaaatgagaaaacaaaggaagactgggactgaatctgagacttaacaacatataagtcctggacttagaaggatgatacagaaaagaaaaccgaaggagtcatttgaaaaggtaagagaaggaagtcttgtgaaatactttcatgcagacaagggaagaaagagcaggcctctttggtgctttagacacagaagcacttagaacaatgctgttatgtagcaggcacctcaacaagtatttgttgaataaacattaaacaaatggaattctagtaaaaatcaaaattaagtttggaaataattttaaagagcatctaatccaactctccatccaaggctttgtaaatagttatttacaaagtattgtatttagtgaacgttttacttctttgtttctgtcatagcgtctaagctgacaatgccataatatcagaattaagagaaaccttggatgttataggtgagaacctgagatctagggaggtgacatgacttacccattgtcatccatcaacaaggagccaaagctgaatctagaacaaaagcagtaatcaacataaataaggtacccctacactctgtctagagagtgataagaaagaaaagatgtggaagagtaagagaggtcaagagagcaagaatgttttgatgagtgtgtagcttacttaattgtaaagttgatatttgagcaaagtcctgatgaatataaggaagttagtcaactggatgagccttcaggcaaaaatgacatctagagcaaaatacttaaagcagagtgggccttattgtgttgtagaaacacctaagaagccattgtggctagaaaagaatgaccatgggtaaaggcagtaggagggaaagaaagataattaatagagcctggctcaagattcatctgtcttttactttagatgaaatgtgaattcacttgaggggcttgagcacagtaatgacatgattgaccttattacttaaaaaaaaagtcactgtggctaccgtgtggagaataaactataggagggaaagctaaaagaacagacattatttgtggtatgtaagtgagagtttataattatgaaataagaaaatagcagtggaggtgaggctaaattattgggttttcaagataaatgatagaatttcttgaaatgtgaagttggagaaagaaaagaatagctctaaagaatatctctaataacctgctaatacagatcccagattatttgacctgaagaactgagcaaatacaatttaagttaactaatattgggaaggctattgatgaaacatttttggagggatgatgtggagcttaaatttggatgtgtgaagtttgagatggctaataaatctgtagttgaagatttcaaggggacagttggatatacaaatcttagtttcaagtcaaaggtgtgggctgaacttctaaatttggaaatctcaaagtggaagtaattattcctgtttctaccagttgaagtgattattaaatttaaaaaaaggaaaaagaaactaatacctgagttgtgggacactccaacactaaaatgtcagcaaaattaggatgaaccagtaaaggagattgagagtgagagtaaatgagataggaggaaaaacaatacagtacagttatcccttagggtcttcaggaaattggttccaggaccacccctgattatacaaaaatcttgggatgctgaagttccttatataaaatgtagtaatatttgcatacagcctacacacatgcttccatatactttaaataatctccagattatgtacaatacctaatataatgcaaatgctttgtacatagtttttaaactgtatgtatcattttgttgtattattgttgtatggatttttttttcagatatttttgatctgtgattggttgaatctgctaatacagatcccacagacatataagattgactttataaattttcctggaaaccaaaagaaaaaattataatggaattggccagttgtcaaatgtgaatgataagctaataaaataagctccaaaactgatcactggatgtaataacatagaggtcattgggtaactccgatgaaagtaattttgtaggtgataggctgactggaggggtttgaagaaagaattggagaagagatattataggcaattactataaataagttgttcagggaattttgcaagaaagagtgttgggacaataggttaaaaagaaagtaggagcaagggaagagtttttttctccttttttggagcttattataaaatacgttcctaaattaataaatggatttagcaacatggaagtcactgttaactttgatgaaaataattttgcaagtgacagtgtgattggaatagttttaagggagaattggagaacagatattatgaataaattgttcagggaattttacataatagatgcacgtagttttggggtatatgtgattttttttttttctgagatggagtctcactctgtcacccaggctggagtgcagtggtgcaatctcagctcactgcaacctctgcttgcagggtttgagtgattctcctgcctcagcctcccgagtagctgggattacaggggcgtgccaccacatctggctaattttttgtatttttagtagagacggggtttcactgtgttagccagggtggtctccatctcctgacctcgtgatctaccgtcctcggcctcccaaagtgctgggattacaggcatgagctaccgcacctggcccacatatgataattgaatacatttatataatttgtaacaatcagatcagtgtccttgggataaccatcaccttaaatatttgtcttttctgtatgctagaatcatctacattattctcttctagctactttgaaatatacaatagattattgtaaactatagtaaattaattgatacaaatacatgatttgatagaataaataagacctagtgataaatagattagtagcgtgagaagaatttttatttattttgtggttttgcttgtttattggcagagttaatactgtgatggtgatcacctaccagacattgaaaaattaatgataaagagtggggagaatcatttaagcaaagtgaaggagtagagatagtcaaagaaatcttccctttgaaaatctgtctgtgaaaggaaggaggaaaaagttacagtaactaaagggtgaggcagaagaagaaagtgaagattaaaagaccatttagggggctgctctatgccagaggctgaatgaaatttcattaatttggaaggtctgcatatggaaataaaaggttaaaggctgattttcaaagactaaagttagggaatgagtgattgaatatcaaagagagtaatagtaatttcttcagattagattatggaaaatatgtaaataataatagaaaggtcagaaagacattttaatacattgggcccagaagataaataatgatttcaattggtaagatgtaggttgcagataagcactattccaaaaagaatatgtcctattggatgtttgacttaattatgatatatagtttgaagtaagaataagaatttttaagtcattaaaaatgaaatactggctgaagtcaagggaacaatatggttatcaagatcagaatattagtgaaaacatggcatgcaggttatataacatagaaaatctatgtaatgttattcaaattaagaatgcaataaggtatgtaatacattttgttttattaaaatcgttttgcacaattatttatttttattagttggttaaaataatactaaacatttagatttaaactaacaaatttagtcaatacaagtttccagtgaaggctgactcccatctaaaggtagttcctccatttgtgcactgttccttctcaactactcaggagtgtcatgccccaattttcttaattctcttttataccatcaatttttgctccctaatcgattactattaaactagcttacccatcatttctctggaactgtcttttacaaaatgagcaataacttcttagttcctaatttaatacttatctcacttgatttatctgcaacatttgactttgttgattattacctcttttccagaacatccttcattcttattcactgggatgtcttttctttcttgtatctttttctattactcactgactatatcctttcagactttttcttttcttttttcttccatcatccattctgtatatgatggcatctacccagcttttttctcatcttttgtttctgttcaccctactttggaatgcataatttcctgtgacttcaacaatctaaagattttgtgatttttctccttccagattactttctctcttgctttgtttctatctgtacacatatctttgctcaaataacaggatcttaatgagaacttggatctcaaaataaacagaatgcctagccctgaacatttcacactatacttattttacatacatttgtgaaatgtataaataatttttgttccacatataatttgacatcattgataatctgcttttacatgttttttccaatggttgtacttgatttgactgaagttacataaattagtttggattaggtttaactatgaataaaagaaaatataagcaaaatgcaaacaaaaaccaagaggctaaaacaagacacaagttgtttgtgttttgtttttgttcgtttgtttgtttttaatgcaggtttctggaggtaggcatttatgggaaccgcaccaccaccacctagtatcaaacactcaggatccatttatttgactgttctacttgtaggttactttcattcccaagatcatatcttgttcaagttgagccattaagttacacttcaaacggtaggaagaagaacaaggaaaaggaaaacccaaatggcagtcatcagctacctcttaaacaaagttttagttgctgacctacattttctatttcattttctcctatttctgcttatatcccattggccaaaatctaattacatggctatttggctgttagggactcaggggaaagcaatccttattctagctagttattgcccagctaaaatcccatttttaggaaagaaaaggagaaaaggtgttagaggataactagcaatctctgatacatggtttttattgatgcaatccctgtaggaaaaatgtgtataatgaatactcactagtattttacatattatagaaatatgtgtgtgtttatgtttatgtctatactggcacagatagatacagtagtagaaagtaaactttcctttgataatctgcctgtgaaaggcaggaggaaaaaaatacaataactaaaaagtgagacagatgaagaaagtgaagattaataggccatttaggagactgctttatgtcagaggttgtaaggaacttaattgatttcgaagctctacatatgggaataaaaggacaaagactgtttatcaaagactagagtcaggggaatgggtgattgaatatcacagagtgtatgatctttattgccaaaaatagataccacaaataaggtatagataccacatatatgggtatacaaaacctatgtgatacagaaaaagcagtactaagaggaaagtttatagctacaagtgcctacatcaaaaaagaaaaacttcaaataaaacacccatgatgcatcttaaagaactatgaaagcaagagcaaaccaaactcaaaattaatagaaaagcaataataaagataagagcagaaataaatgaaatagaaataaagagaacaatataaaagatagtaaaacaaaaagttgtttttttgaaaagattaaacaaaattggcaaagttttaaccagactaaagtaaaagagagagagagagatggagagcagatacacataagtaaaatcagagatgaaaaagaaaacattataattgatacggcagaaactcaaaaaatcatcagtggctgctgtgattaactatatgccaataaattggaaaatctagaagaaactgttaaattactagacacatacaacctaccaagactgagccataaagaaatccaaagcccgaacagaccaataacaagtaatgagatcaaagatataataaaaagttttccagtaaagaaaagcctgggagtcaatggcttcagtgcagaattctaccaaacatttaaaggagaactaatgctaatactattcaaactattctgaaaaatagaagaggagggaatacctcctaattcattctatcagaccagtcttacctttgctctactttaataaatactttcatgagcattgctcagagcccctacaactttgacactaaactccaaagttcctcttgcttactcctttcacctatttttaatttaatcataatttctaatgcttggcatatttttttttctgtaatttattaacctattacttagtcctagccaagaggaaacacctttttcattttgataagagcaaagtataaaaagatagatatatctcatttaagtttataagtgcagtgaccagaaattgaactctctctatgtatttttttctaatagtttctaatttctttcttaagaaagaggcaaaatcatgtcctgaaagtgaggagaggtggtaggttaggatattttagcagagtgagatttatttgaaatactttctctggagaatgtgagaaaaagggggtgggaatcaaaggattgctgggcagtattttgaatagggttgagatttcacaacatatgtttgtaagagaaacaattataagcttgcataatttttctacagcaggcttgttaacttatatgtaagcataacaagacaggcaacagcattgctgggccatggaatattaggacaatggaggaggagattgaagatgttggcaaagcacagtgtggatggggaagaaaggggcttccaaagcagtttgcctcttctaagcacattaattttatccataaattttattcataagtctgtataaacaatttattcttgtcagtttgtgtagaaagaaacaaattgtaacagagaacctacaattttctaaaatattagagaatgtaaggttttaataattgagaacttatcttatactggtatatttgtttctaatatgcaaatagcttacatttttaaataaacaaatatttcaaattttttcatcttaataagacaattttctgaatacttttaataattcagatcatcaaaatataatttcttgatttaggcattacttttgaaagtcacctctgcaactcccctccattagcatctttttcatgaaactagcctatgcctaacttgactaatttctcttatctagtaaatgcttacaggcaaatattttagccccaaaatcctttgatggcatggatttaaaaataagtagccaattcatataggatcattttcatacaaaaaaagcataaaagcgaaacattaaaacttccttttaaactcactggtcccttctacaatgactttctctgctacaatgactttaactttttttttctgaacactcattttctgttcaacatacctccctatattattctacaaaacgggataatggttagtcaaccaacagtcatcatggttagtcaaaaggcaggtgctttcttttttattttattttatttttcgctttgtttgttttccagattaagcatagaacagtaggatatcagaccttataagatgatatggaattttcagttctcgagaaagcagacagactcttgggaggagctgcaaagtccaataacaaagggcatgataaagaaaggcaagtgacacaagtgataaaggaagacaagtgaagacttgcactatacttgccttatttgcactatagtccataaaaccagatgattttaatgagattcagcatcttctatatttcaaaataatgggtatttaaaaaattaatatccctttattatctctcttgcaataaaaaatttcagggtttttcttccatgtatttaacaagataattacatatttattctgctatatagaagatgacgtgtcattattcaatgtattgttaactctatgtcttagataatatgatttatgttctaaattagtactatgacttgtatttaaattattttgtggaaaatagaaaaaaatagctaccttagaattcctcttgaagaacaattgcctttgttaagtgattggctaaaaatgacaccctttggcatagaacagattggctagtagtgagattcttccattgttccaggaataacattatctgcaaataatacaaaagaaaagaggaaaaccaagagtgatgttgaatgaaaattatgtattgaaagaggagagtggaggaagttgaaaagaaaagtagtacatcagggaattccttcagtgaagattgctttagtccatggttcactgccatggtactccagcctgggctacatagcaagaccctatctccaaaagaaaaaaaagaaagaacacgaaaaaaagagaaattctctgacagagtcatgactcagaaagtttgaagaaaaatatgtgtttaatgttcaatattcaggtgtattctttgctggtgtagaatgtaatccttaatcccagtttgctggaggaattgtttgtatacatctttatttattttatttttttattattatactttaagttttagggtacatgtgcacagtgtgcaggttagttacatatgtatacatgtgccatactggtgtgctgcacccattaactagtcatttagcattaggtatatctcctaatgctatccctcccccctccccccaccccacagcagtccccagagtgtgatgttccccttcttgtgtccatgtgttctcattgttcaattcccacctatgagtgagaacatgcggtgtttcgttttttgtccttgggatagtttactgagaatgatgatttccagcttcatccatgtccctacaaaggacatgaacttatccttttttatggctgcatagtattccatggtgtatatgtgccacattttcttaatccagtctatcattgttggacatttgggttggttccaagtctttgctattgtgaatagtgccacaataaacatacgtgtgcatgtgtctttatagcaacatgatttatagtcctttgggtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagaacctgttgtttcctgactttttaatgattgccattctaactggtgtgagatggtatctcattgtggttttgatttgcatttctctgatggccagtgatggtgagcattttttcatgtgttttttggctgcacaaatgtcttcttttgagaagtgtctgttcatgtccttggcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttttatttgctgtgcagaagctctttagtttaattagatcccatttgtcaattttggcttttgttgccattgcttttggtgttttagacatgaagtccctgcacatgcctatgtcctgaatggtattgcctaggttttcttctagggtttttatggttttaggtctaaaatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattgatctatatctctgttttgttaccagtaccatgctgttttggttactgtagccttgtagtgtagtttgaagtcaggtagcatgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattaccttgggcaatatggccattttcacgatattgattcttcctacccaagttaatcttctgaataagaagttggtggattcataaaaaagatgccactttccacgtatgtggtttgtggtgggtcctttagaaagacaaaaacaaccataggaaatgaaacatgagtgagatcaagagtagtcaaagagaaatttggagtggaaaatgactcttaaaaaaataaactcctaggaatttgcagaagtgtgagagagagagaatcaggtgtctttcatttgctatgcgatgcggttccaacaaaacatattcagatattaaaagagatgacttagctgacacctaggttacactttgccttgttggaaaacacacaaagaagtaaagccacatatattaaatttttaagttattaaagatctttgattgagaaaatgaacgtcctcaataggacactgatttaaactgaaaactcaattttcaaggaaaatacagatcatagtaccaatttgctaaagaggattagaatataactcaagaaaaaccaataaaatatcatactttaaaaataaacccctattctttcaatgtcttttgcaaatgctcatattcttaattagcatacgtaaagccaaactcagcactgttatactcagtagatatgcctgatgaaatgcaagatatattacaaatatttatgatatattttcttaatatttaacaaaataaattagaattacacaagtcaaaagctcccaataatatattttgaatatattttgaatttattttgcctctgtcatattgtttatgaagaattgttatttttcacactttctacttctacaagtcaaatttattggtgacttcctacttctacaggttcaatttataacctattggaatgataaattacaaaacgtcatggtttatagtgttagaatttattctctatttctatagattgattgatggaacattacaggatggggcgttatcaggaatttttgatgtactggttggttggctctttttttttttttttgacggagtctcgctttgttgcccaggctggagtgcagtggcgcgatctcggctcacttcaagctccgcctcccaggtacactccattctcctgcctcagcctcccgagtagctgggactacagtcgcccgccacccacgcctggctaatttttgtgtgtgtgtgtttatttttagtagatatggggtttcaccatgttagccagtatggcctccatctcctgacctcgtgatccacctgcctcggcctcccgaagtgctgggattacaggcatgagccactgcacccagccggttggctctttttattgggaacattcaaaatcctttcttctagctttttgaacagacacaatgaattattgttaactatattcatcctctattgttctagaacactagaatttatttctgggaagtagatgtaatttcatattcattaactaacctctctctagcactctcctcttacacttctcagcctctgataaccataaaattactctacatctatgagcaccattttttttagctcccacatataagtgagaaaatgtagtatttaactttccatgggtgacatttcacttaaaataatgttctttaggttcatacatgttgccattaatgacaggatttcattcttttttatggctgaatactattccattgtgcatatataccaccttttctttatccactcatgcatcaatgggcatttaggttgattccaaatcttagttactgtgaatagtgctgcagtacacatgaagatgcagatatctgtttgatatacttatttaatttcctttgtataactattcaatagtgggattgctggatcatatggtagttttagtttagttttttgagaaacttcataccgttttttataatggctatagtgatttacattcccaccaaaattgtatgactttccttttctcaagcacctatttagatctttgccccccttttaactgaattatttgtgggtggtttttttttggctgagttgtttgaattttttgtatattctgaatattagtcctttgtggataaatagttttaaaatattttctcccactttgcaggttgtctcttcactctgttgattgtttcctttgctagccaaagctctttagtttaatagagtctcatttgtttattttgtaatcataaaatatttgtacagaccaatgtcctcaagtgtgtttcgtatgcattcttctagtagttttatagtttctggtcttacacatttaagtctttaatccattttaaattgatcttttttttaaatagagagagatatgggtctaattatattcttctgcatatgaatatccaattttcttaatactatttattgaagagggggttctgtccccagtgtatgtttttgacatctttgtcaaaaatcagttggctgtaaatatgtgtatctattttcaggttctctattatgttttattgatctacgtatctgctttcataccaatgccatgctggtttacttactatagttttgtactatattttgaaaacaggtagtgtgatgtccatggatttttttcttttttcttagtattgctttggatattcatgggttttttttttttttttggttccattcaaattttagaatttttttatattttttatatttagaatgtcattggtattttgatagagattccattgaatctgtatattccttcaggttgtatggtcattttagcatgtttaatttttccaatccatgagcatgggatacctttccatttgtttatgtcatcttcaatttctttatcaatacattttagtttttattgtagagatctttcacctaattggttaaatttcttcctaattattttatttttttgcgcctattacaaatgggatttctttcttgacttatttttaactagtttgctattagtgaatagaaatactgctgatttttgtaggttggtttttgtatcctgaaactttactaatttttttatcagttttaaaagcatttggtagagtctacatttctctagatataagatcatgacatctgcaaacaaggataatttggctttctcttttgtaatttggatgccttttatttcctttccttggcgaattccttcattttaaatctttgtgtgactttataagagaaaagagttttctaggctacatatacttgtgtcttgttttttattcgttagccagtctatatcattttatttttaaaattttcctttattattatttttttcaaggaaagatcttgctctgttgtccagactggagggcaaaggcacaaacatagctcactgccacctcaacttcttgcctcaagtgattctcctgtatcagccttctgagtaactggggctacaggcacattccaccatgccacccagctaatttttaaatgttttatagagacagagtctgaccacattgcacaggctgaccttgaactcctgggctcaagtgatcctccctctacctttcaattgaaaattttaaattgtttacatccaaagttgtagataggtgagatctactcttgttattttgttgttttcttattgttttgtatattatttgtttcttcctctcttactatttatattttttctcatttgtatatcttttataccagtgagttgtatacttttgtttgttttcatgatggtagatattgtaccttacttccagatataagactcccttacacatttattgtaagaccattataggggtgatgaatttcctgagtttctgcttgcttgggaaagaccatatttcttcttcatttcttaagcatagcttaagaacttaagctacctagctttgctaggtagttttcttacagcttttttattattattttcagcactttgaatatatcatctcattctctcccggcttataaggttcctgctgagaaatctattagtctaatgagcattcccttatatgtgacttgacatttttctcttgctgttttagaattctctctttgtctttgattttggcagtttcaatatagtgtgccttgaagagaaatatttcatttctgtggtcctcttcaaggcacattgtattcaaactgccaaaatctatcactttaatcagtttggggatctatctgcttcctagatctggatgtctagttctctcctaagacatgggacgttttcagctattatttcattaaatagattttctgtgccttctcccgtatcttcttctagaactcccaaaaggtgaatatttgtttgcttaatagtgtctcatatatcatgtaggctttattcattttcttgtaattttttttgtctgagtgtgttatttcaaaagacttgtctttaagttcagaaattttttctcctgcttgatctaatctattgttgacactcaattgtattttttaattttattcattgtatttctcaactataggatatctgttttgttcctttacatgatatctctgttgaatttctcattcagattaagaattgttttcctgatttttaaaaattgtctgtgttttcttgcttctcactgagtttccttaaaattattattttgatttccttttcatgaattttatagatttccttttctttggaggtgtcaaatttccttttttgtttttctcatgtttcttatgaccctatattgatatctgtgtacctggtgtacacacttcttccaattttgtggagtagatttatagggcaaagttttttttctgtagatttatctatagtatctgttggacagagtgctttggttttggttctgattgggcacagttgtataatctttgtatgatttacttagctgtaatcaatttcagtgatatctgtgagttcctgagtaggttagaatgcatttatttgtggagactggatgcagctttgctgggaacagggacagtggacaagctgatcgggggtatgcacaggaccagcagtgggggtgatgggccccaggtgggtctatcctcacactcctgggtagcaggcaaaggcacagctgccccattgctgaagagggtgggtttggcatgcagtagcaacaggtcctaggtagagcagtccttgggcccctggcagaacacaagggcatcagtggtgcttgcagtgggccccagcaggctagtccttgggatggtgagtggcacatagtgatggtcagggtgggagtgattgtccaggtgggccagttctcagatccccagagggcatgcatggatgcatagtggcttccctgctagaggaattgatgttcttgctggcagctgcaggtccgggtacgtggctctcaggatctggggagtttttgctttgcctcatattatctggaggtgagccaccctgttgtgctcagctgcctaatttcctagaggtataggggtactatgtggtctgaggtgctaggttacagctatactgctgggtcaagcttgtgacatgttgctgcaaccatttggattggtttggggagaaatctgcagagtcccagggatttttgagatgcggggagtatcaagccccagggcaagatgtagtgtgatggtggctctgctctcaaaatgataccatgctgtagcagcttgggtcctagaaggcgggagagacccagcgtgaactctctggaacaacgcagtcacaagagactccaggtaactccctatactcagggtatcggggtgctgagggggctttcctctagctagtactgcaggtgtatattgtgggaatgtggactgctgaggatcttctgcttacctttttccagcagtgggggagtcccaacaaagacacaggggtgaaaaccatttgatgattctggtagagattgaaatgacacacctccaagccaaggaacactgagaatttgtcaactaccaccagaagctaggaagagccaagaaagtttattctacagaggcttcacagtgaacatggatctgtagaaaccttgattttgagattatggtatccggaaacatgaaaaaataaaattctattatttaaagccacccaatttgtgatattttgttatggcatctttaggagcctaattaataaaatttgcagtaatttcttacattttcacagtacatttaaggtaatagctaaactttttaatatcctgtacattatttttccaagtattcaaagaagaacaatataaaattaaaatatgatgttgttactatgttttcatattagatatggaagatgatttgggagaaataaaatttaaatttccaattctatctaacagagaactagaagatatagcagtttttgctcattttgtctttcattgcttcaaaataacaggaataatggcatacatgaaaatagctgatatcgagaatgtaaaaatatcgtgagtttttattgtgttgaatcttacttaagtagaactgaaggaaatacattcatatggtctgcattatttatttcagtcaaatttggtttctctggttagaaactacacctagggaaataagccttctgtaaacttcatgaacaaacgtaatttttcactgactctgtgctttttgtaatgaaaatattcatagtagtagaaaatcttattgtgcctgaaaaatgaatgacttccttatttgggtttccattatattttgcacacacctctattattgtactcatcatattgcattagggagatatttttgtctatctcctctgttagatagataactcctcaaaggcaaataaaattattcattatatgtcaattttctgtgcctagcatagtgcttcgtctgtggtaggctcataatgaatatttatgaattgaaataattattgaattcatagcttcagtagttacatccacaaggtgtagtttatattaatgccactttcaagtagtgaaaagcataaaaattgtttttatggacattactcaattaagaaagagagatgtaaaataatttaattacttacctgtcatgggattttagtgcagtcttcccatgtgtatagttgagtggattgacaaagtgttttgttttatttaagaagtgctgaaaaccatctactcatcaaacatcactcagtatatgttccagagaacatgttaacggctaaataaaaacaaacaaacaaacaaacaatcctctgtccttcccctaagagagagatgagtgaaaattccaaaaactgaggcagaaggtgccatgcaagttcagaaaaagagcatctcaacttagaagtggagaaatgtggagagaaaaacaaacaaacaaacaaacatttaaaaataccaaggctatgtattataagttgaaaacgactttaacatcttgcttatatgactttgcgtattttattgcaacagtgcacttaaacaggaatgtcttatttcaagtaatcaagaagtcagaatattataactgaacacagaagcactggtttctgtgacttctcaaagaactccaaaaatatagcatcaaacgaaaaaaacatttctgaattttaacttcaacagtcaaagatttaggttttgttcttctagtgtgcctttccttatctgtatcatgtctacatgatttgtcctgatctaagtttctacaagaagactgaggtttcagtcctagcactcaaaaagtcttcatttttctctaataaggtcaccaaatccctgaaactcatgatgcaacctcagatgcagtctttgttaaattttgatagcagctatatataatattctctttacttaggaagataaaatgtaatgaagctgagttgaaaaaaaaatcaaagtgtgatactagggaaaattgttccagtcattgtctcactattgccagcaagttcatttgggaaataagaatatctttggtagaagtattaatgtagattttgtattaagataagaatctttaatttgccaatcttagaatttgctaggaatgtattttccatctacatttttctaccattatgtattgaacaatgacatttattctgagaaatcccaaattgattatactatctcaatcatctgctcgattttactattttatttagaagagtaagttaggataattagagataataattactctttaaaaggtgaatggcaaaagaatgtattcaaatatattttttctgggtcagggttgcttaaatcttataataataatctttgctcaaagagaaaacatattctgtctgtgaagcaaacatcttttttttaaacaggtgttgcttcaataatcttgaatgtttcataaattatcaggtacatattaactaggactctaaccttcccagtatactttgctccaggagccctggctgcgttctctaaatgtaattgtctagctttgaaggtattttgtgaggactgctttctgcggcatttacatgcagatgggattcttaggaggactctgtgcagctattactctgtgaatagaatatgaaaatgatgcagttcctttaggtaactggcaatattttcaaactaattttcctcaaggaggaaaataaatggactttatactgaagatttctaccttcattaaaagctcatgtgggtgttcaaaaattaaccagaagatgtgaccctattaaaccccccaaatttatgtaagagcaaaatgactaagataagtccaaataaagtcatgatacaattgaaattttatgttcatgtattttattgagaggtagtctgagctttcatttgatcagcttctaatttcctttaatgtaacagtattttagagcatagaacgtgtttcatgtttaatttactaaattgaagttattttcccaatggaagtggcatacatgacattgggtgttcatcattttgtatgccataagaaaacatttaatctttctgtttgatctctaatttgtcttaacgggatctcagtagcataagcaaaattaaataataaataaataaatagcatatctcctattccccagaaccactcagtacagctgtgcaggtgacacaatgtacaatttcaggagtgtccaataatatgatagtctgcataaatgacattcctgagtgttgtacagtacacagcctgtgtgactgtaaatggcatcttatgccagcattgaatataatttgttgtttagcctgattttgccaggatgttcttcccttgccctgggtatactcatgtgaatagatagtttttaactcattgagttattattgataagtaaagaaatgtcttttcatgcttttgtttacatttaatttctaaaatttaatttgatttaattttcctatactataagatcacttgactgggatcaaagcaatctacttattttctttaaacatgctgtataaaccaattaatgtttcattttcatactgtttcattagaaataatcctcttccttaaaaagccatataattttgagatcaattatgctcctattttaaaccttgaatgttagcttccttcaattggaagtgtatcttagagttttgtttttgtttttgttttgagacaagagtcttgctctgtcacccaggctggagtccagtgatgcgatctcggctcactgcaacctctgcctcccaggttcaagcgattctcctgtctcagcccctgctagtagctgggattacaggtgcatgccaccacacccggctaatctttgtatttttagtagagatggggtttcgccatgttgatcaggcttgtctggaactcctaacttcaggtgatccacccgtttcggcctcccaaagtgctgggattacaggcgtgagccactgacattcttagagctttttatataaatttgctagcataatggtttttttataactgtttttaaactttaattttattttttttttgcttttagtaactttttagagtgtttttacattttatcttttattttgaggtaatttaagattacatttagttggaagaaatcatccagagatccggtaagcctttcctgacagttttcctaatagtaactttttgaataactatagtatgatatcacagtcaggaaatttatagaatccatcaaaattattcagatttcaccagttttatatgcactcgtgtgtatgtgtatatatatttaattctgtgtaattttatcacacttgtggacttgtaaccaccaccatgctcaaaacagaacaagtccatcacaatgatccctcatattacccttctatagccacagccacttctcttccttttgtctccctaatacctggcaaccttctccatctctataatgtcacttcaggaatagtataacagtgttttcaaaccatcttgtgataaataatatgatgaattattacttgaatttttaaaagtttagtatctttgtgcttccagtgacattatagttataaattgtttaccttgactttaccatacaataaaatattgcctacattattgtaaccatagttttatagttcttttgccatccttctatttggaatccattttacccttgtacctgaggatatgctttaatgagctaaaatttgctttacttttatttataaaaaggttatattaaaaatgtcatgtttttatgaagaaaaagcattctaatatgtataatgtgatagctctatgtctaaattactgggtaatcttaattaagagatttaatatttctgggttttacattaatcacatttttcttgtactactatagatttaatcaaataaaagtttgtattttatgattgtaaactgcctctaactgaaggactttttaatgttgctgttctgggtattatggcattaccctctttctttaatttattatttaagttcattcagaatataaattataagggattagaccaatgttatgatcagttcacaaatttgcccttgacagtggcagcaaaagatgtattatgaacaagtgtaatgacaagctatcaacttcaaaaggataattgtgtctatgcaaattcttaatctatatatctgtgtagatactttgctatctatctagtatccattagagtatcctgaattctaattggaccagtttttattccgatgctcttatttccatatcacaaataaaaagttccatgaatttacagttcatttcataaactaataacttttgttgtgtcttgttttccttaaattccatttcaaagataacttttagtgaaactactcagtaggaatacaatagttgaagatacgagagaaattgtgactgcttgattgaattttttaaatcacctagtctattaaattatctttgactaagtggaataatttacaagcatattcagcttttatgttgccaatagaatatttttatctttgcaggatatcactggtgcattctttaagtatattattatttataacagtagcatactttacaaattttttttcatctattatttgctttcctataagggtcaatatcaacatttatcagtctgaagtgttctaataatattggataacatttaaataggttgagacagaatagttaccctgaataatataggcatatttcatcacccttaatcttcaataagactctttcaaatatgcaagcctatgtttctatgttgatgagaaatgaattagccaaggcctcattaagcctgacaattctgactgcatatatagatattgaagctatttcatagtgatcttcagcatcaaaagtttaacatttaggatggttatatgagatcttttcagatgttgaaagtataggtaatgtaagaaggatcatacttagcttgtttgaatagatgaaaaaattaaggccaatagttataaattataagaggagagaatttgactaagattagcagacatttaatatgattaatgctttccccccaaataaatgatttcttctgaggtaataagatcctttctttgaaaagacttatacagagaaaattgtattattggcaatatgggattcacgatgtcaatggcaattgttctatatgattattaaaatttgtttttaatacgagatttctatttttattagcaatatcttcagtattacccaagtgttattaacattaagtggtatgtcaattaaataaaattcacttgggctacattttgcttagaaacagtgcataatacagcaccaaccatttagccatatattgatcattttagccatgaaaatgtaggtccttatcaaaagcctacaaaaaattatcataaattataattaataagttttactaaatgtttaaatgcaatatttaacatactttttgaattgtctggatacgacataatgtttattttttattctcctggaagatagttttccattataaaataattctgtttttatgtatgaagccataaactgtagaaaacagtttatgcccttgaaattaaccttactggagagggtacaaatgtataatgggtttcttttgagattaagtttgtgacttaagaaacacagttgtgcaatatctgttgtgggttatagggaaacttcatggtcataaaataaagtaaataaagctataaagagtgtcacaaaggtagtaaacacatggctctagccttctttgctctgtggtctagcaaatattctaactaactatagcaagtaagattatatgatacataattccattgactaagcctctgattggagtatgcaaaaaatttacattctaatttcctagttatctaggtttctgcaaatgacatactatttaaaaacctggtagaaaggtctgtcttaaggttatacatcccatagctcttgataatattcagtttccaaattgaaataacttaattacattctccaaggatccattttcagagtaggtgcagctgttgcattttcttttttagaaagacaattataattacaggcaacttgcttaagaagatggaattaataatgcattacaattttagagaaacagtgagaatgaagtttggttcatgtaggaaagagatatgtgatgacagatcaacagaaagcaaggtggcgtgtgtgtgtgtgtgtgtgtgtgtctctgtgtgtgctttaagtcttattttggagactgcacatttaagataatattctacaaataatttcttaaagagtcatctagtgcttgctacatagaagctactgtcaaaaacaaggataatatttagcaataaagtcacaatttggcagaaaggttaagtgtaaattagaaatttcatgagagattcagagagacatgtacgcaatatacttggatcagtataggaggacaagactgtttcaaggatttaagacagtcttcgaagaggacatatatttcagctaaattttagagcaaagcctgtaattaattaggatgacaagactggggaacatagggactaaaattaggcaacatttccgaaggcgaatgctgtcaagaattgtgaaaggtcctatatatgcccattatgttaaactattgtcattaaaattttctatatttttactgaaaaaaaaaagaattgtgagaggtcacttttgtatcctacttatccactaacaagttaggctgctacattttcaaatattcaggagaaagcatgagacacattgtagtcagaaacacaggattttactaatcatggcacagcaagctggatgagcttcaagtttttattacattctcttatcccattttccacagggtgttatgaagaggaccaggttacacctacatgtgcagggggttgccttataggaaaccatgagttctagtgagcagtaagaattacttgttcattcctctagactgaatcactgtctctcttccccaaggatataaggaaacctactctttttatcaaagaatttacgaactccatatttcaaaactgtttgtaattttaaaaaatccttaaaaagatagtcggaaaaaaaagtcactgtattgacttaccaggtgtgcagaaacgagtcagctccatgaaaaagtgtctcccaatagaaaaaataaattgtaaaatctctaaaagatgaaatagtatgttgaatctcaaatagtatctcaaagagtattgcaaagaaatttcatatggataaatgtgcatgttctttggttcataaaaaggaaaattcgggagagatttcctgattataatgaatttgatatatttagtaatgcatttttttttctgaaggtttttttccttgggggtatgaataatgatttgaaatagatcagtaacaaagtcagacttagagttgtaagaatcattgttattgttgagtaaggatggagtgaatgtgtgcaagaatgccagcacagaagcttgaaaatttagtgttcgtgggtgatgataagaacaagaatcaattaagttgtacccaggttaaagaccaacagaatgatttaaatttgatttactgaaaagcctttgaaatttgctcatcagctagaagtaagacaggataaagaacatggagaaactgggcatgtcttgaaatttcctgattttaaatgaaatgaagagtataggaaaaggtggaattggatataaaaaatgattatttgagtacacacttactgaaagattaccaaaagggaaattgttggtagaagatatttagaattcaagcgagactgagaataactgttggaaattataattgatgctgtagtagtagatgagatcaaagaaaattagtgggcatccattcgtaatttaaaatatctaaacaaaacagatatagaagaaatttacctcagcaaaataaagaccatatatgaaagacccacagctaacatcataatcaatgggggaaatgaaaaaaacacagtgaacttttcctctaagatcttatacaaggatgcccactagcactactcctgtcccacaaagtactggaagtccttgacagagcaattagataaggaaaaaaaagaaaacatctaaataagaagaagtaaaattaatgctttagatgatatgattatatacatagaaaaccctaagttctcaccaaaattatctgttagaatgaaaaaacaaattcagtaaagttgcagaatacaaaatcaacatgcaaaaattagttacatttttatattgaaacaacaaaccatatgataaggaaatttttaaaaatctcctttacaatagcaataaaataataaaatatttaagaataaacttaaccaaggaggttaaatatttgtacactaaaattatgtttatgaaggacattaaagaagacacagataaatgaaaagatctcctgagttcatgaattgaaacagcaaatattttttaaatgcccataatacccaaagtgatctaaagattcaattcaaaccctattaaaatctaacaaattttattacagacatggaaaaaaattcataaaattgatatggatccctgaaagactccacttcaaagaattagtttgaaagcaatttgaacaagaagaacaaaactggaggcatcaagctttctaattgcaaaatatattacaaatatccagtaatcaaaataatataactaccataaaaacagacaatggaacagaatagatagacaagaaaatcaatttacaaatcatcattcaactgatctttgacaaggttgccaagaacacacaatggggaaagaaatatctcttcaacaagtgatataaaaaaatgtatctacacgaagaagaatgaaattggatccttatctcacaccatatgcaaatatcaactcaaaatgtattaaagacttacctctaagacctgaaaccataaaactactagaagaaaacatagagagcttcttgacttcgatatgtgcaatgatttttttggctatgacactgaaagcacaggcaaaaataaacaattgggactataccaaactgaagtttctgcacctcaaagagaataatcaataaaatgaaactccctgctgcagaacgaggagaaatatttcaagccatatgtctggcaaagggttactatccaaaatatataagaaactttcaaaactcagtagcaaaactaaaacaaaaacaaataagtgatttttttttaaatgggcaaaacgcttgaacagatatttcccaagtgaggacataccaatgatcaagaagtttaggaaaaggcactcgacatcactactcaccagggaaatgcaagtcaaaaccacaataagatatgacctcacatctgttagaatggctattagataaaggacaaaagattagtattggccaggatgtggacaaaaggggcattcttgtaagtgttggtggaaatgtaaattggtatgctctttatggtaaatagtatggaggttcctcaaaaaattgtaagtagaattactatatgatccagcaatctcacatctgagtgtatatccacaggaaataaaatgaaatgttaaagagatacctatactcccttgttcattgcatcactattcatgggtgaatctggagtacattatgctaagtgaaataagctagacacagaaagacaaatacagcatggtctcacttatatttggaatctaaactagttgaactcatagaagtacagggtagaatggtggttgccggggttcagaggtggaaaaaattgggagttgttggtcaaagagtacaaagtttcatttatgcaagatgaatatgttctggaaatctaatgttcagcatggtaatgatgactaacaatactgtactgtatattcactacaatttgctaagatgatagatcttaagtattttcaccccctccccccacacaaaagcagtgactatgtgagaaaaattctaccaggattatggcagacactattgatgtactacttaatgccaccaattttctcatcctttttactaacaaatgattttttagaggtggaatagtattcagttaaatatatttacctttaaacactcccatgcagcaacaatgaccatatgaaagagttatggcctgtggaatttatgtacaagtcactgattttgccctcttggagataaatttttaaaaagcatacgtggtagaaattcctttggctatttctcctccaccttctcccctacctttctgcctaaaaagtgctaaatgtggctagaagtgtaacaattatcttactgcaagaatgataatgaaagccatcatcatgcatcagtcagtcagggtctagggaatggagtgaaacaaattaactccagcatctcagtggcttagtaaacaaaggtgtgtttctcagttagacaaagtgagttgcagtgttggctcctctcttgggcaactgccttttaagtagtgacccaggcacctagactgttgctattttgtctgtgcagttacagaacatggcttctaagggaagcaggtggatacagcaagacagtcataaaggggcttttcactgccttaacttgaaagtggcatgtcttctacccgtactctgttgtcttgaactagttacatgaacctgcctaactgcaagagggcgagaaattgcagttttcaatgtgccctggaagggaaggagtattggaaagtaagaagtactcatgaaatctttcttctaaggcactttgagcaattataccatcccattactgcccacatctggacatcttgctatgtaagatcaataaatatctattcattagggccactgtaagtcagatttttgttcactgaattcaaacagaattctaacagttaaaaagtgtttaaattactttaaattatctatccaagtttacattcatggaatttaaaataaatagggtatttttagttataatcccatattactatataactataacactaatcagacagatagcaccagaatttagtgggcactgaaagagaagacatgttgttccaaacttgcagacagtggaacccagaaatttgctatgttctgctgtgtttgtttccttcactgtagaaggatttctatagaatggagtgggcatatatttatagtctaatctactaggcagcgttgtgtgtgccaagtttaaaatagcctattctatagtacaaaattaaagcccactttgaagcaaattagggaacttaataacatttgtgtggttttttttggcagggaggtaagaagttcatatatatcagaaaatcgtttgtcgtctctaatcctcctttttttttggtttgtttttgttcacttgaaaccttggttaagttgcttaactccctagtaactgtttccttacctgtttatccttatacagaattaaatagtgagactcacatcatagctgttaagatttgcagatgaatttgtctcgctagaattttttcatttcccagccataaaaccagcaagagcatcaacagtcaaatagaagaaaaaatagcaagaacatcaacagtgaaataaaagaaaaaaatagcaagaacatcaacacaaatagaagaaaaaatagcaagaacatcaacagtcaaatagaaaataaattatgctatttattaacaattgagaaagaccaggttgcttttaggtataatagggagcttttctggtacagaaggcttagttctggtcatctaataggacctcttaatttgtacttccgtagtgtaaaattgctgttgtggagaaggttgccagttgacatttctaaccaggtacacaaagatgattgttggcacagtcctaagggctaggtgtgtttaccacaaaagaatagataggaaagatatgaaaactggtttggagactttaaatcatagttactctgcccatcatagagaaatgttccaataaatggctctggatctgaccaatcacagcaacatttctcttgtgcaggagtctctaaaattagcatattaatgtccatctcattggaatataaggttacatgatgaaaagctcattatggtcccagtacgttttagctgttattattttccttattttcaattgtccaaatattttgctttttgacatttggctgtttgtcatcgagaattcacagtagtattcactaaatatgctttatgactaaagattattatactaaaaatgcacatgaaattattaacttcactcaaaagttggtattttatacagaactctttttatacagcatttttccacagaaacaaaatttcacatgaacagtttgttttaaaacattggaacacctcactgaacaataattaaagtaatgaaattttattcaaagtacctaagtcagtcccttgtagtcaattaggtgtccagagcagtgcaattatgtttcaaaccaccagggcacatttaaaccactgaagcagaatgttgccctggtgattttaggataatgctatgggagagttgctcagaccatttattatcttcaagttaaagagcgatattaactcattcataccctaagcacaccatgcattaaccactgctagcactcttttcttggtgctgaacttataagaaataaaaaacatatgagaagtatttttaatatattggaaaaaacaaaataagtcactatttttgagtgttactttctgctgtaaaattttccgtcaacttataaatattttagtgtccaatttgtctgaacctgtgctaagaatgcattcaattaaggcatacttgacatattaagttggtacaaaagttattgcagtttttgctattgtgttcaatggcaaaattgtaataatttttgcaccaacctaatatttcaagctttacactatataaattttagaacttcacaaagcttaaggactgaggcattcatgaatggatcctaaatatctatgctgcaatttcagtccattccgtactagtctgctctcagtaggattgataattatgaatagtctgaagacatttcatatgtctaagaagtttgtaatggaatcagtaatttttttgcttacactaacttcgattcttgcactgtagtatgtactgtattagtccattctcacattgctataaagaactgagactggacaatttacaaagaaaagaggaagtctggatcttagtagaatgtaagtataaaagggaatttaaaatttccatttcaccattttccatagcccttgttttcccaaggaaattttcagagaaaaagaagacaaaaaatattggaattctctttttcttcacttgtcatttcaaaagggagcaaatatcaatcttgaattaccaggaggctctaaaaatgattcttcaggttttagttcttaatattacttaatccaaattaggctgttttcttcctttagaaataaacaaaatggcatcattcccaccctactcctgatctaatgtattatggaatagcatattagacttacaaagcaatattttcttagtcccatcctatatgagaattttaaccaatgatatctgttttttttctagctctactttctctagagatagtccatgatgttagagaacttttgctaacagatctttttcttatactataaatttgctttgtaaattagagtcataaatgagaccagattctgatttatccccctttatgatatgcatgattgatatttgagaagcttgttttttcagatttatagcaggaatactagcccaaatgaggtatactgtatatttttctctgatgtattgagagctggaatctgggacacagttaatttaaaaggcagaaattaaaagccactgaaaagaattctcttatgctaactaaaattttcacttactgattggtgaaacaaatctttagaattattcatcatttagaggtagtcgatctaatcattctcatcatttgttttcttctctttctttttttttaactgaagtcctctacttccatacctcaccctctcctcttcatactccataacaaactacagatgaagcctccacctaatattcaaaaacactttttctctttgtgctctacgttagagttctaaagtcctcagaacaatatactgtacaaatttagacctattttatcattaataattaacctactaatctatagcacaatataccaaacaatttgtctcgcttttttgtcctttctttttctttcttttttttttttttctttttcttgggtctttgaccttgagacaagagcaagaataagggtttccaaacttttttattgtgcacacctctcagaaaaaaaaaaattgagcagagcatgcattgccatttgtttatttatcactgtataaagcattcatatttacatacccaatatggtatataatatggagcaatataataaataatataaaatataactgtaatgtatttgtatactgtagaacatacaccttcattaaaagataccaatactaatatatcatgtacattctacatgtgatataaaaactattgacttgaagttttgtgaacctaattaataacttcagctactaatgctgtgatgcccataaccttcactgacatcataatggagggtctgaaggaatgacatatgataaagaccagataattttttaaaacatgaggctgtttttgccaggcacggtggctcacgcctgtaatcccagcacttcgggagcacgaggcgggcggatcacgaagtcaggagatcgagaccatcttggctaacatggtgaaaccctgtctctactaaaaatacaaaaaaaattagccaggcgtggtggtgggcacctgtagtcccagctactcgggaggctgaggcaggagaatggcgtgaacccaggaggcggagctggcagtgaaccgagatcgcgccactgcactccatcctgggcgacagagcgagactccgtctgaaaaacaaacaaacaaacaaaaacatgaggctgttttattccccatgccttgcctcttatttggactttaatcatctgaaacagctttttcatgtacttataactttcatgtacttagaacttaaaatagcaaggtacgtcttctctaaactaatattttgttttgtatttttttgtcacaacctaaggctgaaatcaacaaacaatttattcagttacttatttattgcaaaataatataggttagtacaatccaagcaagcccaaagcactgtatttgatatacatttatacctaattagctcatttataactccagattaccaacaatattgtcaactatatagctgtatattttcactatttttgtagatacaacagaacaccacataatttaattgttccatgcatacttattaaaagtatcaattgtttttctttaaaagtattcaagctaaatttatcttggtgctaatctgtgacacatatttttgtcatattcagcaatcttttgtcaatataatggagttgattcaggatatcttctaggagatattttcagagacagaatggcttcagtgatgtactgctaagccctgtcttccaaaataaataaaagaaaagaaaagaaaaagccgtaatttgttatttgtggcatgtttaattttatgatcaaccaagctactaacctgctatcactgaacatggagttacaaagaaatgaacagaatcagctctctcaagctacctgttggctatagctcaccactgggtggccttatcttattctcctattaattatcctttactaatttcctcaatagcttagttttatcctgctgtattattttcgtttttgttaagagtgtcaaatacatttggagagtgaagtagatcttaaataaatgaattaatttaaaaagtccttttaaaaaaccccaagttttgcataatttatttatttttcttattgcctcatgatttgcttgctctgtgaacatgttaaataagttatatattaaacatagaaaagacaatatctctctctatatattttaatgaaatggacaaaatggggccaaatgggtacttactaattgtattcataaatacagttttaatttaatctgtgaattcaaggatttcttaaggttactacctaaggtgctcaacaatgtttgagaataaacacaaagcaaatggttcatgtaaaaccactgaaatgattttaaaatatactgattataataagcttctgtcattgtaactataataaatagtatagtttaagcaatgaattttaggcaagtttctgtcattgtaactataataaatagtatagtttaagcaatgaattttaggcgagtcctttaatatattattaaaggactattattaatatactaaaaggttttcctaaaattcattgcttagaccttactatttattatagtccttttaatatattaaaggaattttattgtattataaaacttaataatactgtatcacctattactatcatctatttgctgatattaaaaatatttgaattcattgtgaattatgatttgaaaatcataattctgatattacatttactgatatttattttgctttaaatatctgtaaacataacttacacctgaagtagataggatatcttcaatttgacaaactaaatagagttatgtttggtttgtaggcacatgtttccaacaaatagagaggtaaaaatgcagtaacatggatcagtagtttgcagactgatttattaagaacagcgggtaactaacaactaaactaacaagatggtatccctgaacagtgtgcttattttcaggtcagagttttaattttcaaaggaaatcaagtgtataagtagcatgcttgacatgaatcttgtcactatttcattagcaaattaaatataaatctgaaaatgcagtaattaaagtagatattaaagattgtgcatgctatttttagtataaaatgtagtatctgttttaaatcaatacagtttctaaataaatatccatgaagtgaggatacctttggataaataacttgacacagcaatgacaatattagttaaatagaaagtactatgaaagagagaaaaatgttctgttactgtaatgcaaacttaaaaggcatcaggtaacctgaattctaatctcaattctatcactgtgaatggtaaagttttgttttgctttttttttttactttttatttttctagctggatgctttaccagtaaaatgaaggaaaacttcaaatgtaaaatatttgtagggaatgtgattgaaacatttgaattttttttttctttctggaaacatttaaaaaatgtgtatgtaaacagtcaaaatatgatgcaaattaactcttacttataagttagcctttaacaaaactataatcagtaatcaatattatataataaagcataactccttttatatttacatatgtaagtcacctataaaagcggaaaatacttttgtgtattttcagattaattaaatgataatatatatatagctttgcaaaacaaatttccagaccataggttataccatacatactattaaatagcttaaataatggctcaatataatatgcagcttagaaagagacaatacaaatgtgtctggcttttcctcaacagttacacctagatttttgtcaaacaaaagggagcatttgaatataaagtaaatatgtaatattttaatgatatggttcatttgaccagccttttcattttcatgatacagggaagaattggaaataagcagtagtaataggcctattcaactgctttttaatacctactgcttcattacacatttatatattagtaattattgtagaaaccaacaatttcagttgtggaaataatcagacaaaatacaaggtgcttttcatcaatcctctatttaatcaaccaactggactaacaaatacgtttcatttctttgataaaatatactgaactgtttctatagtgcaataagctattttgtttagcagactaccacatatattgtctgaataattttgttccgagcagttcatattcatgcttatttagaatcaattgtatttagtacaaacttcttaggcttattgggatacttttagtgtgtatatatgtaacttgatgaaatgtcaataaataaacaatgaactttttttgtacaaaaaccaatttgaatgcttagagaaaacttaaggatgagttactaaaaatttgcctgaattaggtgtggacaagatatctttaaaaataggaagccattaatataaaataattaaaagtagaaaataatagaaaagtaatagaattaacaatagacaaattaagagttttcaaactaagattgcttaactggtgtctctaatttttactcaagttttttcaacttggaatgataagaaactatgtatcatgaattatgtacaaagaagacataatgaaataattacaattattagatgtttaaagaaaagttcttgagtctatatcataagattagtgaatgggctatgcatctacacatcttaagataaaatacaatatttaagttatgtatttattcctttacagaatttttgatatcctgctttaactttttttttattaacctatgatttgtatcccaacaacattaaataaaaatgcttctaccttaaaatatgcatataattctagggatataaattctagagttatagcaatcaagtatcaaaaatatatgggtacctaaaccatctgtaaatcaaaacagtttaatgacaaaagtctatttgaaatatgtgaacagtgaattccatgtataccttttactaatcaattcaaaaacacatgaaaacatcaggccattttgtttatttgtttttgttttctctcagcctcataatgcctttcctttactcagttattcaggccaggctcctagttcctcataggagcttaacttcctgactcacatatctactctgaattataattaaactcttggatgaatctagtattcatgtggacaataattcctctgaaaccctagtaaagtctatttgatactaaagctgatgttcttttcctatatagcagaaccctataatgtgtagctacaattttcagggactgcataccttccaaaacacaagagtgatgtgcatgcaattccaaacaacacaatagatcagagaaatatgggaccttaaaagatctgagaaggagtggaaagagataacagggttatggccccacagaaaagacaagaggtgggtatgttccagctgctctgagaagctaagaaggatgacaaaaaatctccagggggtttgtgagattagtaatctgacttatctcaatagagtgcagctacttaaagtcagatcacattgagaagataattgtatagaaaagaaatagagatgatatgtaaagactatttttcaagggtattattggtgttggcaattacaggtattgttattcttcttgatatagcagatggagacatttcatttaacatttcctaaacctcagctgatttgcgatgcagggtagagagttatgcttttctccaattttttaactgagttttggctggtgctgtgtagaaacatgcacagcttctgcaatatcttttgagacaacccctttgcttttttggctaccttttttaaagaaaatccaaatgcataatatgaacttaatattttttgtaaaatagagtatgtcttattaaatacatgaataccatagcttaaaagcaaaaattttaaataagcaacaaatataaaggagaagtattactatatttgtgtctatagttaattgtgttttgttgccagtgaagtaacctcaggtttatggtatatagttctaaggacccacagctcctcagttccacataaaccttgacattaaaacaaggccctacactattcacaatagcaaagacttggaaccaacccagatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagaggatagcattgggagatatacctaatgctagatgacacattagtgggtgcagcgcaccagcatggcacatgtatacatatgtaactaacctgcacaatgtgcacatgtaccctaaaacttagagtataataaaaaaaaaataaataaataaaaataaaacaaggccctaaagtcttcagtcctactgctaggttaattgcttctaattaatttgcatatcatattaaaagaaaaaaaattacccttgcctatatcttctgctaactctctggctgcttatttttcctcctgcagtttaaacggaaaattcccagggctgtttccaatgaacacccagaagcaaaagtagcagaaccttctctaaatctctgtcttcctttctttgttcccaatagatcaaactttcttagaaatagctgatatctttaaagtgattcatagttctgaaacttaagctaattagcaaatgacatctgcatcttacatacaaccataacctcagatctttttcaacatttaagccacttttcaaatttatgaagaaatatgtcaattttaaatatgttttaaatagtagtttccttttagttaataagtagtttgtgaaaatattagcatggaaaatttgtatctgattcatgtgccagcatttattgttctgcatcaaatgcagaacaatataaaagataggagggaaaatgagtggattgtaaactagggaagtaagatgcaacaatttcagggcagctgttatcaaggtactgtgaaaggatcattccaaatgaaggccaagggtaccagagacaaatcttttcttacttttccattttccaggtgctagattagtgtctcaaagcaccagtataataagctttgtttcatgcagtgatgggaatgtatgttttgggttatataatctaacttacacaaaataaaatcatccaaattgctttgagatgcctacagggatgaacatttgtatgcgtttttactgtcagtttctaaactgtttagatttttaaccatcacaaatgtctttggggaatcatgagtaggctttctgctatgtataataaaacattaatgttactttatgtaatttattgaataaatttgttaatttccagatggttatagtaccacttaccttttgccatgctagctatagtgtgatgtgttagctattaatcaagaataattatagttaatttgttgaagtctatattatctccagtatacttctttttactgtatttgattgtgtgggtttttttagtaggtggcattgaatattttaattaaaaactaactatagagtaaaaaataaaattttggctctttcagcactttaaaataagtgaagccataagaaaatgtggagtttacaggtatcgctagggaagcttcttctttagatttatgaaatagttttaattaaagtagaaacagtacctaagggaacatttaaaataaaaattgcaatataagtacccccatgttactttttcatcaacttagcatctttaagtgtattatttttattatgaatgtttctaatataaaaattggaatgctaatgaataaattgacttattccatgtcatgtatcaataccagacaaaactaaacttaagggctgtatttccaacatttttctgtactatcctacatcataggatattttcccttgttttgaaagtttattaaaaaaacccagcaaactcaataagttaggtaaaaagcaatacaaacataatattcaaactttatctaaagtatgcatattttatttaactttagctgggaatatttaaaatcaggtcatgttctacttcaacccacaatacttaatgtttcaaactggctaacccatgaaataaaatatataactaattaaaaacaataaaaagaaataaagttagattataattctcaaaagctttcttgatagggtaataaaatttatttgaaagaagctgtgtaccaactgatgtaaatattctatggaattttgatatttcaattaaaatatttccatataaacatattttcttattttatgaagaacagcatattcagttttaaaaatcctccctttcagatcattaaaatattccacttactaagtaaaaatagctaatttttctttagtgattctataatagattaaacaaaatgtttgcataatttctattttagtcttttatttaggacacgtattacaatgtagttcaataccatagttatctaccaaggtgagcacaattctattaatatttttttcatatcctacatatctattttcatatcctacatatctattcatctcattgcttctaaaattagtaattattttgaagccatctgatatataaaagtagaatagaatttttaaaaaagaaagcttttcattttatgtatagaatatgggagtgttggttcttgtcgtatgtaaatattttatatctatcaatattactaataacaaaattttcttatgattatttcaaatgaaatcattgagtgctaattttgaaatttgtgttctggataatggtgagtgataataatatggccaaaattataatttcataaatatttattatgagttgttctaaatttatgttctggtaaatttttggctctaatgagattcacactggtgtccaaagacccctgatagagatacattcttttgactgaaaaagaagagttaaattttcttttcttaaagataaattgatactaaacattcttttcaattacattttcagaagcttttctaaattagactctgtattcttccaaagttctaagatagattggtgaataatataagcaaggtctctggttgcatgactcttacattctaaggccagggcttctgaaattattgaaaaataaataagtaaaatagttccaaaaactgaaaacattatgagtgttaaaatggcatagtgaactgcagtagggagggcctattttgggttagacattgtagtacagccatttgaggaataagcttttgagtagataactgaaaaattagctatccaaagagccattttgaggaaaggcattccaagcttagcaaacagcatgtgcaaaggcctggtggtggcaaacagcttcccaaatttaaagattaagaaatgtcagtgtgactagaaaagtagtaaatgtaaaattacttcatgggaaaggagataagagagtaaacgaagaccagaatttccaggctatgtaaagcccaataaaaagtcaaaatttcattccaagtttgagaagttaagcatagcagtgacacataggttataaaaaatgctttggctattggctgaagaccaatttgtagagtgctcaatagaatcagaagagactatttccaggtctaggtgagaccatggggactttccgtatatgatagtaacaacaaagaaagtaaaacaaaatcagatgcattttggaagcagaagaggatttgcaaatggctggccttctgagagtgaagagaacagataattcaaagatgactcttgaatgttcaaccaattggtgtgtaatgctgccattccatgtgatattaaagaatagaagaaggatatgcttgtagagaaaacatcaaaagttccagtttggacatactgagtttgagatacatattagaaacccaggtgaaaatgttaagtagataatttgaatatattgtttagcaatgaaaacacttaaacatcaccatcagaaacttgctttatctctgctttggtatgctgctgtatgataactaggatggtgcatcagtttctgctgtcattgaaagttttctttctaacactggcattcagtagttgcaggatgggttcatactacatgggtgttccacacttatggttcctgctgcttaagtgttttcgtgtagacagtgtttcctctgctctgttcaagcactcaagcactgtttcctctgttctggatttaagacacaagaaatcatcagagtgggggtgcatcctttctgatgtccaaaagagttatcatcattataatgtttggtgatatttttcctcttaatcatctggatacactctaccaggacaacactaccttatcctctttcaggatcttgggaatctcatgggtcctttctgtgtcctgctgccctctcatcttatcctcttcacccaactgtcacagtttttatgccagcttctcatataagaccttctgcggtttgcaagcctttgcctggtacttgagaaggttcatcttcaaactttaagagcaatttttacagtacctcaacttgataaataacaatgccaaatgccttgcctctactatggagaagtaaggatctcagaagagatatactcaagaaactctgctatccctgaaaaatcaaccaatcttcctttataacccttcttctcttgaacttaaaacttaaagaatgttatgctcatccttctaatattttctgtttttgcagtaaaccagaatgtagaaaatgattttaacatacaattcacatcataattttatacaagtctgaagctcaagggaaaatttaggattacagttatagacatgagagtcagcagaatatggatgatatttaaagcttggggacttgttgagatcacttgggtaaaaagtgcacactcagaaaagaaggtctcctatgactaagtctcaggacaatggactcaaacactttataataggaggagttatcaaattttgtgaaaaatgagagtttaatagtacagaaggaaatccaaacagtgcagaatgatgagaacctatgaaatacttctcaaggccgggcgcggtggcttaacgtctgtaatcccagctactcaggaggctgaggaagagaattgcttgaacgcaggaggtggaggttgcagtgagtcgagatcacgccactgcactccagcctgggcgacagagtgagactttttggtggaagaaagagttgtagcagatgataatacagtgttgaataaaacatacattacaatggttggtgttacagataataaactaactgaaatataaaatatgctatgtagtgaataagattatgaaggaaaataaagtagggaaaggggacgatctatctaggtagtagataacatttcaaatgttagataacattttaaatgtagcagtcagggaggttcttacagaataggttatgtaagaaaagtgagaacgagagacctatacagacatctagggcacagtgttccagaatagagagaagctcttaccaaagagccttgtaatccactagagacatttaagtaaagtggagtggatgaaagcccatgaggaatggattaaagaaaaaaatgttagacaaggaaatgaagacagcgtgtacagaaagttttttccaggagtatcactttaaagggaagcaagaaatgggcagttgctggaggaaaacataaagttgggatttcttaaaagatgagggagattagaacatattttaatattgttttgaatgattcaggagaaaactagtgggaatgattgaaggagcaaatgatagacaaacaaataggaaatttgtcttgataagaatatgggcaatttttcaattgctacagaacacaaagaaaataataaagatacatataagagtggatggtagatttcctggtagaaatatgatatcttcatgggattgttttcattttcttaaaaaaatgtattgaagaattggtacatatattcatgagaaaaacacgtatctcccagtagttttgagtgtcgacgtacttgtagtcatgagtctgaagtaagaaaattaagcaataatgttattttctctcaaaatgtttagttatgagagtctaggtatggagtagacaacaattttgttgtgaataaaattagatatttttctgaatagaaggaaaatgggaaaagagaaataataattttgagaaagtaattatgtaattgggccacgaactctaagccagattaaaaaagagagaatttaagagatgtgagtaatacaaaatgtcataacaagagtgaactaaagttttccatatagttctagggtagtttggtaagaaatcaatttgaagaactaggccagggctgaatcagaggcatggcagaccaccattaagatgttgaactgagtcatagaaaaggatacatagatacacagttttgctggagaaaataacatgtcatgctgattgctctcacctcaaatttaaggccgtgggattctaaatttatataattaataattccacttactcttctttattctgaagaaaccattgcatgtatgcttaagctgatatacataaataaaaccagatacattagttccatgaaatgatacatagcagcaaatactacacacactgatgtataaagttctacaatatgtatagtaaaggagacacattataggacagtgcatatagtaatagcccatttatacaaacttctttaaaaatttgtgaaaattataattcaattttcacttgtatatgtataagtaagttcataagtatattaaatatacataaaattaatagtaatgattacttctagaagtggtataggaaagtttgtgatctcatggatcaaaggtcagcaagtcaataaggatattaggtatttaactccacatgcacatataattatttatatatgtttataaaaacatgaatatattcctacttaaattatataattttaaccagtacaaagctaaaattagaaaaagtttaagaatacaatattcctacttaaattatataattttaaccagtacaaagctaaaattagaaaaagtttaagaatacaatccagtgctggctaccagatggatgttggtaggctttctgtagctaggaagaacaaaagcataattatggaaggacaaagggagatatgcccatattttgctttgatgttctttttttatttcttttttcctgagaaggacttgttaaacatcctatgttactggagttggtgtgttgggttggtagtgagggagaaggggaagcctatttgttggcattagtcattgacttgattgaaaaaaatacaggctgttttattgatacattatcagaagtgctactaaatgtaaaagttaatttgaaatgagcttaagcacaaataatgttatttagcaagtcattcaattgattcctgaaacttataaggaggagaatgttgaattcacatcagatttttctattatatccatgtataataatattttattgtaaaatccacatgctctaatacctctcttagttatgcagtaacacaagtgtgaaacaacagaggtcactattatctttttaagagatggggtctctgttatccaggctgcagtgcagtagtatgataacagctcactttaaccttgaactgggtcaagcaaacctactgcctcagcctcccaagtagcttggactataggcatgcgttagctatcatgaccagctaatttttaaatttttagagacagagagtcttgctacgttgtccaggctggtctcgaatgcctggcctcaaacgtttactcccacctttgcctaccgaagtgctgggccatgacacctggcatgagccaccacacttggactattatcttgattaataactttttaatttttcttattagatggtaagcatatttgcagaattgctttttaaaaaaattgaattcaaatcccgttgaatgtatcctttacttacagatacctaattccccttttcccatagaagatgtaagtttttaaggttgaaaggctagaggaaaatctcatttacatactccaaaagaaaatgttacccttaatttaacttggacagctaaaatattttcacacttctcctttggtcagaattttaatgtaataaagattcacagatacatctaattcccatttattgatgaggaaaagccaatacttaaaaacccaaggacaacctatttttacatctttacttggttacttattaaatatgtaactacatgtattgtaaagttagtgtttattaatgtttactacaagttaggtgcatgaaaatattttcaaagtcaaaatatccaaatcctactaataggaaacaaaaaattaaacaagtaccagaaacagatctccaaatgtattataatgtaaaaagtgaaggtaagttttgagtgaagtcttgaaaacatttcctcttttcatagtttgttattgacatatcatcttgtcacatttgctcttttccttgatagaaaaaagtgatgacttttcattgaaggttaggtgttgacatttaatgcaattcagcatacatttactgagcgcctgttatgtcctcatgctgtaagcaatgtgatgaatttcaaatgaagacctgaccttcagaaaattataatacagttgggtgaccaaagtgatcagtagtgtctttatcacaaatgtagcatttttgctgtagttaacatattagaccttaaaacaattcaaatatgtatttacattgtaggtggtcaacaaatatctgtttgtatattctaagtgtaatcctttagtgtgtgaagtttgagtaactgaaacaaattcaaagagagtaaaatttagaaatttgcaaatagagctttaacggtaaaaaacaatttattaaacataaaaatctgtagtttttctatagaagaccattattgttgtcagaatggagatacttgaaatgtatatataatttgacaaatacccaaagtattaattttggagatatcagcaagtttagttaaaaaaaataaccctcatttggcaattataatggacaatcatttatctatccagactatgtgttgttctcactggaagcagtaggtggaatgaaataactcttagaatagccttccaggctaatgtaaccaacagcgtattttttcattgtaggacagaaatacagcatttatttagtaaagtgtcaacttcaaaagaattaccacattttcagtatattgtggaaaaattgttagagtatttttttcacttttaatgttgaatcttcgctaaattgttgaaataaaattggaagatgacaatttggaaataattccttcacaacacaccctttctcacttcccttctcccaccaaatgttatgtcactgttgctagatctggaaacttcatccttgcagaattttaaattgctgtaaaatgggaatatataattctaccctcaaattatgtagttgaaagaataggtaatcatggatctatatataaagtattttgatttgtatatgaggtttggattggctcatatgcttaatatttatatttaaagtgacttcacatatatttattttaacaattgccagttagacaacaacaatcagagagcagtctcttctgggcataagtcatgaagctaaaaccactctttcagattctctatgcttaaaatgaatgggtagatacgtacaaatatatatttttaaaatgttttttctttaattttctgtactattctgtaaagcttgatataaacttattcttgttttgacatgtgtgatctttatatcattggaatagttggcaaattccttaatgccattttcttatttaagatgtggtagtctttttgtttctgatacattgcttctgaactctgttggcaagcttataaatcagatcaccaatcatccataatttatttctgtaggtaattgaatgtgctctgtgtagaatacaaatgtttttaacaatatatctgagcatcttaaatgtgataggtttaaaagtttacagaataaatcaattttttctttctctcattgttttattcctttttatttcatgaattttatatatatgtatatacacccacacatatacatacacatatatgttacaatatatgcagtcatggaaactagatatatacattactcagatctatgccttctaagaaatataaaactttttttaactttagaaatcatatgtttaaatatctattttaaatttttaaatttatgttaaaattgaggataattttctaaatgaagcaacaatgtttttatttccgctaaagagaactgattgtacctacttgcttaaaagtaaatcttctcatgggaatgtcattttggccattgagagatttttgtaaaatgatgagatgtgctgtaatgttggacacaccataagacacattctgcaatgtgaaatgttgtcagccttctgaatcatatatcctattatatatcatatggatatggatagcatacacccatgtaatccctgaaaatattctctttatcaatatttatatgaattataaacagaaaataaatatttcaaattgcttctcctttttacattcctttctaagatcatttttaatacgtgctaccatcagatcttgcttatttaaaaagcttccatacaattgaaaatgtcaacataaaggcacaacaagtcaatgtaccatagaatatagtttgcccttttgtttctgagatcttcatatttattgatctgcttttttgtgtgtgtctgctgtgattttatgtttcctattcttaaaaaataatcgttcttgtcagttgatctgtcaacattatgttaaagccaattctgtattgaaaagtagacagttcattattaatattagcaccactgacttgcattttagaagccctgagcacttttttttttttttcctactagaacagagaaaatcaaagagtgcaacttagtagtcaggaatgtctaggatatgggcccctgggcactttgtttgctgccctcaggtgtccttgaaacttttggagtgttcagagtataaaagctggaaggcatatgacttctctcctctctctttttgagacagattttcgctctgtcacctaggctggagtgcagtggcgtgatcttggctcactgcaacctctgcctcccaggttcaagtgattctcctgcctcaccctcctaagtagctgggattacaggcacccaccaccatacctgccttatttttgtagttttactagagatggggtttcactatgttgaccacgctggtcttgaactcttgacctcaagtgatctgcttgcctcggcctcccaaagtgctgggattataggccggcctgaagtcatttgacttctataagagacttataaaacacaaaatgctgtatactcactggttctaagagtagaattcaaaagtttggatagagaaaatattcagacttgtagggttttcagatcattaatgtaactgagtttgcttattcacataaatttagtttactgacagaaagtgaaaaatgaaggtagacacaggacaagggaaaagaacactgacaaatctaccatggttcttatttttctgctgtcatcttaatactgtatcacaaggataatgtaggtccaatgagcctacctgacacgcaaaatcattatgcagagtaaatgcaatcatgtttaataaaatattatataaaagtttaagaagtatgtaattattcaaatgtaatctttcttttttaatctagagtattctttcagaaaaatgttgcttcatgtcataaaatactgctttataaagactttaatataactgacaaaagcatgaattctgtggattgttaaaaaagtatccatagaaaagctgtttgtattcactttattgccactgatttttccgagtaagaattgaagtttggctgggcgcggtggctcacgcctgtaatcccagcactttgggaggccgaggcgggcggatcacatggtcaggagatggagaccagcctggataacacggtgaaaccccgtctctactaaaaatacaaacaaattagctgggcgtgttagtgggcgcctgtaatcccagctactccgaaagctgaggcaggagaatggcgtgaacctaggaggcggagcttgcagtgagccgagatcgcgccactgcactccagcctgggcgacagagcgagactcggtctcggtctcaaaaaaaaaaaaaaaaaaaaagaattgaagttacatcaaactatctaacagtacatggtcccacattggctattatttcagagttgctttatttccttaggaagtctgtctttcctctttggtacgctaggtaagcatacatataaaacaagataaaactttataagatacagacctaatttcaaagaagttacagtagtattctgaaacaatattgtgttagttacggattctttaatatttgattatgcttgccactgtgacacacacccagacctatcctgattatttatagaatcaaatgcacaccactaagcaatgtaattagtaataatttgttccattattctgcaactgtctggagccatacatttaagcattcacaaattctcaagaaaaatgtcataattcctgaaatgactacaaataatttaaaaattctaggatacttattttgattatcacaagatacttgcatctttctttttgtaaaaagtttccaattaagacaatttggtgaacataaaactgggatttaattgttcaacatttttggctttttattctggtaaattcaaaaatagaggaagaaatcctgattgttcagttaatttttgacaagatttaacaaataatatactgtctatgtggttgactttggataactgaaaccaaatagcacttttgttttggacttccataaaaacaaatgaaatattagaattagtttattccaaaatgtttattagtcacattctctgtgccagaaccgttctatattttgaggttgcatcagtgaacaaaacagaaaatcccttcctcacgaggcttacattttaagtaagagatagacaagaaatataagtgaagaaatggtaattaaatatatttacggtaactattagaaagtggtaagtgttaatggggaaacaacaggatgggataaaggagacaggcatccatcggggctcagctccctgagtgcatgtccagcctccctcagaccactcagaacttcctcttcttccgtggaggccaggcttttgctctgcactttctgcagaactccatcaacctgatggtgtataccctggccttggccaacttagatagtcgcctcatctctgagctcaaaagctagatagaacagagacgcagaataaactcttcctggcacagcctgctctcccaggacctgcttagcatcatgtccctcttttggagaccagatctgcccctagaccttttgtgagagaaggttacatcgtctgtaaagtgtgagaactggagaagtctccatgtccttccagccctgggattcagaaatttccagggccgctcagaccctcgcccctccaagtccctgactcccttatgaatcttgtccttgtatcaataaaaacagcagaggctgtggagagctctttgacgccggcctcctcaagccgggggcaggacttcagcagtgcataagccaatctcatgtctgatataggttgttggtggagaagaatcgtccaggagaggccttgacagtaggggcagccaatcgacgctgcatccagcagcgctgggggcggggcctcttgtgactgactcggaatgagggagttttgcgttcctctcaggcccgcggacttcagaactctcagagggagacacctgggtggctgctcttgtggagaaagactcagggcacaaataaggcgtttttttattttgttttgttattgttgtttgttcaaataaggctttttttgttttgttttgttgttgttgtttgtttctttcttttttaaaactccgcaagagggttttagggcttttcctttccccgtggctgttgttccctgtggggtaggggcctttccctcacacacctggggtcgcacctcgtgtggttggcgtcagcctgactgagacagtcgtatcccagcagaggtctgaaggaggccgctgactgggcaatgagaatagtggaagcgcttgccaggctgagggtacttcccgatagaccacatgagctgaggatccagagtttctttttctggaattacttcaataaaaggtttgtttgtttgtaaaacatttaaaagtaaatcgattcagtcatttaaaggcaggcaaaagtaaaaagggtcgtttacaaatttcccagatattttggtctaaaagaaaattctgtgaaaaaaatatatacaacttgtcttatgaaaagaattattgctagggcttacaggaaaaaaacttagtatttagaatttgtactcttccgtctaatattaaaaacaacaacaacaactgaaagtaaaatgatgtgccgagtttcgtgctggtgaggcacaagtgtaagttgaattttagcctgagaagaaacatggaaatagttacaatttttcatattagcagaggtgtgtgctgtctgaaccacactccagttcccagtgttcagttcaggtgctagaagaagtcttcatggtatagcatatgaatttttaagattggtagatttataattgctttgtttattacttgctttggctttattttttttgtttgaattagaggaacgggatcaatgattttaatttagaaaccatagactagagtaaaattagaatttagtggcatatagaccagctgcttttacatatttaaaggcatatatttagaagaagagttagatgtattccaaataaccccaaagtttgtgttaggacaaaaagacaataacgtgagacgttttggttgaaacgaataaaattctttaaaatggtacaattatggaaagggtggtgtcaggaatgattgagtaaccaatatatgcaggtatgcctttagaaaactagtagggcattcaaaaaagcattgcaaggcgattgttcttggtatcataagcagtttttttgttgttgtttgttttgttttgtttagccccttcatttaaccaagatttaaagagtgtatggatactggactttttttctctacccttaaggaataatagtaatacatgtagacaaatatttatgggatttttagatcgttgcacataaaatagaggcaatataaagtgttgtgggatcaagatgaaacacacatttcacagaaaagtgaaaaagtgacatttgagctgaatatttaaggataagtagtagtttgtcaagtcagttgggcaagtcctcaaaatatataatcaaaattattacaacagcatcctaactagtttcacactctccagacaagattttctatactttatcttttcagacaaaagaaataacagcataaacaaaattacagaacaataaaatgcaaaggatatttggggagaaactggagaaaatgaaataggttaaaaaaggatgagatggtgtaaattagtggtttttaaactttggtaacatgtgggccacatttatgttgatatattcacagttatattccagttccaaaaaactagtactaattacagcattttctttgttattcaataaggcatataagaatccactaaattttaaggaaatgactaaatttttggcattttacttatttgtagtgaaaagatactttatagaatattgtatgattatatctgctctgtgtctctcaagagttgggctgtgaatcagtctaggctgggcatagtgttagggtcaaaatcagaaaaaaatgtttaacaatctttatctattcattcaacagaatttattgaatgactactacctattatggactgttctagacactgaagacagtaacattcctttagaggaagtaaattcctattaaaaattgaaattgaaaaagtgaaggaaaacaaaatttgctatttcatatttcttactcttaataggatgttctgttctgtcttgtgcttgtaaaacttccaactatcctccaaagtcagagtatcataatactttgaaatatcaatctcagatattaattatcctcatttcttcatcttttcaagaagaatttagtgatggaaacactcttgttatcttcgtatgttttagtgtctggtctataacactggacaaattttattgatttataaaaccattgacctatatgaaaagaatttaaggtagggctgagtgaattcatataattataggattctacttatcttttaacttttaaatttctgctttttaaaatcctaggatatgtgatggaatgggtttctttcttgagatttctcatgtatgtgcttataaaatcatatttgtctaattttatatcacagctttattctcaaagagttcttcatttttttttccaaaattaagcctagaacaatgatttccttttaggaagaagttgcttcttctaaattattagatacaaaattactaactaaacatggttgtacttgatcatatattttgtttttatgggttcagactttcactatattcttattcttgctttagctcacaatttgaaatctaagttacaaagaaacatatttagcaaaacatttttcaagaataattcagtcagtcaaaggctttaaaacagtgtggatgaaatagggaagggggaatataattttctactctaaattttcttacatattgtaaaaaatgttttgatcacaggatactgaggatactgagctctgaagttgggtggttaacacagcttggacaacttctggaaacattttcctgttaaaatgatgctgacttaagtctctaaaaatctggcataataaaatacataagaggagataacagaagacattctacaaaaagaataaaacctgtgtaaaggcttagttatgatacagtacatgtcttcataaaagtgcaagatttcgtagcaagaacaaggcaaggagggagaagaattgagaagtgatgattaagacataaatataagttagatcttgcagaccctgcatgtttgtatttaagggtgacctattatgtatgtgtttgagtaccactgattttaagattcgtgtgacaacttaacaagttttagaaagaatactatatttgcaacacataaggtgcatagaatattttttagagacacgaaactagttaggatgctattataataattttgtttatatatgttgaggatctggtctaagtcctgattgttcagaagaagaatatttaggaagtaggagtaaataataattgatgataacttggaactaggtggaaatgcagattgctggattgaagaacaacgtggaggttggcttccttccatgcagttagaggccaggttaaaagcagcacatttaaggtttatctggctgggtgatctattatattttccttcagttgtattatttccatttccttcttttatatgcaaccaaagttcccggctcccctcatattcctatatttctgttcgaaagtacacttggtatttaacactagaagttctgatttaaataaataaaatttgaaattggaagagttttaattttgaaaggaaaagacacataaatctagggaatccagaagaattatgtaaataatacttaaaattgagaagagacatcaagaaactgagcataagataaatacacaaaatacattagaaaaattataacgttagattatattataatgctaaaatatacctctgcaaaatgtcaaataaagagttttcctaaaagaaaatgtgcaggtactgtaaagaaaactatttaacttcactgagagatattaaagaagacagagataactgcaaagacatagtattaatcttatacttttgctgtctatctggtatctgttctcattggtgagtctattctaattaatttgtgattctactatactagtttttttactgtttctaaccatgatcgctgctgttaattctttcaaaacgagtgcaatataaccccagtgacaagctcaaagttctttttcagcaactcaacaagtttgaaaacaaatgcaggtggacataaaaatttacaaaaacatacaaaatgaagctagtgtttcatgacatgaatgtagaaatacaaagagatatgatcatttaaaaatgttgtagatacatattaaaattgaggaaatcagtacaacaaagcattaattctagtatgttttagaacatagtttagatgaggtaggaatttccataagcaaatggagaatagagtatttcaaatggtactgagaaaactgacagctgcataggaaaaaatcaatcaatatctcatctcctactttgaagcaaaatatatctcagactgattaaaaattttaatgtataaaacagaagcaaaagtatatcgtaggaggtacacaatgaagattcatttaatttctgaatagaaaaaggctttctaagcataaatgcaatttggaaaatcacaatgaaacaatacagacataacaatttttttcatgaaaaaagtttaaaaaggaagacaataaagtggggaaaaataaaaaagtttaatatccttagtgtaaacataactcataccagttgataataaaaatgatatacttcaaaattaggctattccaaatccctttagattggaactgatggtgagcaaaaacctcccaaggctcctccaagtggtctttaactgattttctaaaagtttcagatctaagtgacagtcctgtatcacttagcaaggacaaggtagggagaaattgaggaattttcccccaatgtgagggcagcacaatgacatcccaaggcgagggtggatgagaagtgagagtggaattctaacatttctcttcctatttttattcttccacaccaaagcctgacttccccacccctaatgtacagaggggtacaaggtaggacccacacattccattgttggagaaaatttctcaaaacttcccttcccccccaccccccccttttttttttttaagacggagtctcactctcttacccaggctggcgtgcagtgtcgcgatctcggctcaccgcaacctctgcttccctggttcaattaattcccctgcctcagcctcccaagtacctgggattacaggtgcacaccaccacgtgtggccaatttttttgtatttttagtagagaccgggtttcactatgttgaccagactggtctcgaaatcctgacctcaggcaagctgcccaactcagcttcccaaagtgctgggattacaggtgtgagccaccgcttctggccccaccttttgtctttatagtgcctctggagtaaaccttggtgtgtggggggaatccagaagcggagcaagttattggtcttctatttatgctcactgtcttagtgcatatctagaaatgttactgtaaacaccatatgtatatactggtgactcctttagccacctgtgtatttgatatcaatacttggacttctaagcactgtaaacttaacatctccaacactgagctttcactgtttctcccagatttcaacatctgatggtgctctccacctaatcaaggattctccatctctccaattgcttagaccaagaatttagagtcatttttgactctttcctttctcacaaactccgttggctctcagcaaaattaagtcagaaagcaacctctctattgacctccattgccatcaattctattcccagaacatatcagcaactatcacttggttattcaagtaacttccacctgtccctgccctaaccctactctgttcaacacatcagctcagtttttatcagatgcaaatcagacatgatattcctctactaaaatgttccaatggctttctccttatggaagactataatcacaagactgtgcaataaccctgcaaggtcatattatacctggcccattgctatctttccaacagcattcctaaccactgtctttcttggacactccactcgagttacagagtcctgctcaagattccatgcatatatatgatatatctcatataactacatggcttacgtcttcacttccttcataactctgctaataggaccattatcagacaggtctttctcagacctctaaccatatatctctctgtaccacccacaccacttagtttcatttgtagagcttatcactacctggcatgctgtgtacttactacttcatgtttattttttccctctccaacaagaatgcaggttctttgaggatgatatctttgtctgttgttttgactcctagaagggtacccaacatatataaagtgctcaattaacttttgtaagagagtgttgagtgaaaaaataattcttgaataaattaaaaggaaggtactataatattgtatttgatggttttcattttggagtacgggcatatgtgtttttcttttattaaaatttttgttgccaactatctggccaattctgtactgtcctgtttttcatttaaatagtcctgatacaatttttgttcttccttctttctttaagtttttactactccttactctcacaatccgtatgtgccacttatgtgcttttatttttttcttctctttctaaaagacaaaacacaaataaatgtgtgtggaggccatgagaactatagttagtgtgattagtatcctggaggggacaatcccataattaatgttttatataaataaatgcctgattatttgtgcatatgtatgcaagggtgtatgtaaattgtgtctgttgtgaatatatcttcataagctaattgtataccacaatttaaatttcttataaaagtgaagtaagcaacccatttaattaagggtcttcctgttcaacattgtttatctgaaagtaggttatatagcatttaaaattaaaaatacaaatatgtataagattctaaccatagatataaatacttatgtttaaatgtataaacatattttatctttaattcaaactggtaggaaaaaatgcaaatacaacatggttaatttttttttactatggtagctgttcagtgaacattactcattcaaataaatttatagagttatataccatggattttgtactacaatatttattcagtaaacgtgtaattcaaaggatttcatagaacactataccataaaaatcagctttaaaatacattttatttttaaaaatacatttagagaaccctcaagggacaaaaattatatctgggctgaaatatggtacagagactcattccccatttgtcatgttaatagttattagccttaaaattggataaaaagataaaatggcatgaagtaaaatgaaacatccccaaagaaaaagcattcattttctgactataaccgttacaaatactataagtttggagacctgtttgtatgggaaatccagaggcaaatgcatgttgggagggagggattttatattatggtctttcttccctaagttgtttttcctgtaagggctcccagtaaggaattcctttcctttcctttcatgacagtgaaactatacaggtacttttgctggacacttcctggagctgccagaaagcacacactcaacttgtcacaatattttcccctcactgagagtataaaagaagatgggagaatttgctaggccatgtaccccttgattcctcagtccctttactctcttctacttcattatacaataatttccatttttgctgtaatcttgctaaattctattctgtgatgtctcctcactagcatgaaaaagctgactctgtatctgttttattcattaatatgctttcagaaagagtacttggcatatagaaaacatttgacaattattcaatgaatggtttcttagcttaagaaaaaaatacctcaatataagcacgatttatttttttgtgatgatttttatgttatctttatgactgtgtctaactgtaaatgttctattacatatatgttttatattccaactacagtttttttctactgttactagacagtctttcatctttgatatctttaaataagtaatacgtatgttgactgacacctgtgtaactcattctctgttcctgcccttttgccccagtctattttctgcctaattgtctgcagaccctgttgccctctggcttccttttggtttgagccattgagtggaactgatgttttccctatgacagtcccagccaccagctgtcattctgcacgggtgtttccattattttccaaatggaaatacatgacccttggtgccaccccattccattttgattccttttccacaactccatataaataacccctttattatattatcttcaaaattattcctgaatgtgcttacagatttgactggagaattaagaaaatatgaaattcagtttctgttttgtttttttttgttttgcctttgcataataaatccattgtctgatccttgcctaatgtcctaaaacaaatttaatttgagatcttggagtttggggtttgatagatattgatgcatagtgaaaattaaaaacagcaaaaaagctaattatagtcatatctctaaaagaataccaatacatttgtcattttttcaaataaaattgtaactacatcataaaattgtcaatgtagtacaacatactgggatttgaggtatcttgcttgtaaaatagaccagattttgcttgtagattgttagaaaaatcaatgaaatgaatacaggaaaataaaaagataaataatgtagaaaataacatctctcctatcagacattcttttgagaggtatcagtcttgagaatgacataaatagaaaacaaatgcataatatatacatttttaaaaatatattggaaataaattaaagtaatgaaattgaagaccacagatattattagtgatttcaagctttttcaactactttcaggcttatatgaacataagattagtacttaaactgccagattatcagataaataaaataaatgttaatatatacctgattatgtcactacaaattgtaatgctcccttctcttagaataactggaatacaaatcatgttggttttcttatcaataaaatagcaatatttgcaatatacatctgtttcacagccacataccatgaaaaatttctacttcattgcatagtgcatgggtattcctttctggaattaaataaaaaatgcacctgaaactgtatgcagtccatagcaaatagctctctgtaaatactgtgtcttattattactaatatcaacctgcaaaatatatgcatagttcacatgctaaaatgtctccttaaatatttttggtaaagactttatgtaaagaagtgagaaaacgagggaatttttgaaagttctaacatcctccataaatcaggattaataaattttgcaggttaactattcacttatttacccagaaatatgcagacctaatgtgaaatagagataaactacagaagaagagtaatatttgtttaaataaacagttttacaaaaggttttgctttatatgtttttctttgtttctttgattttcagagggagaaagagggaatgggcagtacagtgggattgaattgcaccttttctagatttagcagccacatcctttctgcacatgttgctctgtaattatctttaaaattttacacattctccttataaaataaggtaattatatgtggtatttggagaaacagatcagtggtgctcttgaataggtaattgaagacacacatgtctactgttgagtaaacctgaagctgttacatttctattcctaggaatataggaataaaagttttatttagtgatgaaggtaaagatatttaaaatccaattttaaattcataagtattcatatattgtgcttagaataagaaaaatgatggaaaagttaggcattacactttccagggatcaccttgaatagacgcactgatcatttatttcatgttcaacatttaccatgttctttaattgcaataaccctcaaaattgtgaatgagaaaatgtgaagactagatccaacatagatattaattttatttagttagtccaatgaaaacaataaataaaattattaatctcaagtagataaagtaagtagctagctcatttataattagtttttcttttaaaacattggctttctaaaccagtctcgtgggtattgtatcagttcaagaggcctaaagaaaatttgttataagcaatagtttatttatgggaatggaatgtattgagaatgcaattatgggcaaataatgaatgcatttccttactgtgcaaggaaaagcaatttagaatatttatagtttgcatgtacatttctatatgtactaataatagttgaggtttatttcctctaaccatagggaagatgatcttttccagaaaacttcaaatacctctgatccttttatttcagtgaataaatttctttttctccaattttatgcctctaagcacagtaacattttgttaatgttattgactggcaagccaaaaacatcttaaaattatttttttcttagatgtattgatgtatattttatttacagtaaatttcattcttatgcataaaacattatgtattttgacaaacatatacaatcatatagctgcaataaagatattaaatatttacctcatgccaaaaagttgcttcatggccctttgtagttacttccttctcattacctccagccctcagcaactactgttctgatttccatttgtatagtcttgtctttgttcagaatgtcattaaatcatatagtatgcatccatacagtatacagtatatggatctttcacttataatccttttgagattcatctatgttcttgaatgtacataaacttgtttataatactgccttattactgaaatatctacatcatctaatgataatccattttcattcctgacaaagtttgtattcctccctatctttctttatttgatcagtctaggaaagcatttattgattttattgattttttcaaagaacaaggatttagaatttttttctctttttctcctttcaatttcattgctttgagctcttgtcattatcattcctttactcctgcatagattgttttcttttttctctcttcttaaaatggaagcttaggcaattctaactcaatagtgtaatactctataaaagtttttctatgtgctgttaatgttctggttgttgattgttaaaatctctaactgtagttgtagacttgtctattccttcagtagtatcagtttctgcttcatgttaatatacatgaatatggttagatagttaaaatttattgatgaatttattttctataattatgtaatattctacctctggtagtattcttcattgagtggtctgttttgtatagcattagtttaaccattctttatttgatttgattaatatttgcatggtatattctctatttttactaataatccattatgtatttctgacacctttgctgagatataatttacatatgttgacattagcccatttatagtgtaagtcaaagggtatttattatattcagtgttctgaaacactctctactaattttaaaagtttttcttcactcctagcagaaaacatacactcactagcagtaactccccatctccaccaccaacagcaggagcactggacaattactaatctactttctttattgttgcctttattgttgcctattctgattgttctatataaatagaatcatataatgtatgatattttgtgactgttgtctttcacttagtatgatgttttcaaggtttactcatgttatagcatgtatctgtacttcatttttattgccgaatatatcacattttgtgtatacattcatcagttgatgaacaattgggctgtttccagttttgggttagtaagagtaattttgctgtaaatttatgaataattttgatctaatatttaaggttaaaacctttttattttgaaataattcacattgaattgcaataaataatacagagagatccttgtattagtctgttctcacactcctcagaagatactaatgagactgggtaatttataaacaaaagaggttaattgactcacagttctgcatggatgtgaggggatggggctcaggaaacatagaatataaggtttgcataaggcaaaggagaagcaagcaaattcttacatggtggcaggagatagagagagtatacaggggaaattgccacttttaaaactatcagatctcctgagaactcccccactatcatgagaacagcttggaggaaactgcccccatgatccaatcacctcccaccaggtacctccctcagcacatggggattacaattcaaaatgacatttggttggggatacagagccaaataatattattccaccccagaccctcccaaatctcatgtacttttcacatttcaaaaccaataatgccttcctaacagttccccaaagtcttaacttattccagcattaacccaaaaatccaagtccagagtctcatctgagacatggcaagtcccttccacatatcagcctgtaaaatcaaaagcaaaagcaaaagcaaaagcaaaaaaaaaaaaaaaaatcaaaatcaaaagttacttccaagatacaatgcaggtacaagcattgggtaaatgttcccattccaagtatgagaaatttatcaaaacaaaggggccacaggctccatgcaagtctaaaccctgttggggcagtcattaaatcttaaagctcctaaatcatctcctttgactgtatgcctcacatccagggcatattgatgcaatgggtgggctcccaggtcttgggcagctctacccctgtggctctgcagggtacagcccctgcggctgctttcatggctggcattgaatgcctgtggcttttccaggcacatggtgcagactgtcgttagatctacctttctggggtcaggatggtggccctcttctcacagctccactaagcagtgccccagtgaggactctgtgtgagagctccaactcacatttcccctctacattgccctagtagaggttcttcatgagagctcttctgcctggacatccaggtgtttctatacatcctctgaaatctaggtggagactcccaaagttcaaactcttgtcttccacatacctgcaggcccaataccacgtggaagccaccaaggattagggcttggaccatttgaagcaatggcccaagctgtgccttgaccccttttaggcatggctggagctttaacagctggtatgtgggctaccaagacctgaagctgcacagaccaatggggccctgagtgcagcccaggaagccattttttcctcctaggcctggaatgggaggagctgctgtgaagttctctgacatgccctggagacattttccccattgtcttggctattaacattcagctcctcattacttatgcacatttctgcagttgacttgaatccctccccagaatatgtgttttccttttctaccacatggtcaggctgcaaatttttcaaacctttatgctttactttccttttaaacgtaaattccaatttcaaaccatctctttatgaattcatattaaatgtacactttcaaaataagccaggtcacctcttgaatgctttgcttcttagaaatttcttctggcagttaccctaaatcatctctctcaagctcaaagttccataaatctctagagcagaagcaaaataccaccagagtctttgctaagcatagcaagagtaacctttgctccagttcccagtcagttcctcatctccatctgagaccacctcaacctgtacttcattgtccatagtactatcagcattttggtcaaaactattcaacaagtctcaaggaagttccaaacttttctacatctacgtgtcttctgaaccctccaaactcttccagcctctgccttttacccacttccaaagtcgcttcctcattttcaggttatctttataggagtaactcgctctactagtaccaactctctgtattagtctgttatcacactgtataaagatattatctgagaatgggtaatttattaacaaggaggtttaatttactcacagtttcacatggctgggaaggcctcaggagacttactatcatggcagaaggcgaaagagaagaaaacgctttcttacagggcagcaggagagaggacacacaggagaacctaccagttttaaaaccatcatatctcatgagaactccctcactatcatgagagcagcaggcagaaactgcccccataatccaatcacttccaccaggtccctctttcaacatgtggatattacaattcaagatgagatttgggtggggacacaaagccaaaccatatgaaccccatatattgttcacccactatcccccaagagaagcatttttcataactatggcacaatattacaacaagaaaattaacataacaattacaatctactgaactgattcagatttcaccaattttgcaggcatttattgtgagtgtgcaagtgtattttattctgtgcactttatcacaatgctatagtcaagatacagggaaattccatcacaagaatcccttcagctatccttttagaggaacagctatttcccacctaacctgccccaccataacacctactgaccactactcagttctatatatctttaattttttcattccaagaatgttatatgaatggaattacataatctgtaacttttgagattcgctttttcctttgctcttaatgttctgttttatacataattaccttgagatttatgcaagttgttgtgtatatcagtagtttgttcctttttaatgctgagtagtattccatgatatggatatgctacagtttgttgaatcattcacctgttgtagaccatttgtgttctttaaagtttgggctattataagtaaagctactttgaagattcatgtacaggtttttgtgtgaatataagctttcatttctctgggataatgagtactcaatagtacaatttcagaattgcatggcaagtgcaattttagttttataaaagactgatattcttctccagtgttggtataccattttacattcatgctagcattatatgagtggttcagtttctctgcatcctcacatttggcatagtcactgtttttaattttagccattctggtaggtgtatcataatatctcactgtgattttaatttgcatttgccaaatatctactcatgtaactatttgccatctgtaaatcctcttctgtgaaatacctgttcaagtttcctcttattttgtgaatttttttctttttaacagttgcatttgggaattctttatatactctagatataagttctgtgtcaagtgtatgatatattaacactttttttttacattttgtatttgtcttttcatcttcttattcagtatcttcttcatagcagaagtgtttaattttgatgatgtccaatttgttaattattttttatgaatattgtttttgggcttaattctgaaacttcacctaactcaagatctcaaagattttctgtgatatgtttttctaagtgtttcgtagatttacttttaagtccatgatcaattttgagctttcaaatatcagttagctataaggatttgggtttatttctgcatcctctattttgttccattggcctacatgcttatcttttttttttttttttttttttttttttaccagtaccaaagtgttttggtgactatggccttatactgtagtttgaaatcaggtagtgttatgcatccagatttgttctttttgcttagtcttgctttggctaaaccagctcttttttgcttccatatgaattttagattttttttttctaattctgtaatgaatgatgttggaatttgatggggattgcattgaatttgtagattgcttttggcagtatggtcattgtcacaatattgattccacccatccatgagcatgggatgtgtttccatttgtttgtgttgtctaagatttctttcagcagtgttttgtagttttccttgcagaggtctttcaattccttggtttggtgtattcctaagtattttattttattttttgcagctattataaaaggggttcagttcttgatttgattcttcacttggttgctgttagcatgtagaagagctactgatttgtgtacattaatctatgcggaaactttgctgaatttttttttatcagttctaggagctttctggaggagtctttagggttttcaaggcaaacaatcatatcatcagcaaacagtgacagtttgacttcctttttactgatttggatgccctttatttctttctcttgtctgattgctctggctaggatttccagtactatgttgaagaggagtggtgagagtggacatccttgtcttgttccagttctcagagggaatgctttcaacttttccccattcagtataatgttggctgtgggtgtttcatagatggcttttattacattaagatatgtcccttgtatgccaattttgctaagtgttttaatcataaatggatgctggatcttgttgaatgtttttgctgcatctattgtgatgatcatgtgatatttgtttttaattctgtttatgtggtgtatcacatttattgacttgcatatgttaaaccatccctgcatccctggtatgaaacccacttgatcaggctggattatctttttgatatgctgttggatttgattagctagtattttgttacagattttagcatctatattcatcaaggatatcagtctgtagttttcttttttggttatgcccttccctggttttggtattagggtgatgctggcttcttagaatgaattagggagggttccttctttatcttgtggaatagtgtcaaaataatttgcaccaattcttctttgaatgtctggtagaattctgctgtgaatccatatggtcctggactatttttgagtacaggcagtgtagatttagaatgatttgtaagggctctaggatttttgaataataaatgagcattagcttcaacttaaagttgccagcttcattaacccctgacaacacagtcagtctgtcttttgaaacttaagccaggcattgacttctctgtagctatgaaaggtctacatgacattttctttcagtagaaagctacttcttctgcattgaaaatctgtcatttagtatagtcaccttcatcaattattttagctagaccgtctggatagcttgcagcagcttctacgtcactttatgctgatgcaccttgcacttatattatgaagatgtcttcttttcttaagcttcatgaaccaacctctgatagcttcagattttttgttctacagcttcctcatttatcttagtattcatggaattgaataaagttagggccttactctgaattaggctttggctgaagggaatatggtggttggtttgatcttatatccaaaccactaaaactttctccgtatcagcaaaaaagattgttttgctttcttataatttgtgtgttcactggagtagcatttgtgatttcgttcaataatttttcctttgcattcacaacttggctaatttggcataagagatctatcttggctctcaacatgcttttctcactcaggttaataatttctagcttttgattgaaagtgagagacatgtgactcttcctttcacttgaacacttagaggccattgtatatttattaattttcacactttcaatattgtgtctcagggatagagatgttcaaggatgaaatgaaagacaagggaatggttgattagtagagaagtcagaacaaacacaacatttactgattaagttcaccatcttgcatgggcacagtttgtgacacccaaaagcaattagaagagtaacatcaaatttcattgtttatacatcaccataacagaaataataatgaaaattttgacatgttatgagaattattaaaatgtgacatggagagatgaagtgacaatatgttattggaaaaatgccacttgcccaatgcagcattgtcacaaaccttcagtttgtaaaacaacagcaacaacaaaccccacaatatctgcaaagcacaataaacaaaaatgcaaaaaaagaggtatgcctgtaattctatgcaaactgtgcatttaatcttgattaaaatttggtatttgaatctatacatattatatctaatatataaacatagatttttctgaagcatgtttctagataaaaggaacccagatctataagatccattttttataagagaattcatctaaaggatagatcctggaaataagtgataagtgggaaatcagaagagagttacagaatagggtatgtgggttttatggtgtgtggttaagagtaaaaggggagaaggaaaggaaataaagcttactatagccaattatctcctttgctttgtaactactttgtaatatcttgcttctgaagagtggactgcctaacacaatacttagatttgtaatgctattttttaaaccatgcagaattctgtgtcctgatgtccagtgacttttgactacctaatcaatagcacagtcaggcatctatgacaaggaaacaccacctggtctatgtaaacatctgtacactctacatacatgacttgcacagtgtggaaaattaatgcatttaacgtcattccataagtgaattaatttagttcctaaaatattttttcaacttttagtaccccgcacaacacaacagaaagttttttttatttttttgagtatttttgaatatgctagtttttcttgggactataaaatgcattcttgttcagacatgaggcaatgaacaatatcaatggcttagaataaatttcattgcatgttactgatattatggcaaagcatgaaaatgggagaatgtttgctgggcagttttaagaaattctagatgaaaacattttaaaactacaggaagagaatatggttacaaaagagcaatttagtaattattggacagtgtaatttcctccatccccaggcatttttggttgctaatgttcagaacacacttggagaaattttgtaataggatagtacttaattagcataattcattatctacagtttgaaatgtgcttatggattcgatatataccatgcagatcttttcagcttcttataatttagaacatagattatataatataaacaaggtgaaagcagtaagacatgccataggaagagttataccaagtgcttttcatattcagaaaacaaaaatataaattttagccaggggagttgaagaagacatatgaaggagatagaattttagatgggccttgaataagaaaagaactaaaacatttaataataatataaattgaaatattgacctaacttataaagagtataaaaattcaaagagactgaaagttagggcatgtgcccaaataacttctcttcatttattttcttgacatatataagacagtatacactcactatgcatcaatcattatgctaagtatcagggatataacagccctgttaaagaaaatgtaaaataataggaaacatagaaaacttatcactaagtaaagtaataaatggctaatcataaattttgtggtcagagcaagatagtttcctagagatgcctggtacttgtccaaccaaaaacaaaggaccaaaacaatgaatagagaactacattccaactagagtgaatgaagagtatgctggatacttcaccacaaggaagtggtgaaatctctgtgaagcacagaaacccagaatggaagtttagaaagtaagtgaagcacctatctctgccactctgttccccctgctgggatgagcttggggatgggagagacttctttttgtgagaaaaagttaagctggaggccaccagcagtccccgttcccgacatacacatctacagttcttgctgcaagaaaggcccacagtcctcactgcctctgaatgtagtttggggagcttcctggagttaacatggctgcattgctccagagtgaggagcctatgtgcaccccctatccctgtgacccagggtgctatagcacatcactatcttgatggtaccagacccatagctgtagtgcatcctattatgggagccaatagtcattgtttatccatcgtgatgtgctactgacattccactacactcacacagatggctgcagtaacaaaaacctggctacttggagcctaggttcagcagaacagctgtgactccagtgtctgagactatgctatgccctgctccaatggaacaggcagttatacagagtgggaaagctgaccctgggcttgtcctgactccccagaaaatcaccacagagatggcttacctatcacacccatgtgtgcctgacagctcaacattcaacccagtggtggctccactcccctgccaacccactccagaaccagtcaactcatgtatgtgagcatttgcccgaaccaccagttagccttgtggtggtcccactgcaaggtatttccaccctagataattcactgcatcggtatgctcctggaccaatatagctggcctagtggaggtcctggactccagcaagcccaccctagtgccagccaaactatcacacccaagtatgcgtagtctgaaactatcatggtggccattattaccgtaagtttttgcagtccagagcactgacacactcagacattgctgatgcgaattacagctgaagaaactgcacataaaccacactcctgcttctacccagaatcaaagccaaaacaccctactaaaccacaccctaagacgcatatacatgaaaatgtttcactttaccaaaactaccacataaaatcggaaaggtgactcttctaccagatgcacagatatacgcatagggaaagaagaaatgtgaaaaagcaaagaaatgtgagccttccaaaggaacacaaaagacttcagtagcagacactaaagaaaggaaatttatgaagagtctgaaaaagatctagacatttcagccttaaaaaaaaagaaataatatatttttcaggaacatggagggaactggagacagttatctcaagtgaaacaactcagagacagaaagacaaacaccacatgtctcacttataaatgggagctaaataatgtttacacatggaggtagagcgtggaatgatagacaatggatgcttggaaaggtcaagggatggcagaggggtggatgatgagaaattacttgataggtacaatgtacattactccagtgatggatacactaaaggctctgactttactactgatgaaaaaattggcaatggaccagaacagataaccttcaaaagaagaaaagtggccaacaggtgtgtgaaaaaaatgttcaacatcactagtcatccagaaaatgtaaatcagtaccacaatgagatatcacttcactttagtcagaatggctactatcaaaaagacaaaagaggtgttagcaaagatgcagagaaaaaggtacccttctacagtgttgacaagaatatatattagtaaaaccattattaaaaatagtatgtatgttcctcaaaaaattaaaaatagaactaccatatgacccagcaatactactaccaggtaaatatccaaaagaggtgaagttaataggttgaagaactatatgaactcctatttttattgcttcactattcacaatagtcaagtaatcgactctaagtgtccaatgatgtatgaacggattaagaaagtgtgatcacacacacacaaacacacacacacacacacacacacacacacaatactcagtggaatactatgcagccttaagaaagaaacaaattttgtcatttgggacaacatgggtaaacctcaaggaaaatatgttaagataaataagtcagaaacagaaagataaatatcaaatgttctcacccatattcagaatctaaaaacgatggtctcatagaagtagcaaatagaacagtggttaccagagactgaggaaggtggtgagttgataggagaggttggtcaatgggtataaatttatagctagaaaggcagaataagtaccagtgtcctattgcactgtagggtaactatagtcaacgaaaaagatattttatatctcaaaatagctagaagagaggattttgaatttcctactacaaagaaatcataaatgtttgaggtgatggatatgctaattactctgatttgatcattacacaatgtatgtatgtactgaaacagcacattgtaccccataagtatgtgcaattgttatgtgtctgttaaacataaaaaattaagatatgatgagaacatgtgcaggtggtctgtgaggacagagaaggagattgggcacctctcttaaccatggaactttgtctggttttcctgagaaagatttagagtaaatcaataaatgtaaagaaaggatatttatttcagcctcaaagcgaagtatatgcaaagttccagggataagatgaaagaataaaatttgagcaactaatagcagctcaacatagggccataatctaacaaggtcataaagaacattcatgaagattcatgatggatacatcttatctaagtgctagagaaggaaggaggtcaaaactggtttaaaagcaagagagtgagaaagcacgggagcatgcttgagagagggagagagagagagacaagtaaaattagaggaaagtgggagaattgtgaaaaagagggatacaaagtcatggaggtaatgatgtgaaaaatcctgagtttaagatttgactccacctatggataatatagataggccattacatttggatgattttagggaattgggaagatttttttaaaaagtagatgtcagagcaatcaaaaatgatagctgttgatgaaactacaaaatttgagaaagtttgaaaaccagatatggctgaaatgaggacctgacaatttatcttataataaaagcggtttaacattaaagaaaaaaaagaataagctcagaatagttttatgaactttatcaaaaaagctgtcattctctcaattttcttatgtttaactaattcttaaaatcatgttgtaaggattataattacattctctaaaggattaattacaatagaaacatataggattttaaatataaattgatgatttaatcattatttctgcagtaaattggagaactaaaaattttttgcaaagattaattataagttactctgtattattgtcagtatttctttcctcattaaacatgcaatgaaatttgatgtcattaataattttttagtaattccattacaatgtatttattactcaagagacacgtcaaattttctgatacaaataactagagtattagggaacaaatgtatgacatttatcatgaccatatttttcttgatataattatcctaaatcccctttagtggtttaagacatataatcctgagtatggagatttttagggtgaaatggaaaatatattaaaacaatggaaactttatttctagaaattctttatcatgttactgggttttttgttattgttgttatatgtcatttgccactatctgaaatatatattatttatttatttgtttgtatgttttaattttactgtataaaaccatgatttttctcttgcttactatcatatttccaacctttaccattggtatttgtcatatagttaatgtttggtaaataactgttgaataaatgtgtacaatctatttcttattaaaagattattctcattgactttatgctagaatttgcttactcttaaatgaccacagtgatttgacacagggataacaataagttatattttagaatatctcctttagtaattatctaaattaagtagtttaatggaatctttccaagtggcatatattctcaatccctcatttcctggttttcctgataacatgtgaaataaggacagagatatagagatttatttgtgagatttctccataagccataaaccaaaccatattgtttagaatgagtgtaaataatgaacattattcagtgactgtgattttcaaagcccatgtgactcgcctataaccaatgactgtatatttctctctggtggcagagggatgctgtggtacaagtgctttctagttcagtttcttggcttatctaaggtcttgcctcatacactgaagcattgaggctgtcaggaatacttcttagtttcacccttgttaaattatcattatttgctccacctcatgcacattctacttctccctactgcagctctactttcttcaggtccactcccttagattactgaaagtaaattcaagttgcaaactgcagttacacagtagctattacttgcctttactgtactctattactgaaattacctttcatgtccctggaaaagatggaaagtttatcatttttattgaacattttgtcttttttcttttctcgcatttcttaatgtccttgtggagccgattctcatgtactgaactgggtcttttagggggtcatctccaaactctgctttggtgtattacacacctccatgcattgtagtctcattacatctggaaatgtgtgcagcctgtcaaaaataatttaaactttccctaacggatattcatgttcatcgaaatagggaattgaacaaaaccaaattgtaaatcaaaatctggcatgaactatgctactcaattgaaaatataattgaaacaaatccaaatagtttttcactgagttactattttaatcaacaagagtaaacataacctgtatattttctgaaagtaatgaaagcaaattttaaaacttgagtctaaaattatacaattatattatatatttttgttaactaaattcagattggaaaaaaagtcagtcagctcaacaaataaacagattcatccctatgaaaagagaaaatagatttatagggaaacattacggaaaatgcactgcaaaccaagaataaaaatgagaaatatataaaaattatcccaatgttttcatattggaattcaacattctgtacaccagtagacacaataatacaataaaggtgattttacattttaatgggcaggtggtcatccactaaaagtggtggctagctcccacacatcttaggaaagttgggttttcagggataaagatgaagagtattggttagagggtccttgcatccctgtacctacaccttaacactgattacatatacaatgacagattttccatcctccttctactgttcccctagcatgactaattgccaaaaggtgagagaatatttgtaattcctcttgacactcccaccccacaaacatagtataataaatcagctgtttattttgccttctgaagaagaaaactgtgagctttgaagaataggaaatatatacttgttattaagaaaccttaatctgaaactcttaatctgaaactcttattattaagaacgtgttattaagaaaccttaatctgaaactcttcctaactatgtaatagccttgctttggagactcttttactttggctttatagcaaacacttaaaatttaaatggttagatatatggtagaagtataatacagcagtatttttctatttcatgatgtcataaaaactgctttgctggaaatcttcaaaaaattataaagcaagaggtactttatatattaatcatgaccaatatctggagcatagttccaatattttgttttaagatacttgttttgagtatattataaatggtattcttgcaaccaaatatgtgaagactacatatccaactatatttgtttggatatatacaatctgttttctgcctctccattggatcaggcctctaatacattatagaattatatattcttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccagaattatatattctaatgaaagctagtcatgaacatttataagattatgaaattacataaaagcaatgcttgttctatgaaaataaactgtgaaatttgccatccagtgagaaatactgaaaaaacattaagtggataggagggagtataagaaaataactgtacagtctcactctggaaataaggatatcaatttatgaggtctttcgattttgtaactttattgtatcaatacatatatgagaagcacgttgactagcaccatcagctcaatatctgttatgtttattattaacaataagaatacaatatatataataaataataaataagatataataaataataaacaatatataacatattaataaatgataaactatataatactaataaaacaataccataaataaattattggtgcagtaaataaatttggataaatcaaaaatcatgtgcacttaaagttttatagttgattgtattaatacacacaacctgattggaacagcatgtgtttggaattgcactattctgtgattgacttttctatgcataaaagaactatttcatttgtgcttaaaaagttgacagtgcaaagtcatgaatatagttggacatttgtttggtcccaattttgtgaaaacgtttactgctgaaaagctttttaaatttttttgttgttgtcttttgtaattcaggttatctggaatgaatataccaccaccaattatcagcaacaaaaactggctcagactgcattttgttacagacagcaatcatcgataccgtggatttagtgctccctatcaaggtatacttatggaatacctttgcctcttttgatatgtaaaataattttggtgtacacaactatgttttgtgatagaaaaatgtctttagcatttagaaattggaatttgtattgaaaaaaatggtcatgctgttgctgagacaataatgtgatcataactaaattacagtattaaagttagttgattttatagtataatattcagaataatgaatattatgatttctaaaaggtagtatgtagcagatgcaatatttttctttaataaagtgcttcagcaattggatatactatctgaagttgtaccgcaaatcactgcagaaaaccttcagttgcatgtacgctctttctcaatcgaaactcacctccatatgcagcatgtttgttactgctagtttaattaaccttgttaggagttttatctaccaattgtgttaacataaataattttcaatacataggatataatatttgatgcattaacttgaaaaactctttggaacaagattattatgaagatggagtactaatgaaaatgtagcttctacaatgttctgtaatactatgtgagcttagtgtactttatcttcagactacttatgtaaataattcatttcattctcagtagtgtatcagctacttttcagggaatagtaagcattgccacagttacattcttccatttatctgtgttttttgttttttttaatgctttcccctttagtagtcttcagtcctaagcacttcgaaaatttaatatgatgactttaggaagcttatatttagtactcaaaatggcattaaatcatatattgttctttggaatacaaaattcaacaattaatttgtattttgaaaaccagtaacctctctgaagctgttctattaataagatttctctcaaaaactgcaacagcttgatgtgatttgtaatttgactttcgtaatagtgcactgagtatcactgtaataaaaattcttaggaaagtaacttaaaatcaagattttcgacaaagtccacgtagaaaatctgcaataatgatcatttctaaagtagttaattggaatggaaacataaatgcaaatatgcttttaaaactatgcaatgtgttaacatgtatcataatagaaaatattagccatcacaaaacactaaatctttagagttcaaaaataaactttcatagaaaaatttattttcacatattttattaaaaatagctgtttaggcatggtaacttgaatcttaaacagtttaaggcaatgtcacttttaaatttgcaaaaatattttatcctgttcccaatttcaatttctaaaagtttgtgtactttagaggactattttattgaaaataagatattgtgaagcttctttatctctaggttgacccttttacttgtggagtttttcatccacctaactctgtggctctgattcctttctacaattagttaaggccaatggcatggcagaaattcaaaaatcaatcctcttcgattcctgtgatcttttctactagattcatggaatcttctggtcaaatggcttctattatttttctaaacagaaataaagtagcatatattttatatttatatgtagaaactggagcaaaaaaatagatctcctacctcaaatattaagcgatatttcatttgttttgtgcaatatgatttcatggagctggtaccttcagatagggttgttttgcactataagacaatggcacaaagctaccagtcgatttgtgtacttacttataaatttcagcatgctactcattggtctttaattgacttttgcagtatttttaagattggaattgtggttttcaagcattatgcgttttcggcactgaaaagtagcatcactgtagtaaaatggaaaagatgtgttttatgaggtacaacttatttctatttgctgcaggaaaagggactcaaaagagggatgggatttatatcgatataacagaggaaatgcagtggttaagaaaattgaagctttgattttataataagattaagggaaagttttattataaaaatatgcctttgcatattattcttttaaaactttcctaatttaggcttgctttttctgattgcattaccttaaaataatattctacctcaacagcatacattcaattgagaagtaaatcttgaaatcataatgaagaaatttaaattaaaaaatatatgtgtactaagataacttaaatggctgcaaaatcataattctgtcatgccaaaatacatgccctatcatgaaatggtaacgatgctttttacattgttccatgctactatttcattttagtggtgtctacattaaaactaattcaagattgaaaattttgtgtaatatattatacaaaagtcaaaactaagtctccatgcagctcagtttctaaataactcatatatttaccgagtactcagtaactattattgatttacctataattatttaatatttttaggaatctgcaggtttccaaagactgaatattttactcataacgtttctatttaatctctatcctttattaaataccatgaaaattaactgcaaactactagtgggttcattgaatgccattagctattttttatagtgtgttccataattgatggagtaggtacatagacacacactgctgtgctttcccaaatataaccacctttaagttatgttatatgctagcttcctgaatgctttagatattataattttaaataggattaagtagagactgagaatagcatgctaaaaagcatagttctatatcaattcaaaagtattaaaaatgtggtttaaatagaaagcctttaatacgtaaaatacattctcactctgagctcctgtattgaatatgcccactcgtatttaaaataaaacatcttttgccttcctagtttacctataatagaaatctcttacttaaataatttattactgtctcttctttgattaaaaaaaaaagttatttagtttttaactctgcccccacaaattcacttcaatattatgtcattatatttgtctttgttttaaactattgttcctccattcaagttccattaaccctctattaatgagaacttggattgtgctacttctcacctaaatagtaaaacttttctttaattgtggtgtttggaagtcctcttacttattttttgaaaactctatattattgtcacttggtcattagtataaactaaactctattcttttccatttcgatgaatacattgtcatatttacttattttttaaattggaaggggagttttagataacactcaattgtccaagaaagaaaatcttacctatagaagattttaattaaaagtatttttatttcataaggctcaataatacaagtatgaaatatctcatttttaaaattattcaacattcagcatttctctttcaatgtgcaatcataaataccatagctataggcattcatataattgtatttatcatgtaagtttaggcattgcagtatttaatcaattttaaatatgtaaatatatgagtaattttatattcttgattcaagcctctaaattccttacattttaatcacaatttgatttttatattttcttccaaaattttttgtatgtgattcttcttatgcaggcaaatattttacagaaatttatttttcatgaaataaagatatattaatagcaacacacaatatttaaaagttatgaaagataatgatattttacatagattctcaaataggctatgatcattttgggatcaactgggcatcttctattgaaagaaaagcatatttattggacagaactttcaaaccatatcgaaaatgccctttcatataccttaattacacagagacttctggcattttagatgcccattgtttcagtcaaaaacaagtaactttggcatagttcatccattttttatatttgggaagtttttacataaatacctgtgtacagttactgaacaaaggtaaataagattttgggggatgcagcatagtatattaagtaaagaataggatcagaaggttagaattgaatcataaagatactaattgctgagttctctgagcattggtttttcttttatcaaacagagtcacagtagccagacatattattgttttgtaaattaaaaggtattaagacttcttctttttttgactcttcaatctttatttagatactcaacacacatgtgcatgagcacgtgtgcacacacacatacagacacagagtacaaattaagtcattaatttcccactacctagaaagaccttcatatttctttgagtcttaagactgagatcagatgtctctgaaacattccctgactccttcccttgggggtagttaagctttcataatgtgttgtaatatttcaggacttcagaaaactttgctttgtgtaatgggcttacaagataccctgaaaatgatgattaattatctttgtattcatttacaggatggttggttgttattttctgccacccacaaccagtcatccctttttaattttttcttgataagggcatctcattttcttctgggggaattatccctcttccattgtgtgtgcaatcttggtggggctgccaatcagccccaccaagcggtaggcatatgaggcatgatggccagttggactaaaatggaactgtttacctgtttaagcagaaggggatttattacagagaatggagtctccactaattatttgcagaacaaataattgttatataacaaataatagtctgcaaagagaactgttaacatcagaaagccaaggaagtgggaaccacagtgccaacttctgattgttgctgtaaccactggtaccagaaataggaacgttagctgtgactaacaggttagaaaccatggccacaattgttggctccagagacacgacatgcctgctgggactgcaccaacaaaatggatgacccatgccatcctctcagtatctgataagtggctagctactgggatttcagctaaagctgttgcagaaaaatcaacaaccttgcaatctatgttctgcaccagaaattgcagaagtaacacaaatgtggcctccacctcacttctgcccttctgacctcacacaaacacatgtgactagctgaatatttttaagtaccttctggaacactgtctgcaaactatactatggaatatagtgtttagctttctagccttaacaatgactgaaggggctctagaatgagggcagaatggatactgaatatcaatccactacataaacaatggactcgctccccaggctcttgagcccagtggttaaagagcagaagaaaaatggttggagccagtggatccttcagtttcctgaagattagctatctagatcctccaaacgccctggttcctgtccttttaggtttctgcttttgtagatttccctttggctctggaagcccccaccatgaccttataattatttcccttttacctctagtcagatttgagttttgatatttataatcaaaccacctcaatggatagccataccacccttaactcgcccgatctcatttgttctctaaagatttcttatagtataagtaagacattaagtaaataaagagtcttcactggaaagagataataacatatggaacagatgagaaagcacacattctaactatgaaaaatgaatagtttaaatattgtgatgaaacataaaatttgaatccaggagctacagttaaaaagataaaacactaggctttatatttctcactatcacaaatgaggatgcccacgtttctcaagggaaaaacactttttcttggaactgatttttaaaataggctagtttgtaagtaaaactgagaaacaatttttttttctataacagattttctgaaatcataaatatagtccaggcttaaaaatagagcacaggatcaaagcaaatttctgtaaagagagatggtattctaatctttgctttcactaatatgttcaatgatatattttttctatctttgtttttctttcttgttgtaccttcaccatatccgttgttaataaaatacagggaatcatatatcccaccattctagtcatgaacccctactctaatgttataactctcaatatgagttgtatttatgattctaaggatagggtggaggagtgtgacatgaaaagagaagaccaataacttttggttcagacaatttagatgaactgtattatcaaagggatgttggacattgtattagtctgctcccacactgctatgaaggaccaccagagactggatgatttataaagaaaagaggtttcattgactcacagttctgcatggatggggaggcctcaggaaacttacactcatgacagaaggggaagcaagcatgttttacatggtggcaggcatgaaagagcatgtgtgagtgccgaaaaaattaccatttataaaaccatcagctcttctgagaattcactcactatcaacagaacagcatgggggaaaccgccttcataatccaatcacttccctctcttaacatatcgggattacaggtctttccctcaacacatggggattacaattcaagatgatatttgagtggggacacagagccaaaccatattagacatagatgagtagattacttttatggtaaagattgtagatggaacttcgttagtgtaattccagaaatattcaataaatatatatatattttcatagtatagtaggttttatttaatttttactgagtatatgctatgggaaaattataaataatatatttaaattattatctcaaaacatgctttcatacataggccaactgcattattttaagcttatgaagtaagagagctacttttatttactgagttttaagagaacagaattttgagtttcattggtatgtagtatttgagaataatctctaatcttgcacttttttctttgtatttgattttgacattattatcatctttcttcaagtttccttcaatgctaaataaatactttcacttggaaattcttttttaaaacaatttttgttgtgaagcaaaaacatagaaaattattttacttcttgctttatggacctgacagtctatgagactcatcttctttttagtacaatgtctacagaaacagcaaaaataatcaaacattaataatcaaaatgatctatctaaataatcattggtctgtctaaagcaattattaaaaattttctgatagcatttattctgtgatacaaatgaatattttacagtcatgccagtataagatttaaggccttttattaaattaatcaagaacgattttaaattatatttttcctattttataaaattcattaatttaatttaaaatctaagtcaataatactgggaaagtttataaatgtaaagaaggagttttagttattgcaatattgaaaatgaaagtttgactacacttttaacaaaataattctaatccttagatttggcaatctttttatatacctcctgtctcaaatttctgttcattagttgtatgtgtatttgatagaaaagtggctaaatattgttttacttcaaatttccctgaaataaaatttttgctgtgaaacataccctggtaagctgaacaaactattctacattggaaacacaatgctagtgacacttttttgcttaactctagtccaatataacaatttctagtaaaacattttatctttcttaacattttaaaattcatgaattaaaagttaatccatataactgtgtttagaattggggtacagttttaatatataaaataaggttttagaaataaagtataattttaggagtcatgttgattatttcctttatcttttttagctgttttataatccttttttctgattaggagttaacaatatgtattaatgttgagactgccagaattattagaggacatcattcatgagaaaagagtagttgtagaaacattaaattcagattctgataaaaataattacttaaaatcagaaaataataagctttgggtcaaagtacagcaggaaagtataaagaaaaaaagagtgtacttaataaatcgtcacaggatttaggattttgaagattagagaatcccttatacaatttttttctagggagttggattaatcttcatagcattgatactgtagtgactctggtttataattaaaaagaaaatatcatggatagtcttacttaaaaaccccaaaactttaatgcttacctttgcaattttaagacagtgttcaatacatgtaaatatgggtttgtttgtatatttatttattctttattggagtacttataaagtcaaagacaaattataatagcctcatgttatgatctcatggaatttgtaaaaatccacatacaacttaatgatttttatttcaattactatctttaaatgtaccaactacaataaataggagataatctgtcaataactagttataatatggacaatattttctaaaatttaaactaggttcaaatgtagtacttggtaattattaaactgataaaatgatagatcattttgcataactattttgtttgttcccacattcctgctgataagagaataaacttaaaatttgccaatctcttctagaataaaagtcagctttcttaggataaatgttcaaactttcagggcttatatcacttcctccttcccttttcaagaaagcttctagataaaaagtttcttgatagcccatgagtcttaaaagtgatgggatgcacccaactagtgaatattagatagtttcactagaggcttcacttccttgtaactgaaaattttgtagggatctacttctgctgtgcacaaggtgggcggtccaccttgtactccaagacaccttttctgagtcttaatataagtgcttatttatcattttgttaatttaaaacaaccacttaattacaagtatctatataatagatattataataaaaattatccccattaaattatgtcaaacatttaacagacaaatatattacaaattaatcatatgagatatcagcagagtctattcattgctactgtatgtatactagtgaaacaaataataataccatctgctattacaggtttatttaaccttttattagttcaggtactaccggctgttattgaaaaactcaagaaggaatctgtagttataaaacagcttgaggtgaaagaattataagacccttattgggaaaggtaataatttcataatactcagtgcatgtttgttgaaaaagttcaaatcaaaacatcatattatcaaactaacaagaacataaccttatttcattggataatatcctccctccctacagaaaatatagcaattactgtttagatttttcataactaacatgagactccagattttgtggtcatatactctgtcagatttccaagtgaacacaatttttctagtttttcaacgtgacaagggctttttttcaaagcagatgttttagtagcaggaaatggccatagaagctaagattggaaaacagagtgaaatagagattcccaggaattaatttttcttcatacaagtattgttctggaaagagcactggattagaagttagtaaatatgaataccgacttcagtctgtgaacctgaatagattacttaatatctcaggactgtgagttctttctaggtccaaaattcttgtactgaatctactactcccaatgtcagtaacataaaagttgtttgcatggtagcaaggcttcacagtaatatgaagtatccccatttatcattcccgtggagagctttggtatccctcaccttctgattaacctccacatggttctagactcctttgcagagcaccagccaaaaaggatataacacacatatataaatatttaatttttcttgtagccatgtaaaagtttaagaaataggcaaaaataattttaattatatgtaagcaatatggcaaaaatattaacatttcaacatataatctatataaaatattactaatatattttacattttatttttcatattaagtcttgaaattatagggcattatacttatagcacatctcatattgaacattgatttttttctatgggaatagtttatttatagactagaagaaaacttataattaatataataaataggttgttagcaattatgatttacttcagtatcactgtaattattgctttctcataaaatattcaaacaaatacatggaatgttatatcaatatatagtactagaaagattttagtatcaatatatagtactagaaagatgcatgttcccaaatcttcactacaatacagctacatcttatatgatgcaacagttaaaatgtagcctataaaacaataaagttgtgtgtaatgaaaagtatttttcactacctgtttctaaattaaaattaagattaattataattaaataaaattaaaaattcagtttctcagttatactagctaatttcaaatgattaaaacctacaagtggctggaggctaccatattgattattcatccttaacagataaggtgagcagccgtcttatggcagctaagctagtgctagccaattataagaaaataagaaattagttcaaaaatcacataaatacactgagagaacatgatacagtgtcatttttctccattgctcctcagcttttgttattgttcactctttatgatttattttctatgattattgtatttcctggactgccttatttcagaactttagaagccataattcacataaaattgtgatttccctccaccactgtgcaacttaaaaggagtatataaaataagggacttcaacaaaattctgactgttaataatttaaaaaatactcctttgaaagctaatttctcttttttttttctttttagtacttctaaatgcatacttactgttagacaagtagcacaggtcttttccccgccaaaaaggttctgagaagatattgagatatttaagaaatggaatgaatatttctcatttctttatatataattttacataagggggttaatagtgtcctctaatactatctagcataagtctaattttatacattccattatattacgttttccccataaggatattaattctttgagttagaaaatgcagcaactgtatgcaaaaagaaaaatatcacaaatgcatatgagattttagttataaccttaggtatcttctagtttttccagttaggtatactgacaaattcaaataaatcatttcagcttgatggaagaaaaacaccctcaacagaaaccttccctaggattaaaactcggttaggttctatgaccacactaaattaatgcaaattactaaagtgccacaaacttgggtggcttacacaacagaaatatatatcttacagttcttgaggatagaagtctgagaccaaggtgtcagtaggttttgtttcttttgagacctttctctttggcttgaagatggctgtcttattgctgtgtcttcacatggtctttcttctgcacacatatatttctagtgtcttgctctctatgtccaaatttcctcttcttagaaacacactaattatattggattaggcttccctctagagacctcatgttaaactttattacctctttacagtcatttgtctaagtatggtcacattctgaagcactgagagtcagatattcaacataaattttaaggagagcaattcagcctgtaacaactagaaatacagtttcaactttataattaaaattccaagccctagagagtaatcaaaacactaaatatgattcaaggtcaaatttttctttacggtctcccttcctgggccttgtcgtccagaggaagcctatataaggaaagaagagggacaagattaactgttcttgtctctcctctttgtattttacttctttttccaaatttcttacttgccactgtttcaggtctttcttggatctagctgaggtagggtggagaagatataaaaggactgacccaggcctaagacctaagatggctacatgttctctggtcctgacatttaagctaattttgtcatgggatgtccagggccttttaagtgattgaagctgggcctttctcttctgggattccttattccagatggatgcatctaaatggacacttgcccgaattagtcccttgcccctccatatcccagtctccttctgctaaggtagttctacctctcagagggcctggttggatagaccccaaatgacctcattttatcggtatcccatgatcctccttgataaaacaggttacacattattgccccgagaagcacaaaaagaccaggcttatcccaacacagatgctctcttttctctcactctctagatttccttgactggtggcttatttctgtatgagtttgcttagaattttttcagacatggacaccagtcctttttgtgtgccaactgcaaaaaatacatcctatagcagggcaatcccattaaagcccaccctactaggctggtgctaaaaggtatcactcttccactactttttcagaaaggctgttagaagggtcctcaccaatctacaagggctctctgaaacgaaatatttccaccagtcttcttttaactctgttcttcttttaaactcttgctgtgcctgaagagtccaaaagtctgtcaacttgaaataaatacatatagagacaaatcttcaagagtaaaggacttgtttgggaagaaacaaagtaataggattttaatccaggacgtatgcacaaactgaaatagcctctgtcatctctggagaacaaagaaaggaatttattagggatttattgggaagagaggaggttatgcaagttgttttgcaggaaagttcattggcaagtgtcagtggttgctagataaaacttgtagtcttgaagttatggttaggcccttgcagtttttagcttgccttgtgagacagttttgaaacaggcaactgttgtttaagtggctagctgtccttgtgtgactcatgtagtaagctgcagtttggaaaaattttttgtgataaatcttgttatcaggcaaatcatatatacaaaaccaacaaggaatagataatacaaaattaatgaatggttgagaattactgcaggctaggatgaaccagagataaaaagcctacacacttcaaatttgtttattattttttaaaaataagagaaattaagagaggcactgacattaagctgataatctaaatgtatgaattggaatcctatttacattatataaaaattgctgaatatctttgaatcttaatttactcataatgaaaatgaggaggatggattacattgtcattatattccttttcagttattttttaaatcttgagtgatttcctttctcttttaaatggtatgtcagtgactctcaaaaattacttacagatgacaaaacatttgagagtatattttgatgttacattttttttaagtcgtacatataattatgagaactaatgtttaggagagctattttgcagctctaattctaaatgagaatcaaatacttttgattctatatggccttaatttaaattacatagtttacatattgtgaatatgtcaacatgtaaaatatttctgtcctaagatgacatttttcatttctgtatttatttttataaaaatcctaggtcatctaaaccgtggttatatagccattgttattggttgattgtgtaatgtggtagttaaaaccatgactgagaaaacgaatgatttgtccttccttctaggtttaccaaatgactcagtagtagtttttggtttgggtttattttagtcatcctctctctctccctgtttctctgtctctctctacatatcacttgacacacacactatatatatgtgtgtatatatacagacacatatatatcatttggaatatgcatttatatacatatatgtctcttgagatttggtatatatataatgatgtataacatttaatgcatacacaatgatagtacaatttaaataaaattatttatccatagaaatacaagcagcgcacaaattaggtgataccattatttttagaagtgcattataattttatcattaaattacataaattcttaataaaatttactaaacatttcaaccataaataaataatttatttatactttaattagcaagtttaaaagttacctgattcatttatctactttccataaaattctgcataagaagtgctaaaagtagttctttcacagacttcaatttttaacttttttcattgtgttagactattgattccacagctataaaattaccttggaaaaaagacactccctaaatcttgcgctcaatgctctgaaatggaatcatcttcctacaaccactgattaaagtcaaagaaggtcagggaatcttttgttatgacaatcttattttgcaaataaaggatacaacattttaagcctgctctacattgttcaataactcttcttttctctcacatattttctttggatgttgaatgctttaatatacctttgtgtgtgtagatgaccttgcaatacttgtatcttcctgtgagaattcttcctgtataatttataatgtattttcatgctacatttttttgtattctttggctaaacaacttaatagctctgcatagtgtattcccatttaattaaataataagtagggctgtgggccaaaatcaatctgaatctaaatgggacaaatttgttttttttcctacaagaggattgtagtccttaatattttgttgctaaagaataacttgttttaaaactactcatagttctacatttttaacttcatagaaaactttacgaaaaaggtctatggctgaggaactcttgaatcaagatggttatcatgaaagcctccccaaaaagtagcattcctttctaaataaattttatcattacaatttatttctgacagtagtttttactgtttacttttttggggggaattgtttcaatatatgttagaaaaataaatgttttttttaatccggtaaggccaatgtattcacagaagtaatagagatacattgacaaagctatacctgtatgacatatatttgatttgtatattgatgaaacagataatctcttgtgcgatttaagttgaagatagtagcaatgctggtttctatagcatcgtagaatcatgtttctgcaatcttattccctggaatcaaatcctagttttaaacttaatccaaagttatgctttttcttcatttccttttctaaaagcatctcgctaaaaaaatcagattcctgaatttgttcctctgcctccctcaaaacctcccttctgtattccatctactcagggcctattttggtttctattaaaccataaaatattggtactaagatattattactattattctaatagcttatttgcattcccagataaaatagacattatccttattttaagttaggagacaagcaaaaacacacttatcaaaaatattacagagaaaatcctaacatggaaagtatttgctaaaatatcataggttactcagatttttatagggtgagaaataaatgatcaatattttgaagaacaaaaattgaaggaaaaataagcaaacaacaaataagaaaaattagtaactgaaacactatttatttatttatttatctatttatttatttattttttgagacagaattttgctctggttgcccaggctgaagtgcaatggtgcgatcttggctcactgcaacctccgctgcctgggttcaagtgattcttctgcctcagcctcccaagtagctggaattataggcatgtgccaccacacccagctaattttgtattgtttttagtagaaatgttggggtttcaccatattgatcaggcctgtcttgaactcctgacctcaggtgatccacctgcctcagtctcccaaagtgctgggattacagacgtgaaccaccgtgcctggccaacactagttaattatatcatgactaaaaataaacttatgctctaaatgtccactatctctcacattgtaatttataaactcatatatttatttaactgttttgaaaacttgaaatctataaaaacacaaaggtcaattgtgttagatatcaggtgataaaaacatgatccttagtaaaacatgttgacaggaaagtttgtatctctttataacaaatgtcaaaaaacacaagaaagaggttgtataacatgtgataaagttataacctagtcacattaagtcttacttcagcccttgagacaaaactgataaactagcaagttgagtctttatatgactcaaaattcttacctccagttttctcatcaagacagtgaaggcatgttcagcatgatacttgagcaaatagagacatttaagtccaagtgattatttcaaagtttatttttaattgaagctaattgcatcattaaaggaagactcagttctgattccacattttctcctttctgagaatgagcatttatttatttttgtttttactaaagacatttttttgaaaaccatagtttagcacaagtgatcaaaaataataaatgcattaggataaaacataaaataatttaaataaaatttctgagtgctggaatcttttataagatttcttattatgagtgcatactttggaaaaaggacacctaaattcaaagcttgtttttacattttagctgctccgggagtctcataaacttgcaaagggctattgtgttaaatgaaattctagacgaggaaatttgcacattgtctcacacaataaaagtgctaaaaaccaaaagtcagctttcatgttatcaaattctattcaaacagctgttacaacttctacaagccagctaagatatattgtcttatagttatttgtaggtctctctcttattaatgaagttccttaagagaccactcttaatgaagttctctcagaaatcactccctcagtcccactgtgacctgcccagagtagtcattcatccatccatatatttattcaacaaaagtttactaacaatgtactatgtactttgctaagggacaggatggtaaaagagaagggcaagttcttccaataggttcttagataccgtggctttaagtaaaatgacttacagcaggtcctcgaataacatcattttattaaaacattgatgaggaaaaaaatgatgttgttatccattagtttccctgaatctattaatgatgttaagtgaggacttcctgtatatacatatagtgtgtgtatgtgagtacacattaaacagaccaaagaaaggaatcttacatttgaaaacctgctataaaggaaaaaatggaaggggctggaatagagaataatacaggggatgtaggatctagattaggcagatagccagggaacatattatcataatgaagtggtgtaaaagctgagaataagtttggcatgagaagattagagttgaggcagtgccaggacagcaacattgaagagaagaggctaatcggaataaacaaaggccctgcagaggaaaaagcttaacaagtttgaagaacctaaaaatgcccatgtggctaaaacatagcaggattaagtgagagttatctgaaataaggttgtagaaccttgtcctcaggccgtgataaggaagacacagaagaattttaagcaggagagagggaaaatatgtttaagctttgagaaattgttttttgtttttcatttctggaaaatatactatagtgtgacaaaaatgaatgtaggaaacagcgttgtgttgcactatcctggtgagaaaagacgattgcctagattaagatggaaggcagaaatgaagagaaggcagatttactataaatttatgttgaaattgacaggattgaatgttgctatgaccaaaaaagaagaaattatgagcaattctgaaatttctgatttgaatcctttgggtaaaaatctctaatgagaaaataatttagatgggggaaaaaagaatgccttctctgtggactgtgatgtttaagttcaagagtatatttgtggttgcaagtgatgattgagtaggtgtgttaagaaggaaaattatctctgattatctatgtctgaagtttatgagaagttctaagctggagtcatagttgacatttagcccagaaagatagcatttaaatggatggagtttaatgatttcccccaaagacttaatgtaaaatcaggaaaatacaaccaaagattaagcactgagaactcaagaaccaagtgtccataaggtagattgaaaactagaagagtaattttttcaaatttagttttattttcttcattgacagatacaattgtatgtatttactgtgtacaacattatgtcttcaagtataaatgcattgtggaatgactaaatcgggctaattaacatatacatgtgcattacatcacatggttatcattttgtggtgataacactttacctctctctagaagagagtgattttgtcaaagtccagtaaacatgtttcaaggatggaagtggtcaatatatgacatgctctgaaagcctttctgttctcctttacattaatttcatagaagaatttatcttcttttacaattaatcatatccaaatcctcttctcattcttttctgaaccattttcacccctatgatttgtggaagtcacaatttctcagttcatgtattatttaacctatgatcagaatttgtcagtttcttgaaacactttctgaatttggcttctggaataatactctttcatttttctttaaccgtgattcttcctcagtctcctttgtcattttctcctcagatttctgatctctattcaggcttctgcctaaagttctgggtcatcccctgcagttccatagctttaaatcctctatgcccatgactcccaacatcatatctccagctcatgtcttcagaaacttcagtttcaccttatgcaagtacctgtaaaacaccttcatttagatttccaatatgaatttcaaatttaacatcttcctcacttcactccggatattttctcatggtctgctcattccagtctttctcatatcagcaaatgacctttttttttctcatttattcaggacaaatgtttaaaatcatccttgactcctcattttttctcatatcagcaagtcctgccttgctctgctttcaaaacattcgcaatagactacttcactccacctgcattttaaacactcagtttcctgccatcaccttctcctgcttggatcattttgacctttcctaaaaggtctatctgctctcattcttggcctgtcatattatattagcaattaaacaaccaagtgatatttaaaaaatccaagtcacatagtagcattcctcagttcagaacccttcagtggttccatctcactgagtaaaaagcttgttgcatttacttacatggtttactaacttacgtctctgacttcattccttgcctccccacttctcttgtcacacagtggcatccttgctggtcctcaaaatgtcacacctccttctgtcatagggtttttgcatttgctgttccttctgtctagaaaatttcctaaattgtgtggctcaatttctgatactcttcataaatttgattaaatcttaaatcttagtaaggtcttccgaactactctatttaaaattgcatctgttttctgatgttaaaaaattccatcccttgcattatttttttttcatagtgctattcatcctttcagtaaaagcctcataaagacagggatatctgactcttttgtacactgctatatgctgagtgagtagaggagtccaggcatatggagaattctcaaatattttgtcaaatcagtaaattgaagagatagaatggtgtactagtttgttctcacactgctgtaaagaaatacctgagattgggtaatttataaagaaaaaagttttaattggctcatggttctgcaggctgtacagaaagtgtggctggggaggcctcaggaaacttacagtcattgaaagggaagcaggagtgtcttacatggccagagcaggagaaaaagagagtggggaggtgctatacacttttaaacaaccagatctcatgagaaccctatcaccaaaacagcaccaaagggtgaaatctgcctccatgattccatcacgtcccaccaggccccacctccaatactggggattgaaaatttacatgagatttgggtggagacacaaatccaaaccatattaaatgggatttggtaacatgggggttattgcagtgatgaaatttaggaaaaccctggacaaacttgcttgaggtgtgaatgtaaagtgagggagtaaaaatggtttgtggagagagtgtttttcaataaatttagtgaagagggaagagaagaatgtgaaggaagtcagaagggaaatgtagagtcaggagatgattttactttattttttgtcttttaaccttgaagaaagagaacatatttctgtagtgatggaaatgaccatatagaataagagaaaataatggttcaggcgagcaaagaagataagatagaaacaaagacccagaggtgtcctgggatgtgatttatagcgcaagtaggtagattatgtttggttttttacttgtttgtttttgataaaaggataattcttccagggtaatgagaaggaaaaggaaaataaatgttcactgaataatattcattaaaacaatcattatttatttaaattattctcaaggaataatagctatcttcaaggctatatttcaatgtggaaagagttccatgtttcaccaacataaaaaataaaattatgtaatgtataaatcattctgtagaatagaaggaaagataaagggaaagaatctgatgcttaccaacatgagtagggctcaaagtaaggcagtagatgagaaaattgggaaggaaatcctgaatgaaatgagacatatagaggcaaaatttgaatgcaagtcttcttatttcaaattctgtgctataatacaattcactatatatatatgtatatatatatatatatacacacatatacatgtacatacatacgtatattttaattaaaattttggggggactattacaatattaataaaagatggatttgaaaaatatactctaactcctttattggtagtttaccttattgtgagaaccaaattaataggagagatttagcataaaaagcaatctatcaaacttttaaaaatcttcaattaattagttttgaagagggtttagcctgtgaaaatgtcaactgatacaaactaagaaaaaagtcagatataatatctccttgaccatcaaattctcacctttatttattctttacagttgtatcattattctgatggctgtaaattccctagtcaaaaatgacctgcctcctgatcattagctgttattcatatataaatttttatacaactaaatttcataaagatagttgcattgagaaaacaggtatccattaaggaatcataaataattaatgtacattataaattggattgagtgagatgagtaattactttaaaatgtggtaagacagatgctcaagaatacataatttagaaattgagtttttagttaataaaatattttaactgtgtgaaaagtttactgaaaagctggaatgtgacttttagaaaaagaaaataatttcattattttccatctctatatttgaataagctctatcaactttttgttttcaccattatcactaaacattgagtatatgtcaggccctttgccaaatattttctcctgtacatttcatttcatcattacaacttatgatgtggttacttttctccattttacaaattaataagtacagcattcatagacactaatcagtaccctgaaaagtctctaagtaataatcaccgaagtagggattcataatcaggctatgagaagacagcattttatctcttttacagttctgttatcctgggtgagaacacaaaatgctgtaagacttccataagaaactaacactattatttattatactatttttctcttgattggtatttttcagaattcagaaatactaatatattgatttttataatctagaataataaatttaaccctttgaattaaagttcatctctagccaaaagtcaatctgtcatttttaaaaacctgctaagatataggatgcacacacatacacaatccttcatggttgtctactctaaaattatggatatatttgcagatatgcttgaaacaggtgtctcaaaactctcttcaaaatatctaagtgatagccatatcaaagaaactacttaattaattaactattctcagtgagtgcactttaaattggaattttacatgtatatgtttcccagtaagtttgagataatgcctgttatttccctgcctgtgcttatgtacatttctcccagaaatactaaagcactgtgcagtcacattcaaaattccctttcttaacagacttcattaaattagatgctaaatttatttatatgaaataatctaggtgcaaaaaggcaaatacttcattatcttatttatatttggaatctaaaatagttgaactcatagaagtcgagagtaaaatggtggttaccaggggctagggtcggaggttgggaagatgttggtcaaaatgtacagaacttcagttttatgggaggtataagttcaagagatgtattatacaacataatgactagagataatctatgtattacattcctaaaaattgctaagaaagtagatttttaagtgttctcaccacataaaatgacaagtatatgacataattcatatattaattagcttaacttagccattccaccatacatacatatttcaaaacatcatattatacacagtaaatatataaaaaataaataggtaaatttttcaaaaatcttctttctcatcacagagttcatgaaattaagattctaaacctcctaagatagaagggcaacttaaaccgcacaatccttcagagagacagaatatgatttttcaataggtcactctagctaagaatggtaaagacaactgaaaatgtccccattcagccagatatgagaaaattcaacgaacaattatattgcattttgcaggttaaatcatcttaatagaattttagtcttggaactattagagatgtgaaaattagagacaaggactccctttttcttttgactagttttgcttccatcgtccttaaataaatatctaaaatatttaaaatatttatttaaggaaccataattatttaggacttaaatagttaaacttttctgttacttaagatttcctaatgtaaattttaaattaaatattcatcatacctccaagtaagacttagaattagaaataagagataagagctaactggtgcgaaacgttaaaactcttcaaataaatttctgatactagaactatggttgctaggtgtccagaaagcaacaaacatctgcttcgagctgtttaatatctttgaagcaactccatatattctcctttactaattcccctcacattattataccaaaactaaatgtgccgtcattttctgttttttaaatatcttttaatcattgcactaactttgttttccaatctgaattgccccttctcacagttgcctatgtcactcaaatgcaatcttcatatttttttcttatgtagcaattcagacatgatctttctattttcccattcttctcttaattgtagctattttgtatacatcctatagctctcttaaagtaaaatctatgccttattaactattatgtttctcttccgactgagaatagtgccttgggaattctaaatctagaaaatatgttttatagaatgagtacactctgtaaagtataagaaaaatatttattattttttgataaaatattatatactgattacatttcatgtaattccaaactcttaccattttgtcttttcaaatataagaataaaagacttttgtaacactggtgatacatcattctatcatttttaattggctgagtcaacattctccatcatgtgagaataaatgaactgagttacttttatatgtattctaacttataagtaaacatggcacatatgaacactgagctacactggtctgtactataacgtgaaaaggcctgaatatgaagatgtgtgatgtctctgtagtatagaacaaaaagcattagacttggagacaaatccatgaaatttgtagcccttggaatctcaattttatcagtgtaacatagaagtaattatatctaatctgtaatattattgtgataattatatcccatagtattttggaaagcacctttcacagtaccttgctataatagacatattgggaacttacatatctaatttcctgtatgataatttttcatgaaaaaatattgacaaaagggcattttatatcttctttcttattgtgtttattctttgcattggagtaataataatgaagcacattggtgtggtcctttccagtttttagttgtcttttgtatgtagctattcttcacaacagcccactttctgctagtagtgtgtacatgttcattgagttggacaggtctgatgaaaatacagaacattacttcacttaggctgtttgctttacaaattttcttgataagtgtaacaagcacaattgcacatctttaactgatatttagaagaaatcaagtaaaatataattaaaaattatgagcattgattggtctattgagtcaacccattttccattatcaccaagaaatattatctctatccttaataacttcatgagcttcttccttggtgtaatctctgactattgcctctctacaacccattctttacatgtaagataagtgatgttttgtagtacaagctgtcaagcttgaaacttcactatagatttctagcacattcataataaaagttaattgatacagctgactgtttgaatctatgtgaataactcctacatgtatcaccaaactcatctctacctctcctctctctgcctatgtctcagaaatattgaccttctttctggaaaaaggtcccctggccttcatatggttggcccctttttgtgttttagggccttaaaaaatatacttgtatcaaagaggtcttcattgaccaggtaccagtcactctctattatgctccttttaaaattgtcctcaatttacttttgtatattttctttctttgttaatttatgggtttattgtttctgtacccctctaaaaatatggttccttgaaaagaagaccttatatgatttttatctttatatcttcagcataatagtgcatagcacataataggcactcaataaatatttattaaaggaattgtcaagaaatgcgtgtctctcattaaatatattagcctgttttcttaattcaataaagaatccaacgcatgccattctgtgggaatatcatactatcattttatgtcccattttagctttggtatccttcttgttccttaaaactttggagatgaaaattttctaaatatctaggatatacttttccagcttaaagggtcatagaaaagcattattcacagtcatatttgtgccaattacactggcctttccctgctgctcacagcatctgtttctttcagggactctgctcctcagcttttagcattcccagcacttggtctgttatttatttggaacattggtttcaattagccatttggatatttttttaaatcgcagtactcattatactttccgtatcatcccaggcagtttctcattctgcatggatcctgctcttgactcttaatgtggaacctctggtctgatgtatttactttttcagccttttcaaatgtgcattccagtgcagaagctctgtaatagtgattttcaaactttttcatctttgggatgatcttgttaggggaaagggccaggaaatctacctcatttatccccacatgccactgtgtcacatattttttcttatagcagcaaactaccaccttcatcaactccctacacaaaaacacacacacacacacagaggcacatacacaagcacacacacacaggcacacaaacactacccattgacagtgaagtgatttgttttaaatttaaatcagatcttcccttctccattgctgacttagaataaatttaagtaaataaaacccaaacttcttacaatagcctacaaacctgtaattccctaatacttattattcagtcactgcctacttagacataccatgctgttttcttccttagatcctttacatctgctcttcattctgcgtggaaagttatgccctcaaatcttcccatgagggacttgtttttcctcatttttcaggagtaagcaaagatatccccttctttgagatgatagaccaaggcgaactaggctaccctcaacaacccggatattcacaatcagggccttctatttatgtcttcatgtactaacatttttgaaatcaccgtgtatgttttgacatttttctttcctatctctttccttcgtgttatcattttggcacccagaggaattcctagaatacatccaacacttaatataattgtagaaggaaagaaaaaaagatagagggagggacgaaggagagggagaaagaaagcaagagagcaagcaaaaaagaaagaaagaaagaaaaaagaaggaaggaacgaagacatattaaaatacatgtattatataattcaattaaattctttattctcataattttatagaccttaaacattttctagcccagtgattcttttctgatattttctggaagaataatgaggatctactattttgattattgcaaaaatgcttaatcaaaatttactcattacaggacctcacctgctcactaaaatatcaacttcctttacttaacactataattaaattaacactgattgttctttctcatgtgatatacagctcatctaagaggtggtgtgaaaaatgattgtaagtaatcatactttgcaaaaaaacgaaagtacctatgtagtcacatcattacatataacttttaattactaaacatcacttcactgggttgactcaaggaaatgcattataaaatatttatgcttagaaatttagtatcacataataatatttttgtgtctcatcttttgttttctacacaacacacttcagtttattttattgactgactgactgactggtatattactttttattgtaattttgattccaaggcacaccatattgaatttcattttaattaaattctagaatttactcacctgtacataaactgtttattctttctatcaggaaagcaagaactgcacagattcggtgatatttaatagcataaaccatctttctgaaagaaaaattcatttttagagagcatattttgcaatataatccaaaataaaatgcatactggctgaccatttttgcacatgtactgtagttgactacacagcataaatgggggatctgagaactcctgatgtcccaccaaatccttcccaatctcctagctagtgactgaaattctacaacatgagttttatcctcttatgaaatacctacattgatcttcctatgaaatatgttttacaggaatatatatatatatttaattcagcaactatatatatatattcagcagcaatatatatatatttaattcagcaaacaattctacatatcattttgaaaataaatgaaaaatgattaagtaggtcctcataagtatgaaattggaaaatagaaaaatgacaaatggagtgaatgaatacagacagataattattatgggttaaaatttcttctgtttttccatttttctttagagatgacccgaggtaatcacatttaggaacaacaaaaattttactttttaatttcaggattttaaaaaaatgttttctatccacagaaagaaaatttatcttttcttttaagaaacacatttggttttcagaagggaagagagaaatgtagtggtaactacagtgagtggagttggaggactgtgtctgctggcattattataaagtccatatgggttctcatggcttgtgtcataatctgctgtactatattctcataatatgctctctacttatatttccaagctaagtttctgtgatattcctgcttgcaatttatcctttacccatactaagtggtctttaattcctagaaactaacaaaatctgtcttgtctcagggtgtttacaatacaggcctctgtttggactatttacttattttcttttcaccttggcatttcctattcattgttctggttttagtttaaacataacatttttcacaaagcctctgtttattaatttgacccccaagaccagattagtgcttctattaaatacttccgtaaaactcaagcatttaacccattgtttcagttaaacatggcttgtgaaagacaagtcatgtattagaggcttaaaacagaacgcttcattatttctcacaattctctttgttggcaagatgcttttttgctcgcatgtgtagttacagtcagctagatagttgactatcatagaaggtccaatatggcgtaacacagttttgtaaattgggacacttcagttttgctccttgtgccatttatcttctggtagccagacatacttccttacgtggctgtattagtctgttctcatgctgctaataaagacgtattcgggactgagtaacgtataaaggaaaaattttaattgactcacatttccacgtggctggggaggcctcacaatcatggcggaaggtgaatgaggaacaaagtcacatcttacatggcaggaggcaagagcttgtgtaggggatctcccatttataaaactatccgatctcatgagacttattcactaccacaagaacaagaacagtagggggaaaactgcccccatgattcaattatctccatctggcattgcccttgacatatgaggattattccaattcaagatgagatttgggtggggacacagtgaaaccatatcagtggcagtttgaggaaagcatcccaagagatccaaggtggaagctacaaagaatattgaaagtgaagctccagaagtcacacatcatcccttttgctgcactctgttggtcacagcaagtcattaggacatccttacccaagtgggtgggaaatagactccatctcttagtagggtcacacctactctacctcttagtcaagagtcacaaagaatatgtgaccatatttaatataacacagcaacatagtacaaacatattctgttatttttgttaattgtttatccctttgttcacgttatctcccatgctcaccattgcattctatcatgtaacaatagctagcaaaaggtagaaactcagtatgtagtattcattgaatgaaataaaatattgatgcaaaatattatcttggctaaaaataagtattgtttcatagaaacataggacacaagagactgtggaacatagtatagagaaataaagtgaaatgcccaagtgataactggataggaagtattgtgtcaccaagattaagaaaaaaatctgtgtaatctgacagtctgagtaaaagtgccatatatcaggtctttttcttaaataactctttcattttattatggttttagctcaaaaatcactttgtgtttcactacctgctgttttatttatctgttcattctttttgtctcccatttgaatgtaatatttcttaggaaacacagtgtctgtactgttcacctctggatcatccagcctctggcataaactaagcactcgacaaattcttgttgcctaaaattctggaagaatgaataaatgacctaagacaataaatacttgttgagtgaatacgtgaatgaattacttaaatcaacttatttacccgcagctgtataaattttcatggtacctgctgcctacggttgttatgattattatatatgaattgcttatcatggaatatgcattaaataatgatcaataagtgttaggctatgattattagggacagtggggaatagttggctgagtactaatggatgcctgagtctctggtgtaaatgtcctcatcataaaacatccactctccatgaaaaattaaattgatgtgtgactgggaaaaaagacgacttgcaagaaattttctgaagattggagaagactttgttggtaaaagttaggaaccagaaacttgcagaatctttgttcatgcccaaaggtggcaaaaatgatacacattagcaacatagtaagaagccacaagtatgataatgtgagtcttgtaactattgagcagcagatactttgcaaagatgagtgaaattagattactaagaactgttttataatagaagaactcaaattgttaaaagacaaaatagaacatagaggtatcaaacttcacccttaaactaaattatttaaacaagcaaaaataagctattgagatatgttgtacatttttaatgcatttacacattaaacaggtgtgaaatttaatccacagatgtggataggcaagaagtgttactttgttctcttaaattcaaatacatttgaaagcccctatcatatttgacaggaaaaacattatgtaggtcattgtggggtgagggtagaagaaacatttggcaccttctcttcccttgatttgcgcaagaatccaataggcctttgtagcgactagactatggggagaaagccatttagtcatcattgtccaaacccatattttctatgaaggcagatgaccctcttctttccatgataagcctgagtgaggaaatcctagccaaatgtgagaatacagattcctagacccttctattttccttagagatgatgtgtacatcatcttcattgcttctccccaaactctaacacctccccatcattgccctcctcttttcatttggtgtactttcatgaaaggacctagactctcaggaaacaaaaactagggagggaatatagagaaaatttccctttgagctctgcatgaaaatcctgccgagggaattacaggaggacctggaggcaatcaggcctctgttgagaaaggaggtgatggaaaagaaatatagtgaaaataaaacataagtaaataacatattgactcacatacaagtgtttacatgctatactgtattggggaggctgcataaaggcactgatttcacagaagttaagatcattttgagactgtgcaattttggtccatcttttagctgtgccagttatagctatgtgactcagtgtatgttttgaagcagctctgcgctttatcattattagctcataggttacctttaaggattaaatgaataaattagcactatgtctggcaaatactaagtgctcaataaatgtctattgctttttatgccatgttttaaaaatatttttggtatctatttatttaaagtaaacatattggaatgtcaaatacgtttatagtgtcttaatcatctcttcagaaatgtggagaaatacaaaggtatcttctcacagatgactgaagcaagttttcattacctttataaaggttaaaagtatacttcaggaaaatgattgaatattcatcttcatatctgtaattagaatacagcaaaattatctgggtggatataaaactattagatatttaaaactacactaatgattaaatttttttgcattaatattgtcatcaaaaattcaaaccaaataatatgcatatgatcttgataaaatagaacactcttactttaaatgccttttcagagttcagagatttctttatgtacctgatatctctccacatagttatagatatatacatatatacacacagatatatagtctcatatatgctagaggaagatgagggaaactcatagaaactatctatatttatatctttatctacctaattatctatctattgagaacattgaattttttactttccattttatattttctattacctgaataaaaaaagactaacaggtcaaaaagtattactcgatattgtgaggttgggtaaatattcagtttttgttgccacttacggtgtctgtatataattcaaagagcaataagttcttactggaaatatcttccattcaattttctatggattgaatcattattcagaaagctgacttttttatatgtaaatctatggatttaattctcaatatgaattttttcctcaagtatagaacatgtatttttataatgaatataggactagagcattcgatggttttaatactaaaatggttgaagacttaaatatatttggaataaaataacttagaacactatattcaacttgccttctttccgtttctcatttaataaaatgatgctttcatgagttttgcctagatgtccttgtgatgtcatcatgcccattctctgtcattccaaaagttttcacaggatcaatcaaataatacctacattgaaaggattaatatttgttactagtttttacttggtatgtagaaaattttcagagtttgtaagtctaaattaatatcaaggtagagtttccagataatatacagaatgcccagttgaattttaatttcagatagaaaagaaacatttttatacaggatatagttatactaaaagcaaacaaaataacaaaacaattgttgattacgtgacatttaaatttaactgagtgttccatattcttatttgctaaatctagcaactctattgcaaaatactcagagtcatgtggttgaagcagttaaatgtttgtcttgcttgtagtccagtagtccccaacatttttggcaccagagactgattttgtggaagacagtttttccacagatcgggggtggggatggtttctggatgatccaagcacattacatttactttgtactttgtttctattattattgtattgtaatatataatcaaataattatacaactcaccataatggagaagcagtgggatccctgaccttgttttcttgcaatgaggtggtcccatctgggggtgatggtagacactgacagatcatcaggcattagattctcataaggagtttgcaacctagatctcttgcttgagcagttcatgctcctataagaatctaatgccaccactgatctgataggtggcagagctcagtaggtaatgtgatcaatggggagtagctgtaaatacagatgaagctttgctcgcttgctcaccactcatcttcggctgtgtggcccagttcctaacaggcgaaggactggtaccagtccgtggcctgggggttggtgacccctcctgtagtccatgtagctctttaataccttgtccacattatagcaagaacattctctctaaaatgccaatcttgttatcagtctcatgctttatgtcctttagtgatgcttcattttttcaagttaagttgaagtgttttggctcttcaagtctcggtgcctactatttcgttttttcattcctgccatgccaaataatttgaagttttctgaatatgtcttgccttttcccctaccgcacctttttctaatctgctacctctgactaaaatgttattttatccctcatgtatcagggaaaatctgctcatcctttaagatcaatgccaatgtctcttcaactagaaagtcttcctggtttgtgtaagcaaatctaaggggttccacagctgtgttttcctagttatactgtatcctctattaaacatatcacattgctctggttattttttaaatagctattagactgtttacttgaaagacatgggtgaagattatctatctatctatctatctatctatctatctatctatctatcataatctatcatgtatctaaagtataatagtcatttaatttgtgtttgtgaaatagcaaggatgaggtaaagagaagatggaatgtaataccttttacagttaggatggtttagaatgtgattgaaacatagagaaagaggaaaaatctccattctcattggtgtagaaaaagtagggtattagaaagattcatgtataacatttgcattttttggaatgaatacaagatagggtttgttttttcaataggtacaaatatgtaaagccgaagtagtttgttgaatctcttccttcatatttcacccattttatttctgtctttccaaatatattctgttctaaatttgatggaatttctttctaattaagcaacagacttatctgtctctcctccagggaagatttgagtgaaggaagctctaattaaccttctaatttgtatcaccctgaggatccaactttctacttctagagtagaaagagtcaaagacagttggcgagatattataacattaaaatatatgatttgtgagattttattgatcagatagttacattttatggctaaattttaacatcatctgttgccttagtaaaactaaagtaagcacacttgaagtcaaatataaatgatgtatatcttggtgttcttacctttgtttattgatggtattaaaagacagtttttgtttgttcttttttacttatattctctaaatgaaaggtatttgtgtaaaggaaattagcataataatcacataagaaatacatttatctctaaatatggacaaatataaatatccaaatatataattatatgtaataccccatatataatattcatatataatatatttgcttttagggcaatgatagctttgatgatagactatattcttatcatttctgaagttttttttcccctccaacatgctatttttttctaagccaaaattggtatttattttcgagaaaataactccttctactaattaatttgctgctacagaataccaaatgctctacaaaatgtctgttgcaggaaagtaagacgtttttggcctgtgtttcttattaggctactttacttgagcgtatttatgcagcttctcaccagttgctcagcaaccctttcacagtcaacaccataatagtctttcttccagaatggcagcccttcctagccacccacaccttctttacaccagacctgttaataatgaaccctattcttccagttatttaacaatcatatggatcagatatcaacttatgataaatgcctcaataaaaatcactaaatggtcttatggcaaacttcacacttctccccaaaacatgtatctctaaaatttccccaagtatttttgtaagggaagaaaacttaataataaactaattaaagtggaatagttaaacaattaatctagtatggccctctatcaatcaaaaagttatttgtctggttatgagagaataatttttttgggcaatacttaattcttaagaacatcttttaacaccattgaggtacacagagagaaagatgtgggggataagcgtagtttcttggttccattaaatcatatcacatacataaaagcaggcttatgtatattttaggcattaaagaacatctacaattaatgaaaaatgatgacacttccataggtcccaaacttaaaggccagtcattgtggaagaaaacaaaggataaacagagatacattcaggtagtgaaggtagctgtgacccagggatatgatgagtaggttaggataaagactgctcttattttttctttcaataattattggtataaaagggaaccccacccacaaattttctttacttttctcctttctctttcaaaataaacaaatactatcattataaaatacaggttttgggtttttggaaagaatattgggagatagaagaagcagatggggaaatgatactcttatttgagaaaacataaatgaataagtaatttctgtgtgtcggatgtttcttcctctttttcatacctctattctagcacatgaaatataaaacaaaagtatgttataagtgtgttttgcattatttggatgtatctgaacagatccaattctttacttatgtttatatcctgaaaaataaattttgccatcattaagtattaattaaatacaaaacttttatattattcagaaagaaggtaatatatttagacatttttactaatttattctctcctcacatatatatcaaatattcagtcagaaataggggataaggcctctgtaagacatgttctctgctttcaaatgatattaataaggcaaggattgtcagagaaaacaagggtatgaaaatgaggtgcttctgacatgacatcttgcaataaaatattcttccatgagagctgccagctgttccacaagattttacgtggaaatgaatgaaacaagtgtgtgtgacgtttcattttgtttgtttaggggaagcccagaatgacaaatgcttttactctagttaagagatgacaggtgtctcaacaaaaagatctaaagattcaggattctggttgatggttgtacaaagatgtagaggggcatcctattctttctcttattgtgaaatgtaacaatgatgccatgattcttcttttaaaacctaggtcttcaacatttattgtcagttttgtgaccttataagactattatacttagttacttaaaaagaattcagtttgtattgtgtgaaatttatttctgcaagtggtgtgtgtttttgtggatttgcatatctaaatttaaaaatgacacctatgatgcacctctacacatcggagaaacctccaaaacgcatgaaaaattaaagtgatactactttgaactttaattctacaaatttctcttaatcaactgggtgaagcaagaaacgatcttttgagagagagatactattttcaagattcttaaactctccatttaaaatagcttttctctagcacactcttattatattttttgtactaagaaatgagatgtctatccattctccttcttagggtaaaactgcaatatttaatataacattcatacatttatgtgtacgtattgttttgtcatggttcaccaaaactgtagtctccttaaggctttctaaaagttttgatatttccatatttcatataaaaaggtatttatggttgcttggcatgtgtgtttattaaaatttctagcaattcataatttgagatccttatcttgcatataaacattgtgtaatagtgtataatttgttaatatttgttttacaattattaatttagtcacaaagtgattttagtagatgtaccactacatttactgacaaatcttactatcatcagtttcagattgaattgcaaatatattatttatttattcattcattttgcatattatttcatcaaggccacttgtacatgataaatgacagcaaatccaaatgcaaaatttaatactggtttcctatttaacgcttataaactttaacaaaatatataacataaaaataaacatatcaatatgtcagtaaattcagaaaggtgatatgtatttaaactcaattatatttttaaattagtatttacctatttatttattcttaatcttagaaaatctgttacatgaattactgaattttttcttacatcactaagatgaacttctttttactttaacctctcagaaatctgggcacaagtgatagccaattttgcattgtcatttcataatttaattgctgcagtttttttcttagatatgcctcttataatcaaggctatattgtattattgagtaatatattttaagattttaatcttatgaagtttcaacataaatacagcattttaatttgaaatcaaattttataagatcaatgtagatatacattttttgaaaattataaactagttcttttccaggatttacttaaaattctcctagtcagaaagatatttttatacttaataacagttaatcaaaggtaaaacatttctatttcccctacagttttaagggctactttcagttaatccatctcttttctaaattgcatattcatagtttgcacccatctaccagtttgaactgttgaatactatggtagccagattttaaaatactgaaattaataccttttataatgcaaaatatttcaattattttcgcaactagcatacgcttaatgaaaacgaaatttttaaaaatgtaacaaatcagagctttgtttcacttcataccctcgtattcaattagttcgcaagtgtcctcatttattggtgtgttttcctataagtttcacagaagtcatattaaagaaaagaagaaaaaaataacaaacattaaattacatatgctaatgactctccaaatgatggcttgaatagaattagtcgtagtatttagactttatgttggtgttatttgtgtatatataatttttattttagatgttttaatgttaaacatttatggcattttactttattacatatcacaatgtcacaaaattattattattttgttaaatttccattcaaatgtttcatatgaaacactaaaattaaaggaaggaacagaatatattaaactaatttatgtaacataatgtgctaaacataagtacctaaaaacttctttgaatatgtagttatttttacatgttcttatatattttgggtcatccatgcatatctctagcaatatattctgttttttattttggtaatgagttagagaataattacaaagaaacaacataaaatttttaaactataggacaaaaaatttaatcaaaatgaagttcaaattctatcatgaggtattatttggtacatattttgttaaaattaataactttcaaaaaatttttgaaaacacataataaaatttcaaatttaacattgtactattactattaaataaaatttcaaacttatatgtgtaacaagtgattttccattatcataatttcatagatgacatatagttatgacttagtgaagcatgtttatatatgtaaatcatttttatttcatttttgttagtttaggaatattttgttaaatagcattattaaaattatatttcagataagttcatattgtgaacgtcttatttttagatttttctcaagtaacttaatgacaggataatctaattgtgataagctacaccttgtatatatcatttgatatcaaatgaagaaagttttctgaatgtacgttttcttcctttgagttttatgtcttgtaatatatacatttaactgtgctgtcagacaatgcttacctaattgtgtagcatacttaatttttttcaaaaatgaaagtaaagtatccttttaacattggatagctatgtgtatatttaatattgaattattgctatacataattctaagactttttccagcattggcaattacttaataaaatagttgtgtattcaaaaattttgagtatttttaaactgttaagtggtgaatcttgacaatttaaaaatctgtgtttcatacactgccaatttaaaatattaccaatatcagtatttcaaaccattaatattaaaataaaatggtaaatgcaatatatgacataactgtatggtaatggatgactttattaccttaaaaaggaaatcagtgttatttctttatagttccactatatgtatcaaacatatctaagtttagatgcatttatactttctgtaagcatgacatatatccccttttaattctacacaacgttgaatattctaagtaaatctattttatactaacagattaaacttttgttttggaaataacaacaaaaattttgaagtaattattacttatgcaacttaatcttcagattccacactttttcaaagtgatgtttttgaaagttaaaaccaaaattttatgttccccctgctttgaaattgctcttcattcatgtcactgtttgaaatgcgacttttgcatggtaacaattataatcatattccatttgtgaaatgtgtctttttattattgctaatattattttagtcctattgaattcattctttatttattatttcttctgatgaatgttcctggagcatctactatgtgctaggcaatgttctaggagctagggattcagcagtgaaatcaatatacaaaaattttagccttcagggagcttgcttcccagtatggtgtggaaagaatatgaacacaatatataagtaaaacataagaactggttagtaaaatacctggttggaatacatatctggttagattatgattattaaataaattctggggtttaatgctttatttcaaccttaaacactgtcccaaatttaggttaagggaatagtactgaatcttcatcaccgttggtgggaagtatagctcttatgctaaatattttaagattgggactgctagaaagtcctgggtctagacattaccaaagatcagttctaactccaaaatttggtctggaactgtgtttctcccctgaggtcttcaagaaagtgagtgtttggattgggtctgcaggtcttgagtgattagagaagcagcctaagccccctaagcctgttcataaggattatctcagatttattgactcaaattcgagggattatttgagattgatcataatgactctgatggaatatgataatttaatccatccctttggtaaaggtaggcgtgctcagacatgtgacatagtataaattccattatttctcataaatttagcttataattaccaacatatgtttatagttaatagtttcttttattaaaattaaacctgaaagtctgaaaattatgatgaggttataaaaatattaaagcattagtttttactctgatttcatattcctgtcaaaaataaaaaggctcaattaaactctaggaggacaatatggatcaggtttcatagtaatgagcacatgagctcatcatgatgtatgtatgaaactgcacatcacaaatgtacagtttaccatgagttcaattactgtattttagtagtgcaagcatagctattgcttaaccatgtggttaaaaaattattatcaaatattagctgactaaatattgcaacctgatttatataaccaatgtgaacttagtagattctgatctatgaaataggttattcacaaaacaacttggataaatattcaatagaagctatctgattcatgcttaaaaacattaaaatatttaaaataatttgataatcgtcatacctcatttacttttggctctttcaaaatacaaaaatcatttaatacttctgaatttctagaatcaaattcagatatgacgactcaacctggaagaatcaggggcagaaatgggcttttctgtttgcctgtgagtgaggggctccaggtttgacttcctttcttcctttttgaatttaaggcagaaagcagaattattagtcctactaatcacctgtctacagcacaagaggaaaataaaaaaggcagagtattctcaaaccatattgacattgcttttttttctctttcagaatggttaaaatatccctagcattgttatctaaaatatctaagtaaacattgctaacagaattttgaaatgttgcgaagaaaagtgtataaaaacatataccactcaggggctttagaaaatattcagaagttttccaaccgggatctgactatgattcctaatgagtagctgcagctccaaatttcaatattttttttggttgttgctgttaaggattttagctgtcaagatccttttaaatatacccccattcaatttcatgcttctattataaagttacttttttcattatataagtattatgaactaccatgaacaacctcctttaaaaaacattaaataaaatgaaaaagcaaactctaatttgacactttgaatacatacttctaaattattaaaaaatatttaattagaataaaaatgtggtaatattatacacacacacatgcgcacatatacacactctgaaatgcttatgagatatttagaaattcccaaccaattgttaaaactagcgttgtgtgaattaaagttacgtgctgtataataatagttaagtttcaaccacttccaaatttcataatttgcttaattttaattagttcagaattggttaaactaaaatattacttaaaaatagtagaaagtattaactaatttttaaaaacttgataaattctaaggtacttagctcatcacaaatgaggttaagaaacacattttcatatagtggttattttagtgccccttttttttcatcatttgttttcattttggctttgattttaaattctcttttcttcacttgcttgtcttaaaatagaaaattttgatatttttcccagaaactgtgaagagatatggcagactattcaaagcatacttttgagaaaagtgtggttacatagttacccattccatcaaaacctgacacttgccaggcattcgttgctaaaattcatctgtagatttttttaaaagattgattcagggccacataaagggtttacccttttacctgctctcttcaatgtattacagttaaaatgtggtatattttgtgtgtatatctatccataggatggttgatagaaacaaaccgacagatctagtgcgcttcacaatttactcgcgtgtttgtgttttgcctcttcatgttgattatccttaaggtaatagaagagaatatgattgattaaatttatcagaaaaaataaacaaaatttaaaaagaaaaagttagcatctagtgctactgtgtcccacaggttcttctacattgacccacactacctccactggtgagttagaggagcataacaggactaccactggtgctattgctgttgctagcacacctgcagatgttactgtatccagtgttacagctgtcaccatccatagactttccgaggaacagcgagtgcaagttacgagtctcagaaattcaggtctggaccccaacacgtccaaggacgggctctctcctcatccagcagatacacaaagtaccaggagaagaccaagacatgctgaacagatagaaagaactaaagagcttgcagttgttactcatagaggtattggatgttattttacttgtgcccatttagttacagccaaagctatattttggtaatgattctaattagagaatgagctgaaagagagccaagatatagaaagcaaaagaaaaagttcaaagtagctgaaaaatatggatagtaacaaccaaaactggaataatttgaaagcatagaaattgaaatttaaaaataagtcaaagtgcaatgcaaatgttggagggggagggggtaaaagtagaacagaaatcatttttaaacaggacagtaaaaacaagtaccaaatacttattatttattccataccagttatgatgatgttcacaaaacaggaaaataaagtagccagttttgattaataagtgcatatatttacacatagatgatttatcccatgtagtaatttttagcgtttgcatgatatttttatgttatgcaaatgttagttagtacttgagaatatgtacagtttgattgggaaacatagaaacattatatctggtgatcgttttacatagcttattctttgcctgacccatatgattgcattgaaagatttctcattttgaaaaggtaacagctattcattgatagtatgcctccaaaatttaagtattctttaaatgtctaatttatttttagagaaaaatgacataaaaccacatcttacattggtaattttctactcagttaatataagcctaccttttacaaaataaggaagtctagaaaatacatttttctgtttcttggtggcaagtgtcatagagaagtttaggaaaaaaattcaatgtagtataaaataataaaaggtctttatttatatcgatatatgtatctgtaagaacattaattaattgaacatatttcaagtataaaatatctactacatttccaagatatcaaaatattttctctaaactggctatggtttttgcagtgtgattaggcatggtttatacagaccatgatttaagtaatggtctgtataagtattgtgctcaatacttagagcacaagaaggatagaaatcaagacatctttacatacattaattaaaaataatacaaaaatatctcagaagtttgtttccattcgaatttgtactgaaaatacttactttgattctctttaatgaggcacattctaaaatgaatttttaacctataatagtcttctcaaaaagattaaatcaatatcaccttgattctatattcactttcctattataaatattaccatttataagaatatagggaccgtgttaaaatttgtgatttactcaataaagtaaacagtttttgtcttattaccagaaaatttaaataggtaaaattatattaaaatgttaaaaactattttttcattctctttggaaaattgcatgagctaatattggtaggctatctggaaattattttattacccatcatatagaaggaggataatttctgacataagtttattgtaaaaccaactaataatacaatttctactttagccaaagtttgccgtcaagtggtgtgataaactttgtggttataaattaaaattttatgtaacttggaacaataatgcagactgaaaatagaaaagtttaatagtcaaccattaaattaaattaaatacttttaaggtggttccatataaaatgtttaagtttcttcaagtaaattttaattaagcttcaagagtacttcccgggtagattcccaatcagtgctcaaactttctccattattatcataagctcccagtgctgtttgagagattgatacctgttttacctttccccatattctttacaaaatggtgattttgaatttaatatgcattcagtggtgccatgtaccttggaaatgtattcctcatttatttttcaaagtagatgtaaaacattatatggaaaacatttttaatgtattcatcattattgacagtgacttaaattgttatacttttatcaactttctactttaattcaaattggttcttctgtttcttcttcaataacttactactagttcagtgattttggtttgctacttatctattacactctagacacaatctcttaatattatgggcaaaaatattcatcaatgttaagagtaggggaaacctactattctattgcttagtgttttctgaagttctcaaaatatagctatgctcttagttatgaaactatcttctaagacttgattaccagcaggtccaaatttctaaactggaaatggctgacatctaactagtattatttttaaaataataattttggctcagacacatgcctaaaatgcttactcagtaccagattctgttctagaggaaataaagataaataatgcatgtccccttcctgcaggacattgcaatagagtcgaggacatagaaaaacccattctagtggtacaagatagattttgtaaaatgaattctgatcaaagtactaaagaagttacagtgtgtatgcagagagtgagtcttttaagttactttttcaatgagttggtaaacaaccgaaaaccaattgcttaatttttttagatatttcagaaaaaaacttattcctctgatctattatccacaatatagttaaaatgaacttttacaaataaaaatccagtcgtataacactactcttttaaagctttcagtgattaatcaatgctcttaagaataaagcagagacttggtgatgacccacgggaaactgcatgatctgacttttttccatatttccaaattcatcgcatgtaactctcacaatcactctattattttgcaaaacacaatttattttaattagccaaacactgtattcttttctccctaaggatactctgagaagctaatccttgttccttttaaccacataattctaatttccaagatttagcttaaattgttacctctaggaaggttagatattcctcttataacttgccattgcagcttgcatttgtaatcatcagccctataaattttcctgtaaaatttaagctctctgaggataaggagtgggtgggttttattcatgctgcattttcagtacttagtacagtttctgaccaatagatattttttaaaaaatagttgtcaaactaatgaataagtgtttataatttcacttgctagaaaatttacttaaattatttaaaggcttgaaattaccttcttcaagataatgaaatctctacatatttcagtattaaagataactacattttgtcacagttataataccagttttttttaaataaaggcaacaatattttcattaatccataataatatattgcttttattgtattactggttcaaaattcacaaaatggaactggatataaaggccttgcttttagcccttgaatgattataaaatcaaaataattttataattaaccattagcaaactataaagtcaaaaatatcctatgaaaaaatattctactgaatattattttgttgaagttaattacagtgtaaaacataaatataagagattactatagcataggtccgttcgatgtctgcaagttcatgctattttgcagtatgtaataatttaatatttttaatttttttattcacattccagttaaactttcagttttatgtcttttgatcattaatggttcccagtttatctgttttcataaactggggcatgtattaataattgacatcaatattattatgaacacatagaaacatggattacacacagtattttgtacttaatgtgtacagactaatctatgtgttaattaagtgaattaacacatagataaattaaataaactcactataacttttatttaaataacaactgtaaaattaatgaataatctggaaaaacttaaaatatttctcaaagatattttcaattctttatagggtaccattccaattaattttcctattgtactatagttaaaacatcaacaatttaaattatcttaaaatttttattttctactttttctcagtagcagaaaattatttgcagtctcctccatttgaagattctttgcacgttgagataaaaagaagcaaaagaggaagaaaataaacaatgttggtttagatctattaaaaatgcatattaacaccacacctcactttgctgtattagtgtacaatagtcctcaaaatgagaacttaatatttttgactgcattttagtccacctttgcaaactactatgtgtgagagtttgttcaggtcaaatgaacaattatagctaaaattttatatttgcaaagtagtttttgtagtatcaaaatattacatcagggttgttataagcattaaacatagtaatgattggaagtgccataaactcttaggtattttctcccaatggaaagataaaaaagaattgcttactatcaactttgagttttggtcaaagaactaggctgagactatactctgccccttgttagctttatgatcttgagcaataagttcaattcccaaagtcacaacttctcagtagctgagaacacctgtgtcataggatggttgttattttcattttattcacaaaatatgttttagctcttgtgatgtgcatgacattgtactggatagcaggtacatgagaatgaacaatacaatcaatgccatagagcggtctacataactttaaataaaaaagaagaatcacaaatttattatgagaaacacttacatagcagtatttttgaaatgttattgaattacagtagagggactgacaacctctaaatatgagtcaaagagggctgctcagagaatatttgaactaattattgaaagatgaggccaggcgtggtggcccacgcctgtcatcccagcactttgggaggccgagacgggtgaataacgaggtcagtagattgagaccatcctggcttacacggtgaaaccccatctctaataaaaatacaaaaaattagctgggcgtggtggcgggcgcctgtagtcccagctactcgggaggccgaggcaggagaatagcgtgaacccaggaggcagagcttgcagtgagccgagatcgcaccactgcactccagcctgagcaacagagagaggctccatataaaaaaaaaaaaaaagaaaagaaagcaagctgaattaatgtttgaaactagtaaattatatttatgtcactaagacccattcaaaatggtttgagtgggtatttaggctgaatagaaatattagtctgcaacaaaaataaataagttgttttatgtttgaaggaagacatacattaatgtaagtaagcttaaaaataattgactttttatttacaaaatatccagatgtttaaaattagataacggatatatatctagtgacatttgtaaattcatcagaataatttactgccttagctataagatctcttttgatatcttttctttttttttttttttttttttgagagggagtctagctctgtcacccaagctggagtgcagtggcatgatctcggctcactgcaagctccgcctcctgggttcatgccatatttaagttaatatttaacttaaaatatctttttcaataatccctaaaccctaaagctcaatattacagccttaggaatttacctaacattgacttgaaaatagaagaacctatgtaatgacatgattttagaaataataagtaaattttcctggatttctagaattatctattttagaattaggtgggaacttacaaattatctagtaaatatcattattttgtggagaaaattatggactggcagaaactgtataaaaacccagtcttagactagtattgatagtcctagactagtattgattcattcaagattcatttagtgtctgatatgtggtctttcattaagtgatgttaaacttgaaataacagattataagcacaattgggtatcctttctcaaggagttatttgtcatattttattatgttaaataataattaagatgtgttttactccactgtattttgctttagcattacttttcttggagactttagtagaataatagaaattttttcaatatgtggacaagtcctatcagctgttaaagagcagttttgatagttgctgtttttaagtacaaaatttgggtatattcttctgggaacgttttcatatacacatataataattattattttttattggacttcccgatgggaatttaacttagataactacaacatcttatggaattaaataaatatatgttatgaggtttttatagacattactactgtttattttgacctagtatagtcaattatgccacagtacatttaatggtaatgatcatatcagtaggatattactttggttaataaagttacatgaaattatgctgaattgagattgaatatgatgtagacttttctcctccaacactagagcttaaaagaaactctagtttaacagtttttaaataagtacattatttattattcttaggtttaaggtaagaatggttaattcagcataaaacgtttattttaggtgagcaattttaatccaaagaagcaggaattttttattgttaccataatttatattgttttcaagtaagctcatctgaatatttataaggctcaacaaaaataagaaaacagcaaacaatcatacagatttaatattcacattaaattgccagtttatgtcagaagattactatgtcacaaatttgattcaagaactggtgtaacactcttttacatcaaaaactgcattgtgtgaaagtaacaatttttaggtgcttattatgtgcccatcactaataggctatattattatgcataaaatatattttaaatgttttcaagtgtttgcaagcaactaacactgttttcaaatattgtattaagacttttataaagtatgaatttctaaatctaaaatatgttgtttttaaaatcttaataagcatcatcacaatgagggagctagtttatgagtagtcatgtaaatatatttttatggatactaatgtatgcccagcaagtaatcaattatcagggttttattgtacatcttatctttcactgagcaagtggtgaattcaaaagtatattgcatagtgtttattcccaaagaaaaagttgtagagattagattacagagaaaaattataggtcaattataagagaaagaattaccacagaatgggtatggcatgtgaggaaggatgaggtaaaactgtcttgaaatgcttgatatgttgttctgtgtaagagagattaaatctgtcctctggcataggttgtagaatttagtgtagggaaccataagacagtgcaaagcagtttattataaagaagactgatttaacattcagtttttttttttcaaatatagattgtgtgctactagaagcagtgaattctcaaagacattcaagcataggttgtaatggacaatgtgggtatttagaaatcactaaagcatcaaataatatcttaataatatgattgccactgtcccttttaatcccaaaagtctatgattctatagagaaatattatatattaattaatgtatttaccatcactttatattccctactggtgttgagctgacatgtacttattttaatgattatttatagccagtgtaaaaacaaacatagaagtggccaatgctaccatcaaggaatttagagattaacaatctacttatctcattaaatgtgaaatcagccatatttacttttttttttctgggcccaatgcccacatctatgccttaaattcgaaaacttctttatttggaggtccagtcctagctgttcttttaggcagtgttatttctaacaacagatgacagtgctattcttactctcttcactaccacattctactatgtatttattcactcatttttctttattctttcttttcattttttctttgtttttcttttttctctttacttcttttcagtttttttctgttccatcttcttttcttttaatttttttttctctctcacaaatatccactgagtgccaagctgtcttccagttgctgggtatacagtattgaacaaaacttagtagaccctgctttattgaacttatattcaagtgaggaagaaaaagacaataaacaagtaaataattgtctgatggtaataagggctgtgcagaaaatcaaaataggctatatgatagatggattgctgccttagtttggatggtaaggaaaggactctggggagttaaaatttaaactgagacctaaacaacagaaagcagacagagatgctcttggagctatgccttgaaatttctcagaggagaaagcacaccaggaaaaaaaacagctagttaaaaaaagcttcagtttaacttgagaaaaataaaacctactaattcttgtactcagtgcaccaggaggagagtaaggtagatgaggtgggaaacataggtaggaaaaacaccatttggcttttaggcctcaaaaatgagctttatttttatctaaaccattggtggacattagcagggaacatatattatcaaatgtaatttttaaaggagtcactttagcatgaatttgaagaagaaatttcaagtgaataggagcaagcagacaaataataagatacagaaatgcaagtaacagttgatagtttcttggagtataggtcttatagtacgcttttcaaatttcattgtggacatgaatcatctagtagtcttgttcaaatgcagatcatgacttgatggaattggagttggatctgagatttcgcatttctaacagatctctaggtttgctcatacactgagtagcaagaacttagatgaagatgatcatcatggagagagaacaacatttatcacacagtcccaacactgtctattcctcataggattttgttctccactaggataatcacagtgttgacaagctatcttggataatatagtaaaaactaaactttattccatacgagtgactcaaatggtgggaaatttatgagtgcaagggatattttaaggcagatggattttctgaatcaatgttaatgacactaattagttttggcaacctttaagaatggctgagctattgacattcattatgattttactggaaagatcaataaaggaatagatgaataagaaaatcaacaccaagtcaaattttagctctaaattttaaattttactcaaaattctatactttaaaatggttgttatttttcaatgtatcaaataacaaagagaaaaatacatcagggtttagtttccctttacttaccatgtttcaaatccctgaaaggttgatagatggaggtaaaacagtaaaaaaaaaaatttttaaaaatgaaaaaaagaagaagaaaagaaaataaagagaaaaaagaaaagtatacaaaagttgatgccaaatcaaaaattctgaggagttaatctttaagcattgttttcttattttatatatatggtgaaattacctttgtctgcttgaattcccaggtctttatttatgagactaactaatgtatttattttaatagcatctttaaagcataactaataatagactgcagaatttataacttttaaaaaattatctggttatgtataattcttatagaattacttaattttattcattttatttatttattttggatgtcggaactttgacattggtaaagtgaatacaaaaaataggggaatgtcaacattttgggtggagagttacatacaaatattgatcattgtatgctttatcaatatcctgccatactttttgtttactttttccattgttctcttgactttccctaattatgttatttaatggaaagttgtgtttaatgtttatagagctatttaataattcatgttcagaaatgtaccaatttatcatttaaatacatatttattgaatagcatccttattttctatccattaccttatttcatcacatttttgaaattgtcaaagcaatgtcattcatgacagtaaatacatttttatatttctaattcttttatgttttgttaaataagttgtttttaagaagaaagaagagaaaaaataaaatgttagaatttacttgttaacgggtttatgcacatttaaaatgtattagataaaagtactcagaatgcctgaggacttgaatgacaatattaaacaatgaaaatttattttattcacaaatggcaaatctgcaagtaaccattttaacatttttatccaatgctacccttcaagccatgcttttgagttagtcctatgtaaagattttaagaatttctgatgtcaatgttcttatttcctttgagtaggtctttaaggaaacctatatatttttttcagattttcagccactttgtttttttcacctgtaaccgttaatcagatatcttgttagcttatttttatattaacacactatatctcatttttaatagaatgagtaaataaggaaagataataatatgtactgaattgatcaaaagagaaagcttaactttaaagatcagagatgaaaccattatgtgtgtagctgatttccccaaatggttaccagagcttcttttacctgtgaatgagatcgtcacagtgaatgtggcgtatgtgacttttaaatctttttctttgttaaaatattttgatggggctagactttctatttgtgctcaaagctgatgccaaagcagactcctctgccttttggaatatgaagaaatggtcctatgtagagacatttttatcttgttcagaattatttcagggcattttcacccacttttgcaacaagctgctttccttgcatgtagttttctagagcatatggctaccctgctgtgcgcagagtgaaaccacacaactaatctttacaattttaggaagagcagaaccttcatatgtggcagaacagcgtggtgttaggtttagggtgcattgcgtaggatatttttctcttcacaattacatcatttgtattctaaagcatggactattgctttttactgttgatgcttgatctctctttatttaaattattcttccaattgtattttctcataatagcaaatgaaactaaagtgacagaaatttctagattaattttatccagagcccagagatgttagaaatttttcattgaggaggcttatattaagggggaaaaaaaagtctcatcaactcttctgaactttccctttagaaaggaatgcagccaaagatgattttactaaaaggactagatgattatttgaatttcacatagcagttggttttgctacaccttttaatttcatctgttcacacctttaaaataaagtattatgaggcttcaggccacggggttatacttggcactatcatcagatagttgatgtcttcattcaatattaaatccagttaataaagcttttgtgccttatgaaggtaaacatatttagggtcaaatattattgattacttaaaattttatatcaaaattaataaattaggataggatacactaattgcatctatttatggttttctaagatacgcacttgagagagttctgactgaatatatggaattatgttatctatagtcagatggtatagatgatagtattgaagttttagagtcaaatgaatgaccatattttattaacatatagataaccttgggcaattaatttagctcttctccatttctacattttttgaaaggggcgataattttgcatggatattttgtgatttcaatgagatagtacacatagagtacctaatgctttagatgcacagccagtaaatgatactgcccctttctggatcatttgcaagaagaaaatatactctggttatataaaaatcctgtaaggtaaagataaatgtgaacaaatttatttaaaaaaattagcacagttttaaatgtcttaggtagcttatttccttaggaaaaaatacatagtttaatgcaatattgatatggaatattggatacgaatatatacagtttgatttaacactattcatattgctctcatgtataagttatacaaaagtaaagtgtaacattcaactcatctcagatttctattaactccatattttttcttgccagttttacttttcattgaattacttttcaatttcaatacagccaacgcatttaaattttgtttatctactctatctttgtgaatctctgtgtttcttacagacataattgctagaaaacagcacagttgcgttgtctagattttcaaaacattttctaagaaatgagtgaacaaccaatggtaggatgatgagcaacagccaacaataattctacctagatattatcctttgaagtataatggtggtcataaaaaaattaagagatgttgaatacagtatctgagatgtagatttcaattaaatctctaataatttccatgtaccagaggtatgttcatcagagtacatttcaaaacaatagaatgttgcctaatttgaggaagttttacttacaaaggattatttccgaatgagtgaatgtaaagaaaccataaggaaccatgctgtaacctatggtagcagcagctgggctgttacgattcccacgttgttgggataaggaagaaagtgagatgttggacaaagtcctattgtagccttgcattaaaagacaaatgccctttaattaagagtccagcaaactccaataattgcaatggtgaggaatcctgtggaataaaaattctggtcttactttcctccctcccttcatccgcctgctggaatcccccagaggttaagggagtctgttgatagagtctactgcttcaaaagcttaaatgttaggaagaatcacctggggatcttgttaaactgcagattctaattcaatagttctcagtagtgctctatattctgcttttctaacaagctcccaggtgacgccagtgcttctaatgcaatgtcacaatttgtgtagcaaggatgtagccattcagatcaaatttctgggcagagaacaaggaggagaatagggagaatggacctggaaagggaaatataaaacatagatgggtatgatgagtgtgttggcattttgaatagccatgaaattagcagtaaaacactgcattaaatacaaccatcagaacccatctatgtttattttaaacagaatctaggcactgatattaatatttctagtgaattttagtaaaatataatgacctgaaatcacagggatgatggactgttgttatttattaaagcaattaattttcttctgtttctttctgtattttttttttgtaaatttataaaattattcaatgcactaatgaaattcatagtggaagactatatgccactgtccacagtctgaagaaagtcattaactttggctgctgtttttcaaaaagtttcttctttcctaattaatctcatattagaaggccttataatatacataagtgatttcttatgttgagtgcgaaacaaatatttaatgtaataatattttatcatgagtaagaaaatattagttatcatttttcatgttacaatttacaatcaaattatctatgataaaattaacttttgaaatgaaaataccaattagaaacaaaacaaaagaaaagaaaatcacttgtattctagagaacataatatatcagaaaaaaaaagtcccaagaaagtgcataaattgagtggatattaatattaactgtacaaccgaaaacaatttaaaaagttaatttgaagctgtcagaaaataaagattaaaaacaattaaattaagggcagacagttttaaagtgttaaaagtatctgtgaactataccaatggtaacccttcccatatggtgacttttattatgccaattataagaatccctaaagagaatataaaaatcccacatttttcatataatcctgacattttacagcataccataactgtaagacctgttacgccaagcattgcaggtgcatctgctgttatctgcgtaagtgctatggtttcctgaatttgctccatttctaggaagaaagaaagcccatatacaaattttagagtctttatgcaatgattagttacatgattttttatatagttttgcagtctgttcacggtctcctaaataaaaatcaataactttatccaatccttaatgcctatgaaaattaacaaattagttttattaaaacacagtgtctcctctccatactcaccactctgttcagttttccaagtgaaaaatttacacttatttcttagcctaaaatgattgaaaaataagattccaaatatttagaaactaggtcaacctcatttcaacactaagacattgtagcttcaggatcttcttttgtaaaatagaaaatggtcttgttagtggagaatcttgaaatacgttaaataattattcatataatcaatatgattgtatttatatggttttatacatttctactaaattttccattttgatcaaagttttggagaggtttctaactttaaatagaaaagtaaaatttaagttagaaattcagagaacatagataatatattttgtgtatcatccctacatagtgaaaaagacataacacaaaatagttaacaaatttttggtatattgcatcacaaatcagaatggcttctgagactaactagaccttaatattataaatggtaaataatattagtacaaataactaacatttaaagattcttgctacatgttgatttctaaaatttattgtgtaatttaagcacaatagtaaaattgtgattatatattttctttcacctaaaaattgagcatcacatacatttgatatttacacatcaaacatgcaagagtaagtgctatgtacaaatgagcattgtggcataattaggagtttaagatttaaaaaaatgtattggctgttctgaaccatattacttgtctctaatgattttttaaatggagagtacattacgattttacataattataaaaatgaatatatactatttcctaataaatttaactagttcagttccatcatttatgaattcaaaaatatgttaactctcgtgtatccctagtatgtttatctctaccaatgaatttttctgtactttaagaactttttttaatttttattttttgtgtgctttttaaaatacttagttgtactactacatttctcatcaaattatggccattgcttttctttatacaaagtttatcttcatttattttaaacatattttgaaatgaaatatttttcacaaagattcatgagctacttaacattatgtcactgagttttctattatatcgtcttcctgtgtaacccagaaacattatctaattgttgcaggatacctctagtcacttttttaaaaattatgctacagaaacatttataagatgtattgttttctcagaagattgtattattaatacagtagtaaatcttatatgaaagatgttaaaggagatactgcagaaatattgtttagttttcaatctagcagcagtatagtttcttgatttttctttgtctaaggattacatcaaagaagtcatcattagcagcctctgtgataagtatgttctgaaaagtgttttgttcagccagtacaggatgtagaaaaaaaaaaaagttaaatttttgtacttgctgacttctaacatagagccactatttacttttaaacaaacaaaaaaaagtcatctttatacagttaaataattttataactcccctacacatttaaatctctggaatagaactgataattctgatgacattagtctttatttcctttcacccaaattctactcctaaatagttaagaattacatctcttagaactgaatagaaaagttaatcgacatgtcccatgtcttatagactcagaacataggtctgctaactcctaatccactaagcaaaatgccaaaaataacacactctgttttaatattactttaacctcctagtcagtgactgattagtcttagtactcatgtaaataaatctattgtcaatagtgatatgtgccactttctcaaaatcaaatacacgcctagagacatgttagttattttcaatatccaaaacattaaaaggaaattattgtattagtagtatagtttattagtttactataaagtaaaagataagattataattaataaattcaaaataaaaagtgggaaacgcacatccaggtatcatatcaaacacagcacaaaagaagacgagaaaggcattattgtacatttgaaaagaaaggttacaatgaagcagaaataaacaaaaacataaacaagatactagttacttgttcataagaacttattttcctttttaaaagaattatgatatgattgaattataggtttataatacagctactgacacttccaagatactttattgttaaaataaataccacaaacttggaagaataaaataaatacaaagttagagtataccattcattttaccttcattattgtcttagaatataatccaagtggaaaatgaggagcgcttcagactgttctgaaaacatttaataaatgccactgtcttctaagagagccccatgcaaacatgaaagttaattatttctaattaaaacaatgttctgctaactaatactaaacatgtctgtttcttctttttcaaagataaatgttctgcatattacatattttcactatatatgcatagcaatgaaatagaataatatatttcagatatgtaacttttgagattatgtaatgaaggactcaatttttagaggaacttcaagccaggaaatgttttattactttaagttatagaagcttagtgataaaaggaccaattgaaggtcaccttttccaaatctccaacttgtacttaaattccttctactacacctatttaatatgatcgatttcctaacattaaaggccagtaccaacactaaatatagtacttcccaatctattttatcccaccaataccagatgttctcaagttacacttacaaagtttttgtaacataaaacataaagacaaatgcctgtttcatcaaaaaagttgatattggaaacaaaatcaatctatgatttatatgcgtgaatatatggttaatttttatagtaggcattttaatttaaatcatttcaaataatgactttagctgattaacatgaaaattagatgaggtttaagtaagagtcaatcaatatctttttttgtaagtttttaaatgcaattttgaatttatattgatcttgaagacaacggacaacctggaagacgccacagtgataatccactacgtggcttaaaactactctaatacaagttacaaaacaaagtgcttttgctagtgtccagggcttacaactaaataaagagggatttgattgctggcctgatattcttccctgccaggcctttcttgtattataaaatatttctattacactaaacaaaaaaacagtcaaactgaacatgtaatgaaaaattttaaaaatgattaaaaattgtttagcatatgaaagaaaagaaaatgaatctttgtgcatatgcctatcaatcttgcatttaatgctttctaaaattattagagcatacatagtttttctgtatttcatcttgagatttacaaatgaaagtgcttcatcttgggtgttcattttttaaaatcacttcctcccatcatagttcacgatcaataaagggaattctcccaacaaaatacctttagttaaaagactcagaattaacaatattatatatattcattcatacactcatacaaatacgacatgcacttttggaggccggggcaggtggatcatttgaggtcaagagatcgagaccagcctggccaacatggtgaaaccctgtctctactaaaatacaaaaaatatctgggcgcggtggtgcgcgcttgtaaccccagctacttgggaggctgtagcaggagaatcgcttgatcctgggaggcggaggttgcagtgagccgagatcacgccactgctctccagcctgggcgactgagcgagactccgtctcaaaaaacacacaaacacgcccgggagctgtgggtttacaccgtttcccagcactttggaaggacaaggcaggcagttcacctgacaggagtttgagaccagcctggccaacacggctaaactccgtctctattataactacgaaaattagccgcgtgtgtcacacgcctgtaatcccagctactcgaggggctgaggcaggagaactgcttgaatccgggggacggaggttccagtgagccgagatcgcgccactgcactccagcctgggcgaccgagcgatactcattctcaaaacaaacaaacaaacaaaaatatgacatgaacaaaatattttttctgcctttgaggagcttaccatacagtggagggaattgccacacatgacacactgtgtaaacattttccttaacctgtataaaataccataatttattttaacattaactctacaataaattttacatgcttattactgaaatgcatcaggttaaaaaatcaggttaattttctaagttaaatatggtcattagaagcactcattacttgatgacaagtcaagatttatgctctgtatcttttataaatcgtgaaatctatattttatggtatatattgtaatattaaatacctgatacatgatttagaatagtcttgtaattaatacttgcaatatttatttttttaatttatttattaggagatatacattattctttccgttaaaaatataaacagctaaaatatttgtcttctgtttaacatattttaaattttttgtgaatttaaattttatgttgttaattcacactttgtcatgtccaaaaatggatattctcctgacctttcatcttctgcatctgtattacaattattatagtttttatttaaaaagtatagatgtatcattattaaagataaattgacatatagatgcttataaaagagaaaactaaggtgcttttagaagcaggaaaaccttacccaaccaaataattaaatcaagatacttgtaagtaggcatgctaatctgtccccttttacacacactgccactgccccccaatattagtaacttattatttacaacattgaactctttgatccgtaggattttattcttttgcattttctcctttggtctgataatcttttcctttagttttctttattctttttgaaatccagacgtgttaaaatcaccatgaaatcttcagacctatttttaatacttataaagtcaaatcttataatgcagagaaaagtagaggtagattcctacttataattcatgtttccaatggaaaaatctagaattatgccagaaaatacaaaatgcagattttgttaaaaagtattttgagacagcagaaaattcacatgtgacaaaactaaacttagagcagttgaacacttcagaagaattaaactttaggttaccatcggggtggggatgagggtagaagagaatcacaacaaaaagcgtcacttgggagggatgtagtcattttttcaccatgaataaggattcacagttaaagaatcttaaactataaagagagaagccatctagtcttagctgcttatttaagagaaaaaagcaggtaaaaaggcagattcttgtccaaaatcccacaactaataataactaagaatcagccttataaatcctgctccaacgataatattcctctttttttaaaatatatgctgtgtgtatagatagttcatatcttatattcacataaaccatcaggccctttctctactatcctacttttgaagttattaacaagaaaaaaattaccttaaaatgtttcataaaccaataaatatccataatttgaactaattgcttagaatgacgttcagaaatagtgaagtggtaattttaagccatctaacaaaaaatcatttttgcttttttttaaatttatagcatgaagaaaacctaattgcataacatttaaggctgtcatccttcactataaacctgataaaaagtaatatgtaaagatttccacactgtaactgagcaagttatttcctgtatataccatgttttgtaaaagaaaataattgaagtagggaagggtgatgaggagtgattggtcaatggggacaaaattacatacagtaagatagaaggataagaagacataagttctagcatttgatagcacaatagggcaactatatttaacagtatcttatatttcaaaatagctagaagatttggaatattttcaacacaaagacataatagatatttgcagtgatgaatgtgccaattactcagatttgatcattacacattgtatgcttatatcaaaatatcctatgtacgccataaatatgtacaactactatatctaaaaattgtagtaagatattttagatgggctcaaaatagctgtagttcactttcatacattttgtgcaatatggactaacagcaattgtagtgtcaaaagcaatgataatgaatggaaatgattgacagagctattaaaataaattttaaacttttctaattaagtcattttcttaaatgtgttctaacatttcaaatagactaaatttttaggaaatttattttaaagaacaaacctattaaatccttcccactattctaatactccagcatttttactttgctagtttaatttattccgtaaaagttgatgatttcaagtggtttatcataaactgctaagatttcacttttatataaaaatctggacagtttaaaaaagcacagcttaaaaaactatgtatatgcaggattttccctgtagaatatttaaaatcattctacactgcttagtattttactactaagtgattatattgctttaaaaaaaattcttctgggtactatatcaggcttaagaaagtggtttctttatcttgcataagtccatgctaacaaaatttgttaacttgaatttcattttaaaattgtatttcctgatacatgtttttgtttgttttcttaactagtgaaaaaggccatagattttaaatctagaggatttaaattgtttccagggaaagacaacagcaacaagttttctatctgtgagtgtacttcttttttgttactttctctagtgcaagagtgaagtttgtggtgtctgtgttgtttgtatgtgttttaccaaaatatttgtgtatttaccaaattaactgcattaatatctgtgtaacatgcatgatgattattcaatattttatattttaatgtatattgatttaatggattaacgtggcaaactcccagcctcagattatttttgataaagtttattttatatttcaagatgtaaaaatattcttttgatcttaagtcttgaggacactcaagtttagttctagaaggtgaggcgaaaatgagtaacatttctaaaattggtggtttcttgtaggaattcttgattgactatatcttaatttcaacataagtgcttttctaagaaatattacttttaagatagcaattttcatttcagaaaaaacaagtcttaatttgaggtaatttagataaacctatgaaatcaaatattttataaaatgattgattaattattgctattcacttcttgaaaatctttaaaaatggcctgaagtacacaatttcacttacaaaatcagggctctgaagttcatcccaaaatctcagattaagaatcactgaattagagcattcatttaaattaccataaccaaacacgaaatttttttagtagagctatgtatttttgtagtcaaaattaggaaattgtcaacaatactgttgcatattagaaactttgaagcaagccatttatgacacaatacttgacttccaaaataacattgctaatatataagtagttatttcaaatttcatacatgttgttacttttattcttcaacaagagtatattttttaactttatttttcttcagttccaaatgacctcatgaaataagtttataattatttctttaacaaaaatcatttattatagctatatcaaaaaggactttatctatatgtttattgacttgtacatataaacagtaattgacaaaaattgagcagttatatcaattatcgagaaacaaacttggagtcttatatcaaatattaatggtgtcataattttcaaatgtgatttttacattttattagttagacttgagaatattaatccaaaaccagaagagatatcactaggaaaccattgatctggtagggttacctgtttcaaaagcactaaacagctaatttcaaagggtttggttgtataattaatatttcttcatgtattttgggggctaaaatcattttcaagattgatactgttagtttttaaggaaaataagcaatgctacaatatgacttttatagaaattattcaacacatttttgagagaaagatgtattttctatgataaaaaaagacaaatttaaaaaatcaccaggtgagatgactcttacatatcaaatttcttcaggtcatcatgaaataaaacttaaatgttagcaaaattaaatgttatgtttactacatttttttctaatattttgtgtagccaatatatttatttctgaattctaagtagaattacagcgtattagaatggcttaccctcttctcaatttgtctacacgtatgttatttgacatgttgcatggttcaaacttccaaatgttcagggaaattcaggctatttgtactaagagatctaggatttatcaaggcattgtaagatgtatgtaactctatatccctgttggtatattgccttagtggaaatatatattatttccacttttcttgtacatgggttgtgaaggtgaacaaaaagggaatttagacatgggtgtatatctaggaaaaaaaattctaataaaaatatcttgtttaagaaatatttgctttaaaataggcaaaaagctaatatgaggcaaaaatgttaatttgctccataattttaaaataaattttgcatttattcattgtattttctataaaaatctttttaaatactcttggtttttcatttttttgaagataagtaattctcacttcagtcaaaatattttttgcaaatttcctgtcataaaatagcaagccaacattattttaaatttcattttactataatttgtttctaaagtatttaataactcatttcaaaaacatattctttcatggttgtttgcagtagagttatattgttttaatttgtatcattattatatatctatttcaaatacacattcagatattgatctctttaatattatttattcaacctaggacaaaataattaaaaagaaagtttttatctgacattcgtctttcaaataagaaaaaataataaagctcatgttctttgaaaaaaagatcaattctatgatgggcacggcccaaagtcagtataagcatggaggacatcaaattcccaaactgccaaagtatgtgtgtatttaaaggtctcataatggcacctttagattttaagtaagaaatgaattaacaagagattaaagaagctccagtagtgttcatgggcagagtttggctgttaaaaggctcattcagattttttttttttcagcttttatacctgaactctgaattgcccctatctaccccgtgttctttttcaaaaattgatttcaccaagaaaagaaactatagatttaaaaaaaattaagtaaacaggttttatatttttaaaatgttaaaattaatgaactagtagtctttccaaattctttagtaggctcctctagaatatttttgtggaattatgaggaaactgtgagcctgccataaatgattgtgttttctttctttttcttcaaatccatacttttattcattcatattatccactcaattctttagtaggctcctctagaatattattgtggaattatgaggaaactgtgagcctgccataaatgattgtgttttctttcttattcttcaaatccatacttttattcattcatattatccacttattccacagttcctccatggcagcactatgctagactaagaaggtaaaagagtgaataaaatatattttcaacccttaaggattcaatattttatagggaagctaaattagttaagagataactctttgtagaatgtgaagggttttagtataaaaaacaacaatacaatgttgatatcagtgttgtttgagttcagaaaaagatccaaagcacttgatattataagttgaaataaaaatttaaattaatttttaaaaatctgagaaaagtgacaatgtaagcagctggaagaggtaatgtggaggtgaattttagtcagagtccacttatttttatctttagggtatattatgtgctatataaaatcagaagccataagaaatcatacttacactattcatgtaattaaacttttagagagcactcatattcttaaaatgctgcaagttgctatgcaaattaaaagaagtaaaagtgataaatctgtccaattgcatcaatggcactgtgaaatgaaagcagatgactgaatgaatactaacttcatttaattgtcttggcatcacttagctatgggcaattctgaaatacataaatatcaaaagaaatgaaagatagattgcactttttttcttaatttaaaaaattttaaatatttacagttaacattaaatacacgtaccacacagaagctctctcattatccttacattttaaattggaaagtttttcctcttgcagatgtccagaaatggtggtttaaatgacactttcaagcagacagaaataacttgacaatcaaaataataagaactgggattaattaggtgaaagtggtgaaattatacacatgctctgcattttaaggtaaaatgcttggaaaagtgttttgaattgtagttaatgacatagtttctgccttgccgagctttctgaacagctatagagctccgggttaatagtagaatttctcaaatcagactgcctgagtttaaatatagattcccattaactagcagtatgactttggacacatttcttaacctctccatgactcagttttctcacctgtaggaggtgtaaaataatagtagctactcctaagatggttgtgagaactaaatggggtaatacacataaagtatgtagaatagttctggacctatagtattatgtaagtgttaactatcatttaaatttatataaaatatttaacaaaattttagtttaacacaaaatgacagtgaaatgtaaaaaatgggatttttcttatttctattttctaataatgtattcacaaactgcttgtccattaccctataatctgtgttatatgtcataatacaaaaaagtagttaggcttaagtcatgccacctcttttcctcattttcatgccacattttaaaaagtcacattttaataaacatatactacaatatttccaaaagccttgtaaagattggaaagaggatattttttcacagaaaatgttcagttctttgataacaaatataaggtggtattgtcaatcaaacaactaggacatatttgttgaaaatatattaaataggtatattaaaataatgttttttctctatttttatcaagtatataatctttttctatagataactaaaggtatgtgaaactattaatttatactgtattaagataattttaaattaaataaaaaattgtccaaatgaaatactccaagctatttaaaaagataaattagaataacatggaaaaaatgagtgattatcttttggaagaagtgggacttgagctaagtcttgaatattagataggattttgatagctaaaggggaaggaaaggaaaacatggagacatggagaaaacacaaatgtgtggagtcagtatgttcagcaaattgcagaacagcgaacagacaacgggacttgggtgatggatgcatgttggtgactagtgagaaataaaattgatacagtagaaaatctagaataattggagatttgagcagtaataagaactgtgttttagaaagtttagtcctcctctggtattcaagatgtattgtaggtggatgaaaatggaatcataaaagcatcaaagtgattaggttgaatttaagtagatagattagatgacaatggaaagtttggtagataatcaaataggccattgaaagattgagaaaggaacttcaaaagaattagaagtcattagcatataggtcattctgtcaaggcatgagggaaattcaaatatagagagttgtgagccaatgcctttcaatttgtccgctgtagtagaatcggcaaaagtaagagtggccaaaaaacctagaaaggtaaagagagattgtatagcaagttagagaataagaaaaacataaatatcctatgatttgaattagtgagctgtaatacagttggcaagaaggatatggttggtaatactaagaaaattatttttttagaatgctgtaaaaacatgcaaaatccgatgtttaatttagaaaacgacaactttaccacaactataactgttgggcagtcgtctgatagctatcttcttatctgatgaatcaatttgaattaaattactatattcagcagtccagtggttctcaattttgactttatattagaattaccttgagagtcattattatttttaaaatggctcacacctacaaccgcaacactttggcaccttggatggccaaggcaagaggatggcttgagtccaggattccaaagctacagtgaactatgattgtgctgctgcacaccagcatggatggcaaagcaagaccctgtctctttaaaataaaaaccaaaaactcccaaaaaactgatgccagagtcctaccatagatttattgcattagaatatctagaggtagaagtagtcatctttattctttcaagaaagatctacctgtgttttcagttcacagtggaggacaacaagcattggatggtttagattttttttctctctggaatctctacttaggcactattttttctaaaaaaaaagcaggtaaattgataaaaagtaaaataatagaatttatcctccagttcactttaagattgaatttattaaacaatatcactcagatatttcagtactatctgactgaataataaaaatctaacttggggatttagatatccaatgtggtcacattcactgaaaaaattaatacatctttgactttctgctttgaagaaactgctgaaaatgtgcacaaaagctaaataaatcatattcatggaagttgcttgagggtaaagccattgttttggtttacaccattatgtaataatttaaaggcatgcctagtaatttgcaccactgctgtattttaatgctggcagatcaaattgctttatcatataccagataagaagtgttagaactttgaacttttttcataaagtcgtattttttattacaccttcaaaaataataaggatccaaataaaactatcataactggtggttgacttctttgttgccagtgattaatggaaactctggacactgataccctgagaatgtgtttccagagattttccaatttgatggaaactaaaaacaaaagtgataaatattaatgtgttaataggcaagactaatacaagtcattgaatatgaacagcaaatttattttctcattagttcataaaatgcttttgctttctttattgttttataaaattatagtttaacaaatgcttaaatgacagtgattatagtgacaaaatacaataatacattttatgtatattttaaaattaatatcatcgattttctaatcacatatattttgtttcttttttcttttttccctgctgttgcagtaaatgagggaggtattaaaacagcttccaatttatgcccagatccaggagaaccagaaaatgggaagagaatcggatcagattttaggtaatattttaaaatattgacttcattatttatcttgtcaaggtttattttaatttaaatctttaaagtagctaataatataaagatgaagtcttagtggcatcaaactgcattttatcaatgtattgttattaataatatctaattattttaaagggattagttaagtaatgcattaactttattagaacactttttttttagtttaaatgattaatttctcatcatatagtaagtgaaaaatcatgggatttagattttaaagacataactttgagttccagttttgctacttattagttgtctgatcttgggtaagttgctctatcctgtttgcctgagtttcttcttctgcaacatgtaaatcacatttaccacatataatggtgagtttcaaatgaggcaattcctgtaaaaccttccagcaaatgttctataaacatcttatttgtattgtgtaattataacttcagtagaagttttatatccatcacaaattagtattaattttatcaatttaaaattaagttaaacaacctagagaatttacatagtatactgtggcagccattaatttacataactatcaaataatgctttttaataaacttgaatttttcttagtcctctagaatctattacaaacaaaagattacaaaaagcctatcaaaatattagataataatctcacgaaaactcacaaatacctatttttacagtgtccatggtaaattttatttttcaattatttatgctaatgtttatagttacagataccacatattttttatttttacttattcattttatttatataaagcacaagtgattctctaaagaatatctctatgaagaaaaaaatagttcttagaatatagacctataataaatttcccccatggatctttcagaatgacttaaagttacattttgctatacttggagtgaaaaacaataatacaatttccacacaaacacaattgtaattttctaaaatgtttacataactttaaccacgctcgaaacttaatacagataataatatttgaaggaacacactaaagagaaattcaaaagatttggggactagtcagactttgacatgttatactgattttattaaaatcaactaaatctttcagccttaatgactaatggttatatcttacagaccacaaagtgataagcaattaaataattattttttccaagtattttttatttcttatacaatcttataagcacttactattttatccctacattttaaatgagaaaactgaagtttatttacctggctaataatttgatggaactgggatttgaactcttgacttgcagactccaaaacctgacgttttaatcactatattataatatattgcactttaaagtcaaacaaatttcattcagattatatccctgaaataaattatcttgtcttctgcaagagttagtttcctcagttctaaaattgagaataataatgtatatcttattcggttgaggagaagatcacatgagataacttatgcctcgtagtaaccatacagcttttgacaaattaagtactctattaatacaaactgctattacaaagtaacatgtacaatattactgatgacattaatatttacttggtccaatgatttgcaaattagattaatgatttattggaaatcaacctaaaaataatataatgtgatagtaatataatgagcaaaattaccttcaagtgcagtagatttcaagccattcagttgtaatcacaaatgtagaaaattactcagaagtcaaaaagaaaataataagattctatgacagagaataaacatgtctcaaggtgggtacctacataatttaagaaggtcctactcccgtggatattggaagaagtatatgtgtcccaccggcagggaaggaatagcctgaaaagaaagtgcttgattacctgttccagaaaatagagttcagtgaaactcaattatagagcgtaaataggagaaaataatagaatgaagtagaggaaataaggagaaaccaaatatttgcatcagagaaagtaagcaggcagccattcagcctaatatggactgaagatatgttttgttttaaatacattgttttttttaatggagacaacatttaaaactcagaatattatacacacacacacacacacacacacacacacacacacatatttctgtattctcttattatatttggcaacttaaacctacacacttttagggtaacatctgctcagaaccagttaacaatttgtctctctaggctgggcaggatctccctggctcaccatgtgtacccataggctactttactcatttagctcacctgcctatgatgggaagttgtaaagatttgtaagtgacctgatccaatttatatattcagtagatcatgctttctattttagctcagtgattgaagaaaacttaaattttagttaggtttcttcagtagtctgagtgaaagacagtggagatttggactatggtgttggcagggaacgagacagattcaagatatcttttgaagataaaagccttaatatcccatgaaaatttgatgtggagagtaagaaaaaggaaagaattaaggatgaggctcaattttcaaggcttgaacaacatgaggatggagtgaattataatgtttaataaagtgtgaacatccagagatttctggagaataattgagagttcagttttgaagttgtacattttagaagatttagagatttctaggcagatatgttaagtgattagttgaacataattgaaattcagagatatcagggaaccataggcatatatacatattataaaaatgttaaacatcattttctttaaaaaattatgtgtagataacatcatttaaaataagtagaaagacaagagaacttgtgatgtcatctcaaatatctatttgacgaactgatagaatacaaggagctgccaaatcctgctcatgagagaccagaggactatgacaatacctaaaagggtaactgaagcaaaagaagtcctttaaagggcaagcagggactgttgaaaaattgagcacggaggacagaagactgtgttttgaatttgacaacatgaaggttgttgacaagagtgatttcagtggaatgacagaggttgaaaaccaacttaaatatgctgaagagtgaataaagacagttcagatagtttacagcttggtgacttcaagttatataaactactgaaataatgaggcatttttgtagtcattaggaaatcaagagagagtttctttttagagattcaagagaccaaagcatgtttattggttggtacaaataattctatagagagaaatctattggtggcattggaaagagagggtagaggtaaagaaacataattttgtaggagaaaataaatgggatcccaaggacaggtagtggggaattattttcaatctaatagaaaggaagacagagaagtggagaagagatgctgctaggcctacatattttgtgattggaagatgagaaagctcatgtttaatacttttacgttagtaacgccgcatctaggaaggccatcaaatgaaaatgtgtgtataaggagatgaggatggatgggagagaaagtttaagactgagagaaaaatgaaaaatagttttttaccaagagtgggagagcaagcttgatgtagaaatgttgccttgctaagtaaatttgagtgcccttttgagattgatgataatgaatctgcttggttttataatttctacctagcattactgagcttcctagctacaaacataaaaaggattgtgcaaaagtatgataaactcagtgcatttgggaacttgctagtaattctttcaggcatacagattagaaacatggattgggagcaaagaaatcttcaagtagcgatataaattgggggacttttaaaaggagagtggatcagtttcaggtcaaggtcagtttcagaagcagaagttgaagtatttgtagactcatctgtttcaaagggggaaaaagaactttgtatgtatttcaaaaatgtaatacaaaaattattctcatataagatatggaaatcacccagaagaataaaaaatggaaaggttgtaaaggaataaaaatcaccgacaaaagataaatcaaattgttatgaagtaatgtacttttagtcaggacttaaattaaaagttatatcttttcttgggccctttttatctcaaaggaacattagattgtgattactcagtgaattactgcctccaactatgaaagtcacactggtttttggatagaattaccagtctctgcccctgaaaattcaaaagaactcgtggcatgttctcctggtgccccatccaagtgaaagttcagttatttcataaaacaccaaaaagtataatcgataaaaaaattgatgtcatacttcattaaaattaaaatatctgctctataaaaagcactgtgaagacaaagaaagaacattccacagattggaaaaaaatttgcaaattacatatctaataaaaatacattctgtatattaaatatggaaaaattgcttaaaatttaacaataagaaaacaactcaattacacaataggcaaaacatcaaaacagaattgtcaccaaagaagatatatgagacagcaaatagacatataaataaagctcattatcatatgtaattagggaacttcaaattaatataactaccagatacgattacatagctattaaaatagctaaagtctaaagctctgacaacacaaaatgctgccgagaaagtaaaacaacaggaatgctcatgtactgctggtgggaatgcaaaataataaagccactttggaagacattctgacagttttttaatttaatttattatttttaaacttttagtttcagggctatacatacaggttgttacataggtaaattgtatgtcacagggatttaaaaggtgtacagattattttttgtcacccaggtaatatgcataatgcccaataagtagttttctgatcctcaccctcctctcaccctccaacctcaagtaggccccagtgactgtttttcccttctttgtgtccacgtgtactcaatgtttagttcttacttgtaagtgagaacacttggtatttggttttctattcctgtgttagtttgcttaggaccatcgcctccagcttcatacatattgctgcaaaggacatgaactcatttttttatggctgcatagtatttcgcagtatatatgtaccatattttctttatccagtctatcactaatgatcattttggttgattccatgtctttgctattgtgagtagttctgcagtgaacatacctgtgcatgtgcctttatggtagaacaatttattttcctttgggtatatacgcaataatggtattactgggttgaatggtagttctaagttctttgagaaattgcaaaactgcttttcacagtggctgaactaatttacactcatgccagccgttgacagtttttttttttttttttaaactaaacatgggtttaccaacaattacactcctaggtaaaatttcaactataagacattctggaaaagacaaaactacagagacagtaaaaaaaaacactggttgtcaggagttcagggggatgaagtgagggatgaagagagggtgcacaggggacatataagggcagtgaatctattctgtcggatattgtaatagtgaataatgacactatgtgtttgtcaaaacccatagaacacaaagagtgaaccctaatgtaattatgaactttaattaataaaatattttaatgttgattcattcattgcaaaaaaatttaccatgctaataaaaaatattaataatgggagaaactgtattatgatggggagagaggggtagtgtttgggaaccctctgtactctctgtgattattttataaacctgaaaattctctagaaaataaattctattaaaattaaaaataaagacatacacgtgatttcatattatatttgaactaagtgatatatatccacatatacacatgttattttaatgataatatgttactaaaatctttctctagcatgtttgttacaacctcagatatttactgtttcatgattttcctaacattgcagtaatctctttgaatgaaaactttagggataaaagagatatttcaattatgaagagatgtagaagagataagaatagttctctgatctgcatttccatggatattatcttagttaatcgtttatttacacatttttagaaaattgtgatgtcagttttacaagctgccgatttttctccttctcgtccacagtttccatccataacatctacaataatgtgtttttctaacttcaacaccagcagagctttcctgtcgcctacttatacaaaaagtactcagtgttggcattcaaaatgcttcaaaatattcccaatcttccattcatattttgtgtggtaacaaattgtcccacatagttggcttcaaatatatctgattttctgggactacttagttctgttgtttcttcctcctagaatgttatatcttagcgtttttgcctgtgttatcttacatattcttcaagtgctcactcaaaatcctcttttataaagcttttcttacttttccaatcagttactctctggttcttaacttcttagctcatgttttccttcattatagtacccaatttttttttcttgtctcttagaaacttttctaagtgcaagatccttgtaatcagatatgagtattcatgtttctgtatgtgtgacaaagagagctcaataaatgtaattaattgaattgattaaaacagcaaaactgcagtttagcattttccattaattttctaatcacatgactgtagcaggacctcaaattcatcgtattagtaaatggcttatagataccagttgatgaaacagaaacagtcttgtttgcacgtaatcaatatttttataatcactgaggaaatctatgagaaaatccttggagaagtaaggtatcttacttgttatattttggttaccatttgtgctctactctcctaggtgatagtcccagcaggtgtgttttgaaatcttaaaagctttgtttctaatttgaaatacctatagaatataacaagtttttaaagggagaaatgctgccaaagagatataaagttggcagcattttctatgctgaaaaataaattaaaaagttaaatgcccttaaaattataaccaactttttgggaaagctcagcttgtgggatccttatattcatagactttctttctgtgggaaaggccttaattgatgccttttctgactgaataggaagatataaaggaaaaggagaattttgaagattttaaaagagatattgaaatctcttatgtcacactagatgtgaacataaatttgggcttctcttgagagcaaataacaatttggactccaaattttggatttgtatctggattattaaaatgctggtatatctcagcagtgaaacagcagggaacatgctactcatttggtactattaaaacactactgtataatgtatattcaggaaaagtttattatcataatgtaaatcaaccatacttttgaatataaagtcattttcactcattcttcttacatgaactttctaaatatgctagtatattagttataaatcttattttggtaattacaaagagaccgttagtatatagaagcttccaaaggtgttctgtctctccccacttcacaagtaaactttcctaaagaatggcctacatctgtggcagttctttccttaccatactgctataagtatttgtaattattataagctctcttgaatgtaatggctgagaaatagcttggtttccttgagtgtagccattgactacccatttttcactcttttattgaatctactttaccttctcacttcctaaaaataaaaatttttcacagttacacttcaaaactcactttttcttcaagaatctgatctcctttcaagggtttgtaatcatgactttccatgtttccctcaggtctttatcatttttattcttctgagagttgaatatttattttcaactttttataacaattgaattagtattttttacaaaacaagtatgtcattgcatctgtaaaagcgtgggatttggaatcagatgaacttacttttaagttctattgctctttttacttgacttggggaagttatttattctacacaaagttgtctttccttttaaataaaaatggaaagggtggcaccaaactgaaatgccacagtgaaggactagattatctcagactcatgaacttgcctagtgaagtacccagaacaaagaggggctaataaatgcttggttacctgtctttgccttgtctttgctattttcctgtcgttttcccaatgaatgaagatttaaaagtcttcattgttttccaacatccattccaacactgatgccacttctatctcattcattagtaatcttcagttccctctcttttactttactcacttaaaacttcccaactgcacaaaagcaattatcttctatttattctgttacaagaagtattacacttggctttcaggaaaggattcctcacttttaaatattgcaataatactccttgatcaaaaacttgttttttcccatacctattgaattaagaggtgatataatatcagttatcacgtacatacatatatcatattttaactcaaaagcactttcacaccattattttttaaatgtattaacacactgtaggtttcaatatttctattttactaatgagtaaactcacataccagaagttcctatacttagcagtaataaagacaggccttgtacccagggagtatggcttgcaatttgatcctttttcccccttgcttatatatttgcattctagcatttaaattcttcctcaatgtagtggaaacctaactttctggcattatctttccacttttgtcatatttcattacagaatgccacacttgcctcttaccgaaaaatatttcacttcagtcgtgtggtgtgtattttaaaaaatcaatgtaaaagtaaaaactaccatttcctctaacttactagttgcttaatacaaattgtccttccaaatgcctccacccttaatcagctgtgtaatattgcacatgctactcttgcttcctaaaataagattctgccaatctttacctataagaaacctatccttcaaatgaatttccttcatctgccttggtttcttataacttttatcaatgctctcttggctctgttaaagtcaaaataaaaatgtagagacaaatctctaaatgtaacattttatttgagaagaaagaatcacaattcgaggtatacagtcagaccaggtggtctttggtatgttggaagaataaagagaaagttgcaggtttcattaaaggagaaatgttacatattgttctttgagaaagttcatgggcattaataaagttctggggagctggcaagctcccattggtgagtgatggtggttggcaaaattcatccttatgttgcagcaacttatttcagcacttatagataaaactggtctcagattacaacaggcagttccagcagcctgacttgcagagaattacatttctagagcaatgttatatattctgagtgcttttcccccctggcttctcgactgttttagttgggtatggcaagaatgaaccaattcatacgatcaactttcacaactcatttgacttgaataaaatttacttgtgtgcttcttttatctttctgctcagtatttattctatttttgaatgctgatgctatctttttttaatcatcaatctccaaaaaatgtttagatgcttaagaatcacttgctgcattgaatttgagtaaacttgcactgtcatcttcttcttgtgttatacagacaatacagaaacagtaacagtaagataagtagtaattgcattggtctttgcaattactatttatcctactgttctctgtatgaagaggtgtttctggcctctttgggatggcaccttaaaagacatattacctgccgggggcagtaactcatgcctgtaatcctagtactgtgggaggctgaggctggcggatcacctgaggtcaggagttcaagaccagtctggccaacatggcgaatccctgtctctactaaaaatacaaaagttagccaggagtggtggtgggcacctgtaatcccaaccacttgggaggctgaggcaggataatcgcttgagcccaggaggcagaggttgcagtgagccaagatcgtgccactgcactccaaattaggcgacagagagagactctgtctcaaaaaaaaaaaaaaaacattattacctaggtccaaaaacaaagagtaataaaagcataactgttcttttgattcttgtgactcaaaactgtcagtacattattaccatataaaaactagctcttacaaaaaaaatatatttcaagttgtataaatatatagaagaaagaataggactagatttttgaaatctcctccagctatgttatccaaactgataggacatttaaaatatatggcttataaaaatactcaagttgggtaggcaaacttaaaagaagataacatgaataacaaagcctaataccctgtgcacaccttatcacattttctacactctatagattgtctactttaccttcatggtctcctcattgctggagggagaaaacaagctgtaattgcaatgttaatgtaaaaaataataaaaataaaaagacaattgaggctacaggtagtttaaattatggtaatattttattgaagtaaagtttaaatgtacatatttagaaatatattgacgtatttaggaaataattttgatcaatacaaatatttatagataagccaattatttctggctgggtagtgtgagtatattttgggaataattttgatgaattaaagtatttctagataaactgagtatttctgcctgagtagtgttagaatattttgggtataccaagagtaatttcagttctataaaagtgagatcattgaatacattttatgccacacatttttaattacaagggtgtttttgaaaaaaagttataggaaaaaggaatactaaggcttccttctagtgtcacgattaaagataaagaaaacctatatgcaaattcaaaaagtcaaattagtcagacccttccttgcaaaatttgaattattagtctgtttaatattcttaagtttccataggagtgaccttcagctttattatgtatatgtaaattttgtgaaagaaaatatccttattatgttgtaaatgctgtgacttggacaaagtgaagaagcaatatgattttaattatttaatataatgacatggatcataggtacagaagtaaaatgggaataagagaaggaaattagggaatgagacacaaggagaagagatgtccaagtaatgagaatattttgagggtaagcaagatagaaaaaataagacagaggcaagagacttggggtagaagaaagaagggaaatataaagtcactgttaaactaaatgtggaaatagcagaagcgaggaagtctgtgacaacagactatattagcatttttttcataaaagtctttgtaaaactagtaactactcttagttgcacctctccatattgaatccatcaagaagttctacccatacttgagattttattccaaggcatattctaaaaatatccaatattctccatttcaactgaaaccttcctaatgcaagccactatcatctctcacttagaccattcaaacatcctaaaccatctctcttctactgctgttgtcatctgtaatacattcaccacaaaacagagcaatattttaaaaactatatcaaatcacgtcacttttctgcttaaaattcttcagtgacttcccccttgcagttagaataaattgatacttaaaaaaaatccccatacaacctgttttttttttcataattgagctcattttggatcattcttcttatttcccactctaatccagtcattatagcatcttttctgtttttgaaacatatctaaatttaacaaaaaaggtgagagatttctacactgaaaactataaaatattgatgaaagaaactaaataagttacaaataaatagaaagatatcccatgctcatgaaaaaagtgtctatactaaccatagcaatctacagattcagtgcattctcaaacaaaataccaatgacattctctacagaaatacaaaaataaaataaaataaaaaccttaaaattcacatgaaagcacaatagatttcaaatagccaaagcaatttttagcaaaagaacaaatctggaactatcatacagtctgacttcagaatatactacaaaactatagtatccaaaacagcatagtattggcattaaaacaaggagagaccaatggaacagaatagagaagccagcaaaaactcatgcatttaaagccgattgattttcatcaaatgtgccaagaacacgccgtaagaaaaggacactttcttcaataaatggtgtcagaaaaattggatattcatgtgtggaagaatgaaactagacccttatctcacatcaaaaatcaactcaaaataaatttaggtatttaacataaggcccaaagctatgtaactactataaacaacctagaaaataagcttcctgacattggtctgggcaatgattttttgatatgaccccaaaagcacaggcaaaaaaacaaaatcagaaaaagggttacacaagataaaaacttttgcacagaaaaggaaacaataatgaagggacagcctacagaatggaagaaaacatttgcacactatacatctagattcacagagtgacgtgcaaagttttagcacaagaagttcccaaatatttttgcatcacagtgtcccgagtgtcttagtaatttttttttccaggctcccaggcccaaagaaatacctaacacttctgtttagtagctgtggctaagcaacttatgaatttatgttctaaaaacttagcattgtgcactgcacaatttctcaaaccttggactcagattttatgttaccaccctcattttatgctccacagcaaaatggtatgatatttgcttttcatcagagcagccactgaaaatccagcatcatcaatgtcattgaaaggaatatattaatagttgtataatattgaaactgaattacttcaagctagtagtttgcacaattcatgatggatatctgtgtttccttcaaaaatttaaagtatactgtagcaacctatgtgttctattcagcaacccaaaaagctcaacatactttgggaactgtaattttagccagtaaggaatagagggcaaaatatgccataaaaaaatagatgctggtactgttattttgaattttattaagacttgttgcaggaactagctacttctccaaccactgtcagagtccaggaaaacaacatgatatttgtaattacaatgtgtaacatccacaaagctttccaggctctgcatcatgactgcatttaaactagtatgccttatcctagtgtgttcttccttccactcatgtactcagccaatacccactgtgtacccactgcagacattgggctaaaccctagataaaaggacgaatatgatgtaatttttcccttcaagagtttacagtcttagctcatatcccagtgactcataaaaggttgttgctgatcttcccagacctttagtgtacttctgtatgcctgtctgcaacctgtggggcctgctctcctcaactagatgctagtggtattttttagattccccttagaaatagaaagtttgtaaactttctattcccacggcaaaactgtctttaccccctcactagctcaggcttttggaacttgctaagtctaacctactgggttctaatttgaccataaaaaaaatgtcgaattatttttaatgtaaaataatgagagttcttgtcattctaattttaactcctcaaatataaatagtaactttaaggtagcagtttacacattcactgtgacttattcagaaatcgttatatagaacccttctctgatctatgattcagagtatcagagtgtgatgcactccattgctatttccactgtttaatgcattatgggctccagctggcctaggacttggtggagagatggtgaagagatggtggaaagacagcaaatataagaccatgtcttttctaacaatcatggtaaggtatattgtaatactttgcagaactgatattacaattcggtgtaaaatttgtaacattttaaaccagctcatattacaaactggtaaaaaatttgaactattctatttcataccattatagaacgcttggggcttaattttcttttagagttaagagaatctatagcccaattctgaataatagagatatttttatcattatacaccacttgataacatcttatacagctatctatttgtattttagcaccatatctattcttagagacttcttgaattttatagctggaaaaaaaaatctcagaggtcatcttgcagttactcccaactccccaatccacgatttgattttataaaactgatactaaatttgcctaacatttagtagagcactatttcttatttttgtttttgtttttaccagaaatacttttatatattttattgatgtgtaatatttgtacatgtttatggggaacacatgatattttgatacatgcatagaatgtgtaatgatcaaatcagggtattttggatagccatcaccttgaacatttaccatttctttctcttagaaacatttaaaatcttcttttatagctattttgaaatgcaaatatacaatatcttgttaactatagtcaccctactgtgctatcaaatactgaaattattccttctatctaactgtaggtatccattaaccaacctctctttgtaccccctcccacgcacacacacactgcacacccttcccagcctctggtaactatttttcttttttcttttttttttctcgctctgtctcccaggctggagtgcagtggcacaatctcgcctcactgcgagctccgccttctgggttcatgccattcttctgcctcagcctcccaagtagcctgcaatcccagcactttgggaggccaaggcaggcggatcatgaggtcaggagactgagaccaccctggctaacatggtgaaaccccatctctactaaaaatactatctttctactttctatgtctatgagatgaacatttttagcttgcacatatgcataaaaatttgtgatattttgtctttctgcgcctggtttattttacttaataatgtgatctgaagttccgtccatgttgctgcatatgataggatttcattcattttgtgattgaatagtattccattgtgtatacacactacatttgtccattcatctgctgatagacacttagattgatttcatatctcagctattgtgaatagtgttgcaataaacatgggaatgcagatatcccaaaggactgatttcctttcctttggatgaatacccagtggtgggattgctggttcttatggtagttctacttttagttttttgagaactcttcatactgccccccataatgactgtactaatttacatctccaccaacagtgtgtaagagttacctttcctccgcatcctcaccagcatttgttactttaggtctttatggtaatagcccttctaactgtggtaagatgatatctgattgtggttttgatttgcatttctctgatgattagtgatgttgaacatttttcatatacgtgtttgccatttgtatgtcttcctttaagaaatgtcagttcagaccctttgtccacttttatgggattatttatattattgctattgagttgtttgatttccttttaaattcagaatattactcccttgtcagaggagtaatttgtaaatattttcttctattcaacaggttgtctttttactttgttgatttttcctttgctgtgtgaaagctttctggtttactgtagtcccatttgtctatttttctttttgtttcctgtgattttgaagttttaaccatacaatcttttcctagacaagttccctagaacattttccctaagtttttttttttttagtagttttatagtttcggattttacatttaagtctttaatccattttgagttgattttttatatggtgagaaataaaggtctagtttcattcctctgtaatggatatccagttttcccagcaccatttattgaagagagtgttggaaaggcatttctaatgcaagaagagacattaattccaaagttgtttaaatcaggatagtttaatctttatgattagaggaagtgctttatagcatagtcattatgttaaatgaaaatgatttaaaaacaaagtaccccaccttctaagttcacattttattcatgaaagaggcatagcaacataaaaaaaatgatgaagtatttaaggtatgtttgctttggcagatttattttaataaaaagctaattgattcatggaatatgacagctgtaactcatctaaaggtaacctaatttattctactcaaaatttttctcagtggactataatactgataaattgaatgtggaaaagttgattttatattataggcttaatatggcaatagcaacttaatattctaaatttacattactgacatatgcaataatttattattccttgtcagcacctccatataggattcaaggggtaaatattaaacataggtagtcagtgtttaatctaactggtccttccagtgtataaaagattgaacagttcacagacaatgaggtagttgctatgcacatcggtctttgcactttaaatatcattcacaaagtgccttgtgggttactcttgcaaatttctatgacattaactggtaaaaacgtcaagagtagatcaaatgggattttatagaggaaagtactttgtaaactagaatgctctattcaaatataaatttttaatattcttttaataatttatattaggattaaaaataaacttgatcattttggataatttataacattgtgcatcacaaagctcagttcatctatgcctctatagtgtttccctactctgaggtggatttgactttaactatttaaacctctacttcaactggtttatttctctctgacagctgttcttaaatatagagccacagtcttctggggctttttaaaatacaattaatgtgttgccactattaagagatcaaagtttaatataatataagcctggaaaaattagatacaaataggtttatcttcattacattatttagtttattgctgtctgatagtagtatagggatgagaacacagggagtgatatagcaatgggaacagttaaagttaatgtcacaagaatgagatgttaaccttgccttatggcttaaagaggcgtattgtatgaatatgcctacatgtgaacttcaaaatagcatgttgtggaaatcattaggaagcttaccaacctaaacaatatagcattaaattatttcatttattagctctcacactaattttattttacttttttatttgaagggattgtataaccaagttctactttataatcttaaccactttctttcctatgatcataccaacaaaaatgatcccaaacatagatcttcatttaatactatttgaaagctttattatattcaaatgattttaactcatgtcttaaaaacatttctgtcacagaaaaaaaattatttaagcttttaattagattatattttgccacttaagtgtatgtatattgtaatttttctgaacattttcatgttactttctaacgcattctactagtaaccttcaaaagcactttattttattgccttttatctatcaaagtatatcattatcctactatgtgccttttcttactttataacacagttatggatctgtaccatacttcacttgttatataaaaatattgtgcttatgtagaattgaagatctattaaaaattgtttaattaagacacaaaatctgacctattgagtgttatatataagagataaagcaaagcagaataaaaacatcatatagtgacaagtatttatctcttagtctccataaaaagaattatcaaaataaaaataaaatcttcagctctcacatttttaatagttgtactaaatttaaaatcttgaaatcttttttttttaattttttttttattatgctttaagttttagggtacatgtgcacattgtgcaggttagttacatacgcatacatgtgccatgctggtgtgctgcacccactaactcgtcatctagcattaggtatatctcccaatgctatccctcccccctccccccaccccatgggagaaaattttcgcaacctactcatctgacaaagggctaatatccagaatctacaatgaactcaaacaaatttacaagaaaaaacaaacaaccccatcaaaaagtgggcgaaggacatgaacagacacttctcaaaagaagacatttatgcagccaaaaaacacatgagaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatgccattagtgggtatatacccaaaggactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacagtgagatcacatggacacaggaaggggaacatcacaatcttgaaatcttattgggtattatagcaaggatttttgaggattctgaggagttcaccacagttaattttggaggttaacgaaaaggactctatgataataatcagtatgctttctcttgaaggtttgaaattataactttttctgtgacatttgcttttagcttggttagctatttaactagctgttgtcatatgaaaatctatattaactaatgcacttgcctagggcttttgcgtttctctctgaacaatgtatttcttttgggatttttcctttttccagaatattgcttcttttggaattacactatttttgagtatactgttttatgtttcatagaagtatataagtagaggaagtaaatctacaagaagaaggatgtactcctagtgatagaatttatctgaagctgagtattggaggggcaaagacaggtagcattattatctttctagtatacttgaaattgtacacaaatgaccaagcttggggttattaaatagggcagtagttggcataaatattgaatgaggtagtgagtgaccttaagcattccacaaagcaagatacccagtaacaatatccagactgattataaccaacagtgtaaagaaatatgaaagtgtgtgaatgctgaattgaattctctttgtatcggacatagtcttggtttggatgacattatttctgcaaaagaatgacattaattttataaggtcaaggaaataggcaataggtataaaaaaacatggtattcattatgttttgaagaaaagttttggtatgagatgaaatactttgtaatatctaacaaagcttatcaatgtaacttagagtcagaaacaaaatattttgaaagtaaagtaatttatcatccctttggatagagtttattaacatttaatttttatgacttacaaataaacagattaataccatcacttttactaccagcttaaaatgagagttgaatattcaagagaaagaaggaataattaatagtacaagtaatgacaaggcggggtggattgaatcccaaactagttggaggaatgacccctctataaggagcttcacttgctccaattttacaagaaggaaataagaaagaaataattcaaatttgagaagaactagaattttggaattagactcaaaagtacctttaacagtgtagagcttaagtggttttcactttttttttgctaatcttaattttcaaaatttctgcaatacgtacttgtacaattttaaaacagaaaatctcatattgtaaaataaccttagatattctaatgtgcaattactcatttttgaaattgctagtttaaagacatttagagaataattagacttttaaagatattaaatcagcattattgtggtcattttggtaatagttattttcttgacgtttagtgttttgatttttttgctacagaaatggtttgcagatactttaatttttagatcatctgtcatgcctggacaatttctatttgtacagtgataattttgaaaaatatgcatctgctacttagggttaaatttctgcatctgtcaggaaattgtctagacctttttaaatagaccaaaaaataataacaacaaaagtgcagacaaatttactcttgatgtaatgctgtcaagattcattcctcctctgctttttttttagatcctcttctatgacccaagcactattatctgtccttccatatttctgtatttgttcatatcctgtctatttgattgtaaataaaattatagattcactatcttgggccaacacaggtaaaatttgtgtattttgaaaaacctcatatcttctcttactgacagctttgatattatagggtgtttttgcaaaataagtatcatttttaaaaagatgacagcacttaaacattgaccagcataatcatgagaaggtcaactctagtttttcaaacaatatcattatatatcatttgccttatgacttggtactttcaaattaaaaatgtgctcagccatttgttttgaaatgttgtatcagaatgaataacttattaaagtggaaagttttatttggctgggtagggcagacatctcttctgtggtgacagatgaatttcagtggatacagcttgtcctccttgtcatttcatggtaactgaatactttcctaggaatgcatacacacacacaaacacacacacgctcacacacacacacacacatatttaatgagtgtaagtttttcttaagtttgactcaaatattaaaacagttaatacagtgaaagcacagtgcatttgtttaagatatccatttcctgatgattgagcctggattttactggaaaggctacttatttcattgacttctgtcctctctgtgttgttttgcacttttatatttttggtctagaatatgttgaagtgtagctgtgatcctggatggagatgtttgcaaatgcccaatatagatgcttttcttcattagtggggaagaaattaatggcttatacaatacaaatgagtaattagaaatatttgccatcttggcagtttggattctaaatctgcattttaaaatatcccattccctctcctcctgcagcataaacaggagcagacctagaaaatctaaatcagaggacatccatgggccatgtggccaaaatgtcatatatgatgcatttagatggcatcttataagctaacttaagataaaatagtaaggtagaaaatggtcctctcatctaggtgagaaggctcctttcttcctaccttctttatctttacactatttctctctcttactgctccatcttaacttaagcccctaaatcattgtagcaattgttctactgaggtatgggaaagcaatgcacaaagagatgaaaatatttaattttttttttttgagatggcgtctccctctgtcgagtgcagtagcgcgatctcagctcactgcaagttccacttcccgggttcactccattctcctgcctcagcctccccagtagctgggactacaggtgcccgccaacacgctgggttaatttttttatttttatttttagtagagacggggtctcaccgtgttagccaggatggtctcgatctcctgacctcgtaatcctccctccttggcctcccagaggaaaatatttaattcttaatggataaattaataagagcttcatgtgtaacctaaaattaaaatcaaatcttaataatgattaagctaaatgaggaaaatgagaattcctggcagagtagacattgtagaaagaccaaaggtatgagaaaaagtaaattactgttaatggtatttggaacataaggttcatgttagggagatatgggatgtgagaatataaactttataaatggacaaaaataaatttcccccaccagaacttaaatataattatgacatgaaattttaaagttgggacaaatggaggaatacagagatactcaaaatgactttaaaagacaagaacccctagactatgaggacttcattttaatctaactgagggaaataactgagtgcttgatatgtgatagacactgtgtagtttataaataatatttcattactttatcacaacagacgagaaagctgaagtttagggcaaagttagtatttgaaaggagatacctgtgattctgtagcttaaactgttcaccactactctaaactacttttcccagtgtattaaggggagaagaacatgttgagatggctaatctgtaggggaaaaataagtatagaagcttcagagaccattactggtaatctttagtatagtagcaaaacagttatttattattttataataattataattattattattatcaatttcctgtctccacgctaagtgaattaattttctataatcaaaagaaacatgctcaaactcctatcacttaaacaagatgtcatttattacttttagcaagaagagcctggttagaactagaatatcataatcatctgtgacaaatatggtaaccatgatagatcattaatttattatgttagtgagaaaatagtaattaaatgaatcctatgggccaggccctatactgggccttctttctccatcccctaaagtttttaccatcattagcttgtagctactacttttctaatacttgttgccatcataacatctccatgaaaactcggatttccgtgacagcttgttaactaaactctttgcttctatctttggccgcttaaattgtatccttcactcagaaaccaatgagttcattttaaagcatagtattcacttgtcttaaacccctgtaacaactgcccaattctctcagaatgagggtcaaaatccttatcatggcctagaaagttgtaaccaatctaaccacaacccctaattgcttccttgacttaatttcacatacccctctctttattttctgtgctccaatcacattagtatttttcttgctctttcttgaacacagcaaatgcagcaggcaatgggaaatagtgggtgccatggattataaaaatttaattaaccttgagagagtatcctgacagagaatatttttccagttatagggataaggacatatctgagtgcattagacagtcttatatgatagcaaccaataaatctgcaaaagatagctttaatcactgtttaaaatctatacataaacttacaatacttttggaaatgtttgacatgttgggaaacaaaatagataagagacttgaggttttcttagtggaagcagggagacaaataaacagtgtattagatagtatataggaaataacatggaagaagataatggaataggcgtagctgttttacacagagcagtaagggagggccttatggataaaatatcatgcgaggagaaaccagaacaattgagaatgggagatacaggacttctgaagaaatggttttccagattgatataacagcaagtgtaaagaccctgagggaggcacatgcttaatatcttcaagccagagcaaggaagtcgataaatctaaagaacagacatggaaggagaaagcataggaaattaatcctgcaaattagcagagaccaaatcacatcggcaattttaagggcaatctctttagtatgagtgaaacaggtgatcctttattctgagtgaaacagggatgggaaatttgaaagtacaaaagtgatataatttgaactaacctttgaaaagtttgctctggatactatttaagaacagattgcagggaggcaagaacagaaagaggaaaaactaacaacatagcaagaaggactattgcaatcatatgaatgagaaattgtggctcagattcctattaacactgtagggctgaaaaatgttagattctggatttctaatgtgttgctgacaggattttcctgatggagtgcttgtgaaatgcaagacagaaagatgagttaagaataactgtaaggtttttggccttagcaacttgaagaatggagttttcgtttattgagatgagaaagaaggaaaaggcagataattgaccgttatgtaaacttttaaggttgctcaagctctaagagtagtctaaataaaacttggagtcatgacgaggtctaagaagactgtaaatataatctctctttggttatacggattaacttctagagatgttgatcaggtgtcacaatgagtgagagatgacatgtaggactttttatgccatgttaagggactatttagccataaaatgtatggagccctgtcatttgcaacaacgtgggtggaactggagattgttatgcgaattgagccaggcacagaaagacaaatatcacatgttctcacttacctgagggatctaaaaatcaaaacaattaaacatggatatagagattagaataatggttaccagaggctgggaaggttagtgggggatgtgggggcggctaggagggagaggggtatggttaatgggtaaaaaaagaaatagaaagaatgaaaaagacctactatttgatagcataacaagatagctatagtcaataataacttaatcatatagttcaaaataaccaaaagaatgtaatggtattttttgtaacacaaaggataaattcatgagggggataaatacctcattctccctgattatttcgtattgcatgacttcatgaaaacatcttaggtaccccataaatatatacacccactatatacccacaaaaatttaaaatatttttagaaaaaaacaccttatgaaaatcaatcagtacaattttgcatctctaaatacattaaatgcatgtttatagacacaaatgcatgtgtaaatgcatacacatgtagagacacatctgcaaacatacacatgtaaatacatgccagaaaaacaccgtaatatgatatgaacacaagcactgtactggaattcaagtcagaatagccacattttgattcacatttaccatctacttagcatggtaaacttagtgaattatttgaccttcgttctacatctattaacaagatgattaaatttgatgatagctttacatttctacaagtcatactttcacattttgttttccaaaatactttttgtcactatagtacatatttgacctattggatattgccagcagaagtgaagcctagttattatgttgcatctttcttatcatattttttctcttttatttaactttagccttggatcaactgtgcagttctcttgtgatgaagattatgtcctacagggcgcaaagagcatcacctgtcaacggatagctgaagtttttgctgcttggagtgatcacaggcctgtgtgtaaaggtaatgttttataataatgccctctgaacacattttaatagtttaacctttatttcattgtaattaagttgcaattaagtctttgaattgtaatataatctttaaggaaagattgtgctcatatatttattgatatttatagaaaatctgcaaaatgtgaatcaatctattaggttcccaaggaatttccaattaataatcatacaacatagactgaagaataaagtatgtaatacaagactctggaaacattgtcggcattttttgaaaatcacaattaccctgtctgtataggcaatgatacagatattttaaagccgtaatttcttctccacttgcatagtttgccatttgaattgcttatgtgtccgtgtctacaatacttggtagcagtcaaggtagagcacaggttctacagttagttaatttaatctagaacaaaccagttagttctctggctttatatgtcacattatcaataattccaaataagatataaatatatatcttatattatctgcatgtgtgtatatatatgtaagatatacatatgtatatatatcttatctggaattactggaggtatatatatgtgtgtgtgtgtgtgtgtgtgtgtgtgtgtgtgtgtgcgcgcgcgcgtatgtgtgtacatatatatatataaataccagtatgtgtatatgtgcgtgtgtgtgtgtgtgtgtgtgtatatatatatatatatggcaaaatattgactggacaaaactcattgaggacaattttaaatatagaagaaaatattatgaaaggcaagtgacattttgtacagctacttagaaaataaagaaaggcactaacacaaccaactggggtacctttttatttttaacatgggagttcaaatgtattaaaatcatctgactttgtagttgagttttaataagtaattcacagtgcaaaacacctgattataagtcaatttgactacccatagtgtaaatatcatcatctttaaatactaaaaaaactaacagatatgccaatatcattagacataaacatcaaggtttgcaagaaccatatcattgaggtcagtctgatttcaaataattcctcccagtagaattaaaatctacacctcaaatttaaatatctgtcactgacttgtgacagagtatagaaagaactattatctcattgagataaatgtttaaaaatatgaatataattaaatgatgttatatctatattattatactccttcttcaccttctgactgtttctttgccatctattccacttgcttacctttttcttttctttaactgcttgtgaccacttgtaggaacaaacatcaacttttttaattcattaaactgttgtgtcaatttaactgttaatcatgaaaactaatctttcccccctcctttatcctagctagcacatgcatcacctttcctcagatgaactatttccacataaattaaataagcctccttctttctaaactttataaaactgtgtttgaaaatgaatacctcatcatgtcgtactggcatttctgatggcttgtttgctgttctggtggttattatttttaataatggtgtttctgcatttttctgtgtctctgtactcgagttctctctagctcttcttctctttaaatagtatagctgccaaacatataaagaaacttgaccagtttacacccaaaaaacattgtctataaaattcaagtattcctatgatacgagaaaggcacacttttttatagcttagaaagaagcatacagtatctcatattttcttataaagtgaataatgaataatacattttgtaagggttactttcatgaatgtcatggcagtaaatagaacagtaaaatgttctattttactgattacacaaggctgatttcttgtgtccttcactcaagatgaaattatagccataaagagcaatatagtgaacatcatggcttcaaaatgatatgtttcaaatatcctacttcaatgtcacataaattagatatgtgcatttttgttagcaaaaatggatgtgaaaatagatgacagagaaaaggagattaatgttaatgtaggaacaaaatctcacaccagaagttatagccagatcatggaatttaagatctacataaagtaagattgagactacatagcatctttgttcattcaagactctcattttgattaaaaagatgaatcatacttatgatagtaaattgttcaaaggcaaaaataaggtgttatattacattgttatttttttataaaccccatggcacaaagagcagctctctactgacttgaatttcaagaactatttgttgaatattaatgtatgattggactttttagattgcaagatacattatgttatatatataacatatgtattcatattcaacaattattatataggaagtataaaaaaagcacatgttcaagattcatatgttgatattatttcatttaaatttacattttattttgcagatattagacatagctgcatttgctcattgcatgcaaggcacgtatgtgtatggtttacaaagtccattttgttgctagaaattactggcggtggtagtggaaacagtaatggagggaacatgctgaaatagtaattgaagttttaaaatgactactgtgagtctggacaaagagtagttctcatgtctcatgggttcttggacagaataaatatgctttttccagacaacagcataaattgcagtatcagtgcactgcacctttgagagattattaacatagcttctgtctgtgtattgcatggttgagcaatcaagaaatggtgatttttaaagggattaaaagttcacacagacagcaaattatgaattaaaagagcagtttataaattaatattaatattttttacacaaacagagacaattcttattccatagatgggttatgtatacaaagtatttgccagtttacagtggtgaaaacaattattcccttgttggatatgcagtagatatccaaaagctggagcttttgcaaaaagtagccttatgtgttgaagatgtgtagaatgttcattttagaccttcctgatacttaaagaaacagtatgtggttgagcattgataattttgataatgcggaaacatttaaaatagttaataataatagactgaagaaaaaaatggcaaattttaatctgtttattaggatggtaccaagtaatcaaagtccgttaagttacaagggcaaaaaccactcatgggattaatgaaatgggtaattaagggaggatgagaaaagaagacaatgaaatgggaaaatactaaaaacaaccataaaaatcatgacatcaccttttaatttctttattcaaaaagcatgaaattgttattattcatttattgttgtactgatcaatttatttttattcattcaacacttatgaacatgagtaggtattctagattatgtaccatatgtgatatagagtataaaattatttttattattttgtattgatttataaggcgtaaacacaaaactagataatatataatagacttgtttacaagttagtgcaagcctctgcaaaattcagatgaggaagattatttccatgtttggaaatggccgttgagttggagaaaataatatgtgggcagaacttggaaattattgtggatataggcagaggaagatggatgtgaaagtcatttcaaatgtagagaatgtatcatgggcaatcacaatgtgaattgacacatctggggaatcagtttggtcagttatatgaaaggatgtagagtgagataaaattggagaggttatcttatgtatctcctggtttgaaatatgtctagaagcactcctaaacttccattcccattgtcactattctacaattccaatacggcaactatcacttttattttcatttagagtacaatttatcccacctgttactgacagattaatcccattaaagtctcgctttatggatggagacaatgtgttggtggtgggtgtggtgttgctgcagcagttgctgatgttgccgattgttaactcttttgatttccaaaatcacccatgatttgcctttaagcaactttttttttaacttgtaccaaaagtttatcccaatgtctcaataataaacagaattgccacctagatattcatatatgtctagcctgttcctgaatgaccaagccaacctctccaggtcttgttcagttttcacctcctacaaaaattctttcctatttcaatattcccttatttcctcatcttcaaaattactttacaattactgtctttgccacacaatatagcatttaattttattttgtttggcaatgctccctaatcatttcatggacagtagacttgcttcttcaacaaaagccacctcaaaaagaacaaaataatcaatgcctctaaagtgttcgaattttgaatggatctgttccagctgttgccaaagaggacagttatcaatatggtctacccatccattactgttgatagaataaaacaatctaaatgaggttcaattcctttctttataaacaatggaaaaatgggtgtacaggttatatgatagacaactactggtcaaacgtaagagctgcgaccctcactaactcatgtttattaaaagctcagggtcttaactttttcaaaattattttacatatgttacaaattccctcttatatattattcctcttctcagtgtttagctcagtgacccactgcacccatatttttatacatacagtagctgctataatagtttaagaaatattataggaagatttaattaattgtaaccaacagtttgagaaggtagtaataagatcattgcaactacagaaagttgctctagtaggcttcctgttatgcaaaggtaattagaaaattttgcccaagaacatatcagaacctgctgaaatttatcagccagaaatgcatatagcaggtgtttttctgtagttgttgatgccttcttagttttgtggaacattcttacagatgaaatgatgcataataaggatgatattagcaattaatagagtgacatatggtgaaggagataggcagatggtgtagatatggaagtttatcacacattcatatttcttagtggtttttttttctaaaagccatagtgtgaagctttattaaaccattttgattaggaaacaagccttactaagctctaacaattaacaggttttaatgatatcacttacatgttatttgatggagattaatagtgatgcatttatagacaacttagtagaagatagatcacttaaattcaaaactccctgaacaattagaaattttgcatttcaagggtgcccttccaacaattgtttagaaatacattctatacattttgcctagctctcagattattacaaaaatatgcatataatgaacaaattcttgattcagttttggtacatagcaggaaaatctccacagatatcaaagagaacattttctttccaactcatcattttctaggagtataaccttgctcatttgcttaatatcttctgaacatcagtttacttatttgtaagttgatgagggattatttgtaagttgataagggattgtatggtctcctttcagttgcaaattctaaatattctgaagtatattgactgcttctgtattgaaacttgttaaggatatttttagttcaatattcttctttacctttgaatgctgagaatttgcctcagttcctgaaacacacaagcaataataatttttaaaaattttaataaactcttgctaatgaaatattatttttattgcattatgttttggatatttaaaaaagacaggtttcaaatttgttcagtgccagaatgatggttattgattgtaaaactgcttcaaagtaatttagattctgcagatctcttatgctttatttaccattaaaatctacctttgtatataggtaaaagattatttgtcttcatgcatttttattatgaagtgcacccttgtaatatgttgagtttaaacaatgtatctttagaaaaataaaggtgattataatgtcattgttgaaaatgctatacactaagatatttttgagagttttcaaatgggaaataaatattttaattcttaaaatgtattagtaacaattctaaattttgggagagaaaaatacaaaagaaaacaactctttaacttttagctaatataattttaaaagcctaaaaatttgaaatttaatggggataaaatgagctacatcatgcccaaacaacaactaaccaaggaaaaaaagactgcaataaccatattagtaatgaacgctttcgctaaactaaaaaaccaagcactgaaaaaaatctgaaatgtaatgtcttaatgcaaggatgaacaaatgaaaagctaataaaatcagcacagtgattgcaattttggaggagaagctacctatataaaaggaaatgttgaaaaattattaaaatagaataactttttgtgttcatagtaaacttatgaaatctcttaaaattcccctgtgatgtagaaaaacttatttcctatatttgctgaaaatatgtgctactagcaaaaagcatcttgaagatctgtgatgacttaatagcctttccactaattctgatcacataaaaagttggaaaacttaaatatactacagttaggattcccttatttagcttctccacagtaaaatctcactttgtttcaaaataatagctgggctagctctgggaaggagggtttatagataaaagtgatcacactgtaacctttagaatgtctgttgctatgtatatgcactcaaaatgtataattgtaccacgcaaagtgaaagaaacaataggaaagggaaaaatgatgaaacctgggaaccaaagaggaaacaaaaggcataggcagaatatatacagacattattgatgagaaagagataaacttttatcctttaaattgaatttatttgaagttgtaaaagtcactggtcttctgcttgatatgaatcttcagaatttatgacattttggcagacctttcctcatattaaggcatgaagtatgttcttctgcttactttgtcttacagtaatttttgtggagctaggtaaatagtgtcaacatcccaaacaaatagcaatgcctggcacatggcagatactcactaatatttgaatgaatggatgttttgtttaccactatgctagacacaatgtaagaagcacagagcagaactgaacaaattatgccgttaagaaatgtattatctcattgaaaacacagtacattcaaaataaaacaaccagagaacatccctaaagcaacagaggcatggttgcacagtcaatatttgtcataaagacaattcaaaacaaaggaaagacagaagacagaaatgatagtattaccctttgggaaataaatttcattggacatgaaaataccacttggtcattttatctctgaggttattattattatatattattcccttattttggaaatcattcttttgtttatttaataacattgatattttgtggtaattattaggtaaggggagggaaaagatgaatttttctcctcaaagagatcaatgggctactccagtgggaaaaacagcaacgaaaaagtatgcattactatatatcacaataagagctactgcagaaaaatgaatatggtgcattccgttcaaagacgattaaggaaccactctgcctagaagagtacaaaaatttttatagaaaaggataagcagggattcaaaaaggacagaaagaaagacagacatagagattgaaaaatgtaagacattaaagatagagacaactaagtataaagccacagggtgatgaaaggaaccgtagagggagagagaaagaaggagagagagagaggagaaaaaaaaagaaaaacagagggagaggggtgagtgaaatgtggaggagcataaacttattgaggatgggaaaaatctctacctgcaatgaatttactctcaagggtgggcgccaagagttttaaaagttagtatataattacaatagtttattgtaaattctatgctaagagctatacaaaaaaggagtgctcctctaagcctcccagcacagacctgttgtggtctgtggactgtaaggaaccaggctcacacagcaggaggtgaacagcgggcaagtgggcattaccacttgagctccacctcctgtcagatgagcagcagcattagattgtcataggagcgtgaaccctattgtgaactgtgcatgtgagggatctagtttgcatgctccttatgagaatctaatgataaatataatgtgcttgaatcatcctgaaaccataccactcctcccccgagtccatggaataattatcttccaccaaaccagtccctggtgcctaaaaggttggggaccactgctctagggtactagggattgttaaggaaggcgtccacagaaaaaagtacctgagttgaaccctgaagatgcagtaaacaaggctaatgatgagaacaatggtggatgtgcagattacaccagattgagggagccccgtgggcaaaggcttaaaatattagggaccattatgttttagaaaatggagtatgaacattttttttccatatacctgttggccatttgtatgtcttcttttgagaaatgtctactcaatcatttgtccattcttaattgagttgttttcttgccattaagatgttttaattcctcatatattttggacataaggcctttatcaggtatatggtttacaaataatttctctcacttcatatgttgtctcttcaccctgttgattgcttcctttgccgtgcagaagctctttagtttgatgcaatgccatttgtctgtttttgcttttgttgcctatgcttttggggtcatatacaggaaatcgctgccacactaatgtcagagagacattagttttctctatgttttttaaatagttttatactttcaggtctttatttaactatttaatccatttgaaattcattcctgtatgagatgtgaaataaaggtccaattttcttcttctacatgtggatatgcagttttcccagtaccattaattgaaacggtatcacctcacatctgttaggttgcctatcatcaaaaatataagagttaagtattggtgaggatatggagaaaagagaatctgtatatactgttagtaagaatgtaaattagtacagccattatgaaaaatagtatgcagattcctgaaaaaaataaaaatagaattaccatatgatccagcaatcccgctactagatatttatccaaaaaaaaatgaaagcagtatgtccaagacatatctacattcccatattcattgctgaattattcacagtagccaagatatgtaatcaacctaagtgtcatccattaatggatgaccaaatgaagaatcatccattgttttatatataatggatatatgttatgttatatatatatatataaaactccttgatcttaaaaaaatcaaataattgaaataagccactaaagcaaatattgcatattagattatcagtagatgataacatatgacaggaaaggaaggtataaaagcaataaatatgttgaaatgttgatacctttgacaaacttgaaaaaattcatgcctcataaagatatatttggttatttaatattcttctcataatgttatacataatggatatatcttatatttattttatatataatgtatatatgttatattacataacatatataatatataacataattatattttatatacataacaattaactaaatatattataatgtatacataatataatacataattatatataacataatacatacataacaattaactaaatatatacattacacataaatacacacacacacacacacacacacacatatatatgtacacacacacacacaatggaatacaattcagccttaaaaaagaaggaaatgttattatatgtgacaacatagatgaacccggaggagagtctgctaagtgagataagccaggcacaaagacaaacattgtatgatctcacttacatgtggaatctaaaaagttgagcctgatgactataactagtaataatatactgcatgcttggcatttactaagagagtaaattttaaatgttttcgccacacaaaagtatgtgaggtgatgggtatattaattagcttgatttaatttttcacaagtagacaaatatcaaaatatcatatatacattttttatttgtcaattgtatcttaataagctggagatattttaaagtaaatgaatgaaataaaatataaaagaaggaagatgtcatatggtttgagagagacaagactaagaattgtatccagtttgaagactagttcagtaatttaggtaaaaagtaatatgactttagattaagtgaatgataagaaaatgtagagaagagttgaaacagaagtgaattgagggaacaacaatatgaggaataggaggatgaagttgagcctgtgaaagactaaaataggagcagctagaagcaaagattcataaccagagagaatggtgtcatgataccacagcaaggagatattttataaatcagatgtgatcaacattgtgaaatgctgcaaaatggtcaggaaaataaattaaattcaacaaccaagaggccaccagtgacctgggtaaaatcgttttcactggaattagtgatgtataagccacatggctaataattgagaaataatgaggtgaaaaaactgaggctttatgtgaaaagtggaagcttgcctctgaagcaaaggcaagagctagctaggtttgtagacggaaaaggacatgcaatgaggaaagattgtttttaagatgtgagagactgaagtaatgaggacaaagatacaatgcttgagagaagttgaaaatacaggtgagatctgagccaattgtaacattacagtcctaggaggttaagaatctgagattcagaatagaggggatagcattgcccttggataaaaattgacacatactctcccttgaggtgaaagaccctgaggaaggagccgatgaaggtataatgtttttgtagggggaaatggaagaaggcatcattctcaaatggcagaaccctctacccctatttttttctgtaaagtaggtacagttatctgaggaaggaagaaacccagcagttctgtgatgaaattggatgaaactgaaatttttatgaatagggaggtcagggaagtcaccaagcagccactgagaaacaggatcttatcctgagggtttcatttagctcagtgatccccatccctggctgcacgtgaaaatcacctggagagcttttaaaagaaaaatccatgcctaactcccatcctaggttaattaaatcaaagtctctggaggataattcagttaatatatttctctctgtgataaattggtcaatttaactgcactgaggatcccgaaaacaacttaaaatgacactctgttttcttagggagtctctcccttattcatgaaccgtaacgtactcactggcaggctgattgggacatttaattacacatatcatatccttgttctacagagtggcaaagtggaagtttgatgcagtgaggtcactgagttgaagcagcagctcatgatttcctcttctaaccggacttaatccagatactgaaagtaatataaatttgcatgttaaatttcaaagatgaactcattttcatacttatcatgtattacgagctggaaatggcaccgatttacttctgagataagtgtttcttgggaagaaatgaaatgaggtcagaactaaatgaactgcacttcatttgcactcccactgtcccttttcagccatctttagcttatttattccaaggaaataagacacgacaaatgtaggtttgcagcatcgaaataattttgagaagaaaattaaataaccaaatatgcctttatgaagcatgaattttttttaaagtttgtcaaaagtatcaacatttcaacatattcgttgcttttatacatccctttccttttgtatgttattatctactgataatgtaacttatgcaatatttgctttagtggcttatttcgattatttgattttttaaaaaaaatatgtgtttaaaattttacacttctgttacattgttaaggccaatatttatgacagatttttaagtgttattttactagtacatatttttttagtttggggcaaggaaaaaggagacatcttggatgacttcttgtgtttctcatctgaaaaaacgatgctctgaaccaatttggagttaatataagtttatgtttatgtgcttgattttgggtaaacttttatttcagtgtttgaatgataaatattcatatttagtaggatttacaagtatatatttattctgaaaataaacactttggatgttctaatattgttactttaaccattaatatgtctcacatctcctagatatttctactaaattctgagggaaaaaaaaagacaagaaaacctttagatataaaaaacataaagcaaaaatggctttccattaagactatagaaatgacttctgaaaatcttctcacttaccattatttgtatttactttgttgtcttctagctaaagtttatttctaaattatgcaaggaggacacaggttatttttcctgcctgtttaagagtattttaaaaagaacaataaaacatcataaagaccatgctgagaaaaacttttgtgaaatctttattaaatgactccaattttcttcattttcatgaccataaaaatatttattaataatacatattagcatttattctgggctatgaataccaaagaccacatttgacttttcaaaaagtttaccctgtttactattttctgtcacaggaagtaataacaatactggctattgtgaacctatttttttcctcattaaggcaaaattgtctgatgaagttaaaacctgggaggaatgtgatcagctcattttagaattacaataactaagaaagacaatagtgaacattgccagagagtgtatttagaattttaagagagcagtttcaaacaaattatagaacagatattgaattgcagctacaaagttataaagatataagccactcttactttcaagtgctaaatgactagagtcataaagaacttatttaaagaaagacatttaaggaaactgaagttgtaatatagagactttactgagggtctatgattttaaagacatgtatgtatacacatatgacccagattgaatattaaatacaggatatacccttctaataacattgccaagctgtctaaagcctaaaagatttaggaatatgaaatacgttaagctagtatttcctaaagttctatttgaatattaataatgaataaatttggtagaaaaggtattcaatggtagtcagacaaatagatgatttgctgtattactttaactacagaacttggcagaatctctaatattatcatgttttttgtttatcattaaaagtagaaatgtagtatgtaacatagctaccaaaaaaatctcatctagctgaaaattttgaatgatgctggtgtgggctgtgttgtttcaataatcatgtaactattctcatctccagttcattccttctcacatttgatttacatatcactagtatcatagaatatgcttactttaaaacattactttttctattctgcagataattcattgctatatcattcaactcaaaaattgttaacctggcattttggagcctctaaaaattgactctgaactttttttataactttatttcttcttagttccaatcataaacactgttctaaataggtagatatgaccatggttaatatttcctcccaacatgcccctttagtgaaaagaagcccagacttaagaggacctgagttcagtctcctttactgtttatttgtaatatatattaaatttttctttaatttcttttctgtagtagtaattgtactgactacaagtaattaatgctataattttatagatgagaaaacacgtcaagtaaattgcccaagagaacacagcttttatatgtgctggaactgggattcaacccaaaatgtgtgtgatttccagctctatgttattttcactataccgtactgaattaaagagcacaaaacactgaagagtgcagtatatacaaactacgaatatgatgaatttcagttcagcttttcaaaagttcacgtgaagtttatggctcttataaaattacttggaaataagactgtcagtcccagcatacataagatgtttggccttcttagatagggactattcttttctgtgccacctaaaccctaactcagcagtacttatggattttgtctaaagaattttcctgaattaacttttcccttttctgatttgtcttttctgagtcattcctttgaaaagttcttccttcctttttaaaaccagtagtttctccacaaatttaaaaaataactatttggtaggtaagtattcacagtttcatcttttattttctttatagtcaaacattatgatacacattgacatacttcgttataattcagcagcgtaccctagatggtttgaggttacaattcattcacacattaactagctttgaaaaaggcagttttacatctgaatgtgcaaaccctatggttgtaatatggaagattaaagacaaacaaaaaggttgatcagtgaaagaatttgaatttaggggatgaggagcagtggaaaactttttaaagttattggaatattgagcaatatggaaagaggctgaaaccttgggagatgatagctagtgaggaatccttaggtgaggtgaaaaaaagatttatgagaaaaggaagatctaatatttaatcttaaactgtgttgctgccgtgtaattttcctaccttattgcactggcccaaaccttaagtgatgcttatccctagttgttgacagtggctagaaaaaaataggtaagaaatacaaagggcagttgtctccttttccaattattagagacgtttttttggttggttggttgcttgcttgcttttttgaagaagttgagggttctcagcttttatagaggtttaatttcatgaaaacatgaaaagttatatgggttgttttttggggtgaagtttttgatgcactgcctgatgggggttctaatgatgtaaacagtagtcattctgttgcagccttgtgaactcccatgaatacttcataggattgttagaggtacgtatctagaactgtgagggtctgagattttaccagacttgcaactaagactcacagtgtcttagttggaattctatactaaatagccatagattcggtgtcttaaagaagaaatgtttctttctcacagttctggaggctggaagtttgagatcagaatgccagcatggttggattgcattgagggcccttttctaagttgcagacagctgacttctttttatatattcacatagtaaaaagaggaagagctagctctctggccttttaaaagcatgaatctcattcatgtgaactcacccatatgatctaattacctcccaaagactcgcgccattcatgctatcacattgggtatttgacatcaacatatgaatttaggaggaatgcaaacattcagtccatacagcttgccacattttcacagatgctagcagaagtccaaagactcgtaggtcagagacgaagcatactttactactcacaacaaaagtagtagccagaatataagcattggtgccactttgctgagccccagttcccaaagggataggaccaagtatcggattctcatatatagtaagttgcattataggaaagaaaccttggccataaagagttgaaatcttttataattgatggtaagcattgcccacatctttgctctggagggagacactatctccatcttccaaaattgtaaaataaatttgtgttttgctttggaaagaacaactgtccctgaattccagtgctgtttgatgtaagaacaaccttaaaaagatattccagaacaaaagcagtcaatgtctttgcttgaaagatgtgcacaaccacaagaaacacatggaggattgcctcctaacaatacccacccctaacatccataacatattgacttttgatatatatgtgtgtgtgtgtgtgtgtatatatatatatatacacatagtatatgtttaataaaaatctgtttgtctaataaattgatttgtgaccaattaaacaaaatgaacataaggccgactatgttaagaactatgatagaggtaattgaaactaaaatgttattcacactgtagcctttcccaaaacatcataagctaagggcactgtctaccatatatctttattttgctatttctcatcaatctaaactttctgatgtattttcttatgagaattcccattaatcagatactttgattaatctgaatgtcataggctggaaccaaatccattccatttttatcatacaacatttaattaagatcattatcaacaggaatcctaactgcagaatgaggccaatcaccaggcatccagactcaacttgcagaacaaattacatcaacatcagtgtctactttagagaggcaggtggctttttcctttggtttttatattgttctttgcacttgtcccaaatctttaatgtagatactttaggatgcattaactattgccttggctcacaagatgaaaatctagggcaattctatcatctaaaacaaccctggccagtaagttgaggctgaccttaaggtcagaactgaggtggcatcagtgccttccagaaccgaggtggcatcattgatcacttcagctaataaatcagagactaactttataacatcttttctaatccaattgctcttattatcataggataaccaccttcaaggtcctcataaataatgaatcagcttccctcccagtagctctcctaagtaagcatggtagcctcatattggcaagatctccttagtcatctaaaggctttatgacctataggtattgttatcttaaaccttttttcaaatgtatttatttgttttaaatcaacagacaaaattgtatgtatttgtcatgtacaagatgatgttttaaagtaagtatacactgtggaatggttaaatctagctatttataaaatgtattatctaacattattttgtgataagaacttttaacattcactgtcttagtattttccaagaatacaatatatcatcattaaccatagtcaccgcgctgtacaatagatcttgaatgtcttttattgatacatctaaggtgaatgtcaccatattttgggaagacagcctagttaatatctattttccacataaggacagttcccagctaaacatcatgtctctgggggggaaaaagcattgtttaaatgtttaaaattatggacccctattcttaagaaggacctacatcagccagggcactcaagtttacagtgccttcaaagtgcctcccaaatggctagaaaactgtgagtttcccaattcagttttaatgattgaatctggtctttgtttgggaagggactctgtcttatttgtacatccaactagaaagttggcatttgtttacctcgtggaatgacagagtgacagctttcggaataaaggtagaaaaaatatctagaggtgtgaacaagtgttttactttggaaatgtagaagtttgagtcatttcctactgtttcccgtaagcttattagtaagaataaggacgattgtgttcaaatcagtcagagacatccagcaggtgatgagagacctatcaataagttaaatttacagtgtttgtaaaagtttaggaatcccacaccagagttttttcttcttaaaaaaaaggctccaggggtaattctgaaaaaacaaaaattattaacatttctcccttccccatactccctgaggtcttatggtaacctctatcccctcatgccagggttgttgatcccccttcgccaccatgaaattagtgtgtcccattctaataataataactccaccttgtctccagtcatcttatactcttttcggaacattttattcaaatgttttagggaacaagggaatttttgtaaaacttacaatgacttattatgtcctttactttagcccatgttagctgctataaagggtctcaggaatctcaaccaaatgataattatctttagaatctagcaatatttgagtccaacaacaataacaaaaatattagatcactaaagaagaattaaatttgaatctcctaggccatgttttcttttcttttttttttttttttttttttttgccaagactgccacccagatgttgtatcaagaatgactgtggttgccgttagggaaagaaagacacataatgctcagaaacggtcaaagacatcttaaatttgcaaaataggctgatatatgcctcaaccatttcatcattacctggaaagtagctgagaagcaatgattcccttctggagatagtctcattcaatgaccaaactaccttacaaagctttgtgggtcagaagaagtgggtgaagtagatttagaaattcttgagttcattccaactctcaacaactctcaatgcttatgcatggtagagaacatagaggttcatagaatgctttgactatcaacccatttttgaatgctttttgtgacaataggtcaatcacttttggactgtattaaatccgtagttttcacgtggcagactaaactgctagattattgacaacaatccaagagtcagtaaatccataaggctcatcaagaggggtattgaccagagatataagaatgaattctgcccagtgcgtatagtgaccaggttcatgttagttttaacatgactaacgctgagcttgaacagccacagcagaccattgggtaccttcatcaaaccaggttcatatatttagaagtatctctatgaactgaggggccactgcaccagatagcagagtagaagataaattttctcctcaaaggaaaagctgccattttttaaaacgtaaagctgagatgcccttgggactgggctggatgcattttgaaaatgccatttccatttgacaagcacggccttgaaccctcctccccttattaatcaataaatccaagttgacctaccctttgatcatatcaagctagggagtcacaataactatgggtcagacactgggatttaacaagagctgtgttaaacatagctgcttttgaaaaacagtgtgcttggtagtcttgccactgacaagtttgggacacctagataaaggctgtctccttttgccagaagcccagtgggtaaaaccattagtcacagacacttatagctcaaaaaagtcatcaaggtcatggggttgaaaaggtaatagtacttttctactggatgatcttctcacttgggagaatttctttgacattatatgggcattcacaatacaagcatgtaatatatgactactaattattattgaaaagtagaatcttcaacaatgttacatggaatttgctgaaaggctcttcctacaaggcctcattaactcctcttccccattttgaactttacccgaaccccatcaatttgatttgagaatccagtgtcccacaagattgggtagaatggtaactgaggtgcctgtatctaatagagtcataaaagtttgaactatcctgtctactaaatttcccaggatatttccagcaaagacagctgagaatggtctttggtctccactggggatcagaaagacttcagtcccatccctgatcatccttgtctttaaagtagatgagatcatttaagtgggagaaggaaggaatcaggaaatatggaaggagagaatggttttattctccgtttatggagggacagagccatgtgtatttactttcagttttgagcagtacaatggcggatttcaagaatttttctaggtacttcagtcagtttctcatcctccagtagtaggtcaactttgtcagaattgtaaactcagtctggggtagtaaaagcctaactattagaaaatgtttcatttctagtttctcatgggagattgttcagtgaaatcttccaaaaagggccaaagcaccactgtagcagcctggacccactgacaaaattgtaagatcttttaatgttgtatttaaatggacctatgattgccataacacactgcaaaagagtttgagtcataagatggtcctgcaattgtcatgtttccttatcaagtattaatctcactgcccctcatatctgaagcaaaagtcaaaattctcacaatttgcctggcttcttaccatagtggccattatttttctttatgaaatatatttcttatattcttagtatacataaccttcaccataacttgtctgaaaccaagtagaaacttctgccacctctctccagtaaaaatgttaatactggttattactacagtgtgcacctgagactgactgccagactgttgagaagtatccctatcttaaggagaattaatgtacctgttaggatggctatctctgattctaccttataatactcagccagaagcctctacctaatatctcctcattaacagcaataaagtggaggaccatttattgcctggttgaccattaaatttggtccatgtagttgccactgatttccagagacatttctaaaatcccattagttggcctgtgagaccctcattcttcttcttttaaagagctttttctctgtcagcatcccatcttcataaacaaatttgttatggactataaagtgtctgatattttaccatacttgcaagttaacaatttagactgccacagttttatggatgccagtggtagtcaaaaggtgcctgggtcacagtttactcccagcactaaagatagccacagtattagcctcagtgccacttccttgacccccaacttccacagtatcacatgaagagaacaaggtatcagttgcacatactatgaattacaagagaggactgagcttagaggactcaaatattttataaagggcaggcactatattatgcctgtcctattgctccagactctagagagagacacatctcatcttccaaaatttaaatgcctctgtcattttctctactaaggatgttttctatacaaacattcttgaaaaactagtccagaacaaatggctttgcatgtggaaatatatacacacaagagaccaatggagaattgtctcccaagagcttgcaaatagcctactgaatcccaagggcactaaattcctcctcagcagcctgctatgattccatgggtcaggactgccctgatggctctagaaggcaatttacctatttcctgcccatgagcacagagaaagtgttactaatagaatgattggaaaaaatgtgtccacttgtagcaagtcagagaaaatagagagaaaaggaattacaaataagaaatcagtatactttactttagtaaacattacaactttccaaattgaaggtactttattctaacaaataaaaataatgtcatacaataatcctgttaagcgacaaaactaatcagaagatatatataagtctctctctctctgactctctctctctctctccatatatatacatatatatatatatgacactggttgttcgtacattgtgcacttgagattgactgccagattgttgagaaatgtccctacctgaaggagaatgagcatacctgtagcatacctgttatgatggctatatacgtgtgtgtgtgtgtgtgtgtgtgtgtgtgtatgtatttgcgtacacatatatgtatatacatatatatatatatatatatatatatatatataaaatagacaagcaaaattttgggttaggttggtatagatacctaacccaaaatatatatagtatatttctatatatatatatatagaaaatatatagtaagaagtctttagtgaatgctttagaatattaaaaactaaaatgcttagaatgaaaataacttttgaaaatatcaatgtgaaaatgtgcctatatgcacatattttaggccaatctgattattattttttcaaaagatatagaccaatatgataatttcacagtttagttctggatacttagatttctataagggtagagccatgaatgccttttttctgccccactaactagtaaatgaagaatcaaaaattctattagtttctgcatagtctgggacaattgtaagattagtgttcaggttattagaggttatatgaaagtactgaagtaggaatagacttaaggcacacaatgcattaaaattaaggatttaaaactttggcaattctataatattttaaacatttcatggtgtacatgtccgagttgtggcttatttgtataagaaattgaaattaagctcattgatcttatgcatttgtgtcactcattttcaagagcaagttctattcactttaccaagatgaattatttgaagagttagtaatgtaaactttgcaggttacacaataagagcagtataaattagtaaaaccaaagtttcaattttatgtcttctgcagtttcccttggtgttgtccaacaaagatttggggatttgtgacaaagaaaaaaatgcagcatatcttcttataatgatcatcttataattttatgtgtgataaaaagataaaacatactgtgattttaaaaataaaatttttctgtaattttgtatgaaaatacatgttggtgtgcatgcacaaacatatatgtatatacatgcatatatatatttgttatgttttgaattttattttattttaatattgaaacccaatgtcaaatttgtttactatgtgaaaataagcactactattaagtttatacattttattgttattgcattacttttaaactctatcattcaaattatacaaaataagaagtaaatgaagttaaatatagcgtccatttactaaaaagcaaaataatttactagagtactaatatctaacaaaagtcttttatgcccaagtaacataaaaattgggcttgagaaccgtgaatacaaatgaaaaccataatgcatattatgtgataaattttatgaatgcaaaagcaacagaaatacaatctaatcagcaagctaagcataattatattactggtagagaaactgaattattcaggcataagaaggacattctttgaaatcagtccaccaatatcactatcttcaagcactagaaaggatgtgactagtatccttaatacttttctcctgttggtttttattagacattgtaaatttatgaagctatttaacattggaagcttgcttaaaatattagtgtaatgtcatttgggcacagcagtaaggaaataataatttatacttatggaagtatttctatacgtataacaaataatctggttggcaaatataaagacagcgggacatacttttcttttaacttgaaacctccattttgttatttgtgaataaatcattaaaaaggagaccagtctgttagccttctaataacaacaataataataaaacctgaaggttagattataacaaaaataatatttcctactgcatttacttagtagtccttttatattgtatttaaagttagagagtattttgtctttcactttttcctcccgctttatgcctatttttttcactcttttatctcttcttaccacgacttcccctacacacacacacacacacacacacacacacacacacagagagagagagagagagagagagagagagaaatagtattttagggagttctcgatagaaataccacttttcctaaagagtaacattttaacctgttgatacttaggttaaaattaatctgggagattatttactatattgcccagttttctgagttctttatcagctgaggctcaagattaatcagtaagggaatgtaatcaatagggcaggaacaaatagaatcatacaggtagatatctagactatttcccttctcccttcacttccttcactcttagagtaatgatttcctcctataatgatgaataaaatgtctttatatgttcttaattaatttattccacaaatatatattgagtgcattctgtgtctggcactagagtatgttctgggaataaaacattgacaaataatggacatggtctctgttctcattgaacctactgaatgagaagggtgaaaagacaagcacacacatgcatgcatacgtaagtgcagttttataaaaataatgaagtcctaaggagcagcagcgtttggctctataaaaatattacatgggggatttgtttgaaatgggaagatttatctgatcaaacaatgactaaagtgacagttcaaagatgactaaaaggtatgcaaagaaaggagagaaaaactttcagacagagaaagtagtatgtgcaaaatctgcagctggaggaacaggggtgaagaaattagaaagccagaggaggtagagggtaaagattaaataatttctttggaatagcctgtagaggcaagaagagacagatgaggcaggtttttataggccaaggtatggaagcttgtttttattctaagagcaatgagaagtcattgttttttatagaggctatggatatatatattcagatttgcattttcaaaatataactggatgtagtatgaggaatggaaccaaatataagtggaaagtgtaatggaataaatataaatggaaacaaaatacatggatggaatataaagaatgaaaccaaacattgtccagacaagaaattgtgataacttgtattgttgtagtggtggtggaaatggagaaaactaaatgaatttcagagactctatagtaggaaaagaatctataagatttggtgatggattaaataaggtggtactgggtaaaagaaaatttggtatcataaattacttctgaatttcttgcttacaccatgttccaattatctatggctatgtaacaaatcatctcaaaacttggtagtctaagcatcaacaatatttatttttctcagatatctgtgatttggtcaaggctgggcagaaattgctcatctttttatcacttcatatctatcgggcagctccaaagctgggagctggaatcgtctcaagtttctcttattctcaggcctggagttgatgctggctgatgctgggatatgttagagttgtggccagaacacccacatgtggactttctatgtaggtgttagacttctttataagacagtggctagattcaaaggcaaactccaagtaaaagctctggagccttttatgacttcaccttggaaattattcagcatcacttcaccacatcacattcactgggaacaaattgataaagttagcctgaaatcaatggaaggagtgtcaaagaatatgtggacatgtttaaaaccagtacagataactcactgaaagatgatttcattattgagaaaggaaacaataaaaagactagatttggaaaaaacaaacaaacaaacaaaacctactttttcttcttctgctttttcttactctcttagcatctgttttgcattatctcctttttcaggactttatcacttgcaaactattgactcctaaaacccatctaaccttgaccgctcttctaagtattagtatctccagctgcttgttgtctctaggatgtctcaccatcatcttcaatttaagttgtttaacattaacactttatttttcctcaaagttgctccttttcttgaaatatttcgggaaaaatcttttctgttcagtctcttggatttgtctttgattcccctcgctcagcaccaatcccattcaattgccaggtataaccaagtccactttggcagccatcttacatccacctattcattttctttcctttatgtgtattttaaaattatttttcagccttactcagaatattctgcacatgtgatcatttttcttgtttttcctagaataaatcagcttatattttttctcagaattttgctttgggctttcctctttctggaacaattttcccagaaatatttacatatcaggttcctataattcattaatttatctattcaggctccacttaccgtcattgctgaaatatctacctattctaattattcgttttgccctttaaaaaatttctgcaacacattattttttaaaataattatgcttttataatatatatatagcttatataccatttgtttgctgatatctctcattagtatataaactctgcgtggtcagacatggcatgagttttgttgactgttatatcaccagactgtctcaaaaagagggagtgaaaggcagtaagcattcaataaaaagttactgaataaatgaagggacaaataagaggaatgtgtagacattacttagccttatagccttctaagtcaaactctcatccatgagcctttcttttccattctagcaaaaagtgattacttcctcttccaaactccactggcatttattatccattccagtgttagtgattgcttatctatgataaatactatcaatgtgatatcttgtgtgtgtgtttttttttcaattctctttatgtcttttaattttccagctaaattataaactcctcaaattactggttattttccaagcaattaatacattagtagtagcaagtaacatgaatagacatacctgtatggacttatgctacataaattcattccatgcatctaaatccgtcttaattttagaaggttgcgtatttgattactaaaaatagcaacaaaatattgaattatatatatcagatattatactaatatttctgtctatattatctcttattttcacagtactctgttgtgtcaattattaatttcattttctattgagatgagacttaaacatataagtctcaaggaatttagtctcaaatctccagcaatgaaatattgagtactataaatcagatattatactaatatttttgtctatattatcttttatttttatactaatctgttgtggcaattattaattgccacagtctcaaggaatttagagtgctcaccctgtgacacacaactaaacgtgacaagatgggtttcacattccactcttcttcacttcagagcttgcatcatttaccactttgtaatgcaccatttcaatgccatctgggtctatatgctgatacaaatgaatctctcacagttgaggctataatcctgaaaagcattttttacatttggaggtatgatgatctcttggaacttgaagtggtaagtaaaaatttctgaaatcatctattttcaaaacaaacccaagtttgatattacagaaaccctttgttgtgtttcttgtttgtttgtttgtttggtttttaggatttagacttggctttaaatccaatgtattttaccctgggagtctctcttatttattttatcaagttacaacacagtgcctttgtagcccatttctgctcctttaaaaattattatgatagttacaaaattgttttcaggccttgacctttcatatccattggaagagtatactgttctttctgtatattactttgtaaacccacttgtacttgtacttgtacagtacacaggaacagaaagcaataattaccatcaggttcttgcatgtaaggaaactaaactgaatgtaagaagaacacaaaatttaaaatcacactattagaaataaaaccgtattatctcaaagtcacagttagcaatattgcagttggtaaggcactcaaataccagagagtctgcctcagagaatatgcaaaatatggaggaaggattgggaagaagtcagagaaacagggattaaatctctgctccaccacttcctgaccaagtgacctggaggaagttagttactttatctaagccagtgagtggttctcaatggtggctgtactttagaacaatgagtttttaaaaatactgatatcctgttcccatccctagatgttttaatttaattgcattattgttgggaattgcacttaaatcagaactctgagattggaacctgtgtaccaatactttaaaaggtttaccaggtaattccaatgttaccaggtaatcaatgacttaatctagtcattgattctcaatctttgctgtacattgaatctaactaaaactttaatttccttatttgggaaatgtaggtaattatatctactgccacaggttgttgtgagagtttgttaagataatgcatacagtgcctggtacatagtaaaaacccaattattaagctgatagtagtagtagtagtagtagttgtagtagtagtagtagttttgtagtagtagtagtagttgttgttgttatagtagtagtagtagcagcagcagcaacagcagtactaatagtgccattattattcattctttgcctatagctatatattgacttaatttatctattcatttattcaacaaacaattgctctaaatctgctctttgccagttacgattctgggctctggagattgaatggttaacaaagcagccaaagttcttatttttatagagctcgcattctaaggtaggcaacacaaaataaacaaatactgaactaggaatagagaaaaattgcaggttaagtactgtgaagaaaaactgagggaataaaaaacagcctgctgttgtggatgtgatggccagggaagtcctctctgagatgccatttaagtagtgttgtgaattgaagacagaaaatatgcacatatctgaggaagctgtattccaagcaagcagtgagaacagtaagtacaaaagtgctggcagtaggtgttgatgtttccataaagcactttcccataatatataaatcaaatttcagtatctacttcttttaaaaaactacctgtattcttccttttattgaagggcagtaaaacttcatatatgtaggactcatttgttggtttgataccataataaattatttttcaacaaggcataattacccctattttccaaaaatggcaatgagattcattaatgttcagtttcatattaaggtcccataaagtatagcaaagttggaattaaaactcaaggcttttaattcatctttctatagagttattgaatatacaatctttgaaaaaaaaggaacaattttttatatgtgttaattgtgataattatataagcaaatatttgaaaacattcttggcctgtgatcacatttgctcaactacaccaacaaaaaataatatattcctgggaatggcaataagggagagaatacttagtaatacatgtacaaaattaatggaaaatataaacaaatacatggatttctaataataataattaacagaggagatagaagttaatacatatagtattcattcatatttaataaacatctacaatcccagatggataaagatcataagacttttgtagtatacataattttatattcccacattttctgccctgaagataacacatttacacacacacacatacacacacacgtgcacacaggctcaccttaatttagggagttagagtagcctcttggttaagagaacagactggggtcagatatatggagatttaatttcctattctacaatctatgtatatgactatagacaaattatatataagcctcagtttcctaatgtataaaacagaaataaacccattttatacagttgttacatgtacatcaaatttttgacttagtagcaagtctgaaaatgtcatacaacctgacattttgcctggttaaactgaattaacttagtcctttttagttcctgtttcatgaggaaagagggcagaaccatgctaaatgaatgaactaggcctagatagaacctgatacctggaaaatcagaaccctctcccttcaagcttcatagcatttgaagaacagccactctgctagagctgtctccaaaaaacatctgcccagttaaagtatttctcatgttggatgataaagctaaaagtactaggtataaactgtgggtgagaaatatttcctatcaataatcttgatgaattgattgattgctgggcagctcgttgtgaaggaggctctatggcagagtgcagtgctgctcaagattgaatgtgcagagttatcacttggggaattcaaaggcggttctggctcagtgaaactcagtaagaacctagacttcgcatttctatcaggcttccaggtgatgcgacaactgctgcagatcacacatcgagtagtgagactaaaggaaaagctattggattggatgttacaagtcccaggaggtctgtcgtgtggctttggaacaaattctcttgatgtaaaaatgagaataatcatactatcctgctctctgatggaatgtgactattaaaagactacatataaatattaatatgtatagatgtatgtatttcatagagatctgagagctaactgcaatcttgtaaatataaatgtctattcttaattatatgaataagtaataagacaatgtagcaatccttagctctcagaaattctgaagaacaaaacattaactgactgctccatttatactataactttctcacctccttcattccacatttttcccacaaaaaagccatgcctattaaataagactgaagattgagaaacaagttatatggctgaggttttgtctttcagaaaatatttagtgagcatctatgaaagtcgcatattagtgaaagtcgcataatagtgaatagtgaaaatgaatttagcctatgcttttttagtgaaaaatgacagaagtttgaaagagggcatggagttttaaaagctgacctgtagaattcccaggtagttaaggaaattgagtaccatcttgaattcgggagcctcctgcagtagcatgggcttatcctgaagtatcatatgcttatgacatatttttcctacaatgtaaactcatttaatgaaaaagaattttacttggcattgtttctggcatcaggatgaaattgtatctattataggttaagaaaaaaagtaatgttacctcatgtttctaaaatggctgtcctcatatcaagacttttttctttctctttatgccagatacttatagcaaagacattatcattccctctaaaagaagtgctggcaatcattgaaagaactgtcatctatcttagatagtggcaatttaaccacatggtaaaatgctattgtcacttgatgcattttgatgggaagaatgtcactgatgttttatttctccctgatgttgaattttaatgggaaaataaaccattagtgccaaaactgaatacagtatactactgtgacactgtaaaaattgtgcatttaataattaacaagtgctttttttctgtgttttcttaaaactatattcatttcacatatattacacataaaaacacattctgaaggcaactttcttctctgtttcctcagcagtgatgatctggctgtttgtcagggcatgtcagaagataggaatcttacatggggaacactcaaggccaattatcaggatttctctcctgacaacctgtctttaaatatattgtcttacaagtctggaggtaggaagggagggtagagtcagtaagattttagttcatttgatttattctagtttaaagttactttaaaaagtgtataatgagtttacatctgtaatatgttaaaaatacatttttttcttttgaagaatcccaacttttctgtttcacaggaccaacataaccgccgcccaagttcaaatttgcctgctcttaattcaatttgaagttttcccaagcagacatgaaatcattgaatatagcttgtaagtttcaagttaattgcaagaagacaaaagacacacatttccataggtgctgcctggaaatacttgggcagcttgagatctagaaataaactaatgctaggctggtctgtgtgaatcacctcatttgataaagcccaaacttccttttttcaagtcccttgatgtttctcaagcatattagccaggtctctctgtctttaatgatatggaagaatgccagctcatctctcctccagacttggctgctgaaaggatcatggaggctgagtgccatctgagtccagaggcaatgaatggcacagctgaatatcatcagggtaatgatgatatctcattgctctctaaatctattatttgggacagaaatagagcaggggattttcctggcatttcaattataagaattagaaggaaatgtgaaaaacgtaggggcagcaaggggaaagttttggagagaaacccagggcatgcttaactttcctttttcccattagagaatacaatattgcaaaccagagatttgctttcagttttaaaacaaaccattttctaaatgatttaactttctaaaaatatccagtggaatcaatgtttgttaattggttgtcttaatattagcatttgaatgagggaatcagtgtgtccaaagtctcttgtacactccataagtcctcttggcctcatctcttattccagtcaacgctgtggtgaccagttaagtttcatgcaggtgcacctcatcatgcctctgtagacttctgcatcttgcttcctgccctatggactctctgacacctgggaaagaaaaatctgtgaacgtgagtggcctttacacaggcgctaacagaaattacacaagtgctcatattttatgagtcaattcttaacctacaaagcgatatgaacgaacaaataaatgcatctttctttcttctgcagtttcctctgtttttctgagaggaattttacaagtttcattggaggtttctgtagaatcaaactaaaattactcagagtggtagcacattggatggcacatgcatgtattggctttcctacattccgggcttgtttcaacgcctcacctgttccccattgctgctccttgagatcatattaccagcaaaatccttcacacataagtctttgattcatgcatagtttctgagtaacgtagtctaagacaggtaattttgtggggcctcctagcactccattggctttaagcctacgttagccagatcctatcaatctccacttaaccttttgcttggagtccaatgattcgattatccgtgcttgaggaacattcagaaatttatgtccctagagaatgacctacaggaaacacaaggatagcaaacatctctgtttcatttccacttgtttctgtgtatggccataatcccaaagggaattcagattatttccctaaacctcaaggacattgtttgtgctaatctccagggaatggtgaaatcactgatatgtttctcaggaatagacatcaaagacaatttctcccaagatttatatttgttatttttgttgttgtttctgttctatggttatatatgtacgtaggggaaatatttcctgaaacaatttgctgtggtttattgcaggaagtaataatgttggacagcttcccacccaggaaggcattatgtaaacatttttcactgactaataggatttaattaccaagtagaatactaactgagttgatttatggactaaataaatgttattttattagtaccatcttttgggtgatagtctaaatgctgtgaaaaatttacgacaatcctaagttcttggatcattcaagttttttttttttgcataaagactagtatcaaatagtttaagtaatcaaccatttattctttcaggctacatgatctttaaagtggtatgcactatccatactataaaataatacacagaaaatgtgaaaaaacttatgcattacatatttgtaaaactttgctcttaaaggaccagggaattaagaaaggtgtctaaatattggtaaaaatgacatgttaataagaaatagttttatctgtttaaacatgaaaaaaatcacatactacaaatgtatataagtagttacataatagtacttacattaatatatattcgtgttgcagataaaaagagctgcaatgactaattgtaatattttttctttaatactctattagattacctcaaaagtaaaccagaattgttaaaaattgaatgaatatttatagcatacaagataagagcttggactttgttttgtagctgtcctgggttcaaatgagcatgggtgagttatttaacttctctaatcccagttacattcttttatactattcaaaaaaaaaaaaaaacaaataattgtaacaacaaacacttatacagtgcttactatatgataggtgagctttaactgtataaattaatttgatctcaacaaacctatgaagtgctattttacctcattttaccagtgaggagactgaggtacagagagattcagtgactcattttggtcaacttgaaagtagagccaagatttggaccatgcactcaaggtccacttaaaccatacagtcagccctccaaatccgcaagttcaaccaaccatggatcaaaaattttcaggaaaaaaaatatgtaataataaaaataatacatatttaaaaaccaagagagtataacaattatttatatagcatttacattgtatcagtcattatataagtattctagagatgatttaaggtatacaggggagtgtgcaccatttgtatgtaaatactaccacattttataaggaacttgagcatcctcagattttggtatccaaggggagttctggcaccagttctccaagaatataataggacaactatatttatctcacaggtgctatgttttgttgttttgctctaaattattaaatactataaaataggcaaagctctaaaaataatatctagtatgtagtacaccctcactatgaatatttgtgtttgccatcatctgtagggatagcacagctaattcacactatagcattgaacacttcagcacatttctcaggataggaattgcttgaaagtaaagaattctacgacacaagataacaggaacatattttgagcaaacaactgatctagccttctttagactttaaaaatttgctcattttcttttcagaaaaagaaaaaaaaagaaaaagacagaagaaacatttcaaaaggcaaaaaagaaaaatgacttaacatttatatttgatatgtcattaaatgaatacatatgagttacacatgtacagacacaatgtcaaacaatttttttactaagcaatttggtttcagagtttcagagataaatttctatgatatttatattaaagatttatttaaaattactcttaatgtttatcctaaatcaacatcagaaaaaaacaaacaagtaaaaccacagaatcctgatattttgaatatatggaagtcacatctttcggattgggtaatatagaatatttactatttaataaatgtaaaaagaggtgatttctctaaaaatatttaggaacatgtatttcagtgccttaagatagtcatatagtagtgacctcttagcagaaaagattcatcactgacctttatttcctggggtaactcgacagcccagacatagtgaaactctgtcttcctaggatgatgaacagatagtgaactcttcattgttagatgtgcttacaagtaagaaatttgttcctccaatcacatgaccataaaggaacattgagaatgccaatctctttcttgacataatttgtacaactaaatagatatgaagactacacaagctattgagaataaagcagtaaacaaacaaacaagcaaaaacccagcatcattgtcattaattgtggttatacagcaaacttttattacacagtgttttttaaagcttagactctggcctcagagagggtttgaatctcatatccacaaaagaacatgaagtcaggagtagttttagtatggaggaattacatatatttcaagagcttgacaactttttcagtggcaagtcttacagcattaccttaaatatttcatgatattttattttgtgattggcattagttcatcaactatagtagcatatagttcatcgtaaatatatatatgtatatatatatatatactggctatttgtgtacatatatttagccaactctatgactattgcagctcaatctttcttagaaggctcctctgtttcacctccacagagtcagtactgtcattctgctacttggcatctcagatctcccagtttggtatcttaatcaggacatttcctatgactgtcaatcactcagtaaacacttactgattgcttacaggataaatcaaggaccagtcaggaataagatgtggtaattgtcctcaagaggctcacagtataccaaggaagaaaaggcagtagaagtaagatatttgtacataataagatagcttttagagataaacaaaatgagaacacaggggagggacccttagagtggactgggattgggtctctcagggacagctttccagaggcataactaataaaatcctcaaatacttgtaggaattagataaatgataagaaggtcctggaaaaaaaaggtatttaatttatgctaacaacatttttatttctttcttgagtgtaaaaacaatcatctattatagctttaatatgatcagttcccactgcaatggaagctgaagtttatacttgattcccataatttctcttttacccaaactttttggtaaagtaccaagtaaaaagaaacaaaggagataagcaaaaattaaagagattaggtggaaaaaaaaaaagatgtccccctaaattagtggctcttaatgggaaaggggctggattctgacagctgggagacatttggcaatgtctgggaacaagtttgattgtcacaactccccctcaattgtgggggaaaggatgtgccactggcatctggtgggtagaagacaggaatgttgctaagcattctgcaatgcacaagacatccctctataacaaaacaattatctaatccaaaatgtcagtagtgtggaggccgaaaaaccctacatgaatctgataattgagaaatctgcataaacacaaacaaggctatctagtatttttagtctgctaagagtcatagaagaagcaaaagtaggaagttcactattttttatcactcacatgggttgatactaatgggttagttgactacttgtaaaactgagagtgatactctcacatactgcaattgtattttgctctgagaataaggtctgtacattgtttgaaaagatagagtaaggagataacttggcatcttgaatagctcagtgcagtttctgtttcttgacttctaaagcactgttttactgtgtccaggttaaaacaccctgtggcatacttttaagatgttaactacagtcttgaaaaggaatctgtgagaattttaactacaaagatacttactggtgatgcagacagatttaaccaagggctctgtggcatactattaccttagagacttcagcctgtttagtgtctggccccaaacattgccagctcagaaactcgtgctcaaccttgttccacattggttttattaaggtactgattttttatactaatctcacatacaaaaaaagtgacaattggcaaaatattaatttgcattgaaggagactaaacagacatatgaaataattacaatatcctggaagagaaaagggcattatttaaaaaacatgtataaaactgacgaaaatccaataaagactggtacagcagtatactaagggtaatttcttagttttgacaaatgtaccatgattttgtaagagatgttaacattcaagggaactgggttaagagaatatgggaactctctgtacaatttttacttctctgtgactctaaaattattacaaaaaaattctaaaaagtggtattgaggaagagaataaaattaataagttggtaagtgatttttattttttaaactatttgttagaaaaacactacctatttgtaaattagaagcactgaaatggttcactgccatcatgtccctcaagtatcagtttgcaattatgttttctagctctcttactccattgaaataataacctacttattttaatttcacatcaaaaagaatatatgaatcagacattacaaaccaacgatttatattccagaagtagctcatatttatttggctattataggttgatatattttaaatcatttgtcaatatttgaaaatcgaagatttcatgtaaacatccaaattctcagtttctctttgaaaaattggaagatcgggcaaaacttggcctggggttcagatatgtgtgaacattttaagcaaaagtgtgctcctttatcctggacatctgcttgccagatggccacacaacccctcccttttattcaccactcccttcacatttaccaggtgggcccactgtgtgcttttcagaatgcagcatctgattttgacatttatatttcacttctcaatcttaaatatgagcttttgtgtattttttcttatttagaattttgagagatctgattcagctaatttgcctgtcaacttattaggctaaagaaattatttcttggagttcctgttatgaaaagtctttaacctgtttatgggcatcaaaagtttcttaagtgtcattcaacttgtttcagtgtggcagataaaggatggattcattttcttttgccatccagtgtctacataatttaggacaaatgtatttgttcaatgtaaaccgaagagtgtctgagacaagtctcaattaatttagaggtttattttgtcaagattgaggatgtgcccaagaaaatgagacacaagccacagtaggatctgtggttcacacgctttccaaaggggatcttgagatcttcaataaataaagggaaaagagtgggaaggaggggaaaagaggaaagcaaagaaagtagagtaggtagtgaaataaggggacacattcctatgaggctttaatgagcttttacagaatccatgtgcaaaggaagcttgtagggaaacagtcatttatgcattgtcatgctcagtaaatctgcatttttctcaagggtgggcaagggatgatttctagtcttatctttgtctcttacctgcaaagagaagctgttaatttacattgtcagggtgaaggaagctacctggggagacatgtggtcttgtatcttgttgctggttagtaacaaaaggaaaggcagatttttgcttgagactcagtttccaagcttaatttttccttttgacataaagactctggggtcctgagattttcttgtcctttcacatctgtatagctctgaatgatagttttatgctaaggcttccctatttctgatttctttttgattttcagaattttttcttagattgatataattataccattctacctaccagtctcccagaaaaaggaatgagtaaaataaactcaattagggatcagggaccttgacagttgacattctgtacaatattatgtttgttcctggaattaatcaataatattttttaaaaatattattattttgcatagagaaatagactctcctgtaaataagtgtttctcatatcctaggattcactgacccaattcccagcagtagtctcctaatcgggaagaatttgttcctttttctctttcctttatttccctttgtaaaggtcttgaatgccactttaggggaatattctacttgttgttaagcaggaaaaagtttctaatgaaacctcattattttgggaaacggttggctattatgctgccttcatatcaccaaggatttgttaagcccttcagtaaaataaaaagattggagtgcagaaaacagtaaatctacctaaaaagaacctgtttcaagttactttaaaaattgcttagcagcatcattttcataccaagggctacaacctgttcacaataattcttaacaattcatagaaacatatttataggattgtaagaaaatgttaacactttggttgttagatacatttgaaagaaatgcaatttaatgtctttaaaaaatgctgtttagtccagatttttaacatgctttgtctttaccatgccttccattatcttgtattaatgagcctttaattcgtttaaaaataaaaaacagtactttctaatatgactcctcaaaatgttgtaagtccccaaatatacaccctcaggacaccccatacttttattttgtagcagttgtttcatgattatataatcaacttgtttgggttgtttcctgtttgtctctctccctgtaacgtgaggtgcatgaaggagggcctggttcacaactgtgtgattattctcatagagttgagtgcatcatagttctttaatacatagtgtaggttgaatgagtgactgaatatatacataaatgaataaatgtctctgcatttaaactaaatggatatttcaaaccatgttgtacataataaatatatacaattgtatttgtcaaataaatatgtagaaagtgaaaacagctacatttttaaggattttatagtatatgagaaaagttataagactggacttcctgtagtcttgcatataggcttaccatattactctcttaaatccatctgtatatggcagctggatcgatctccttaaagctagacataggtaagtcaagtgccttttggatatccacaaagtatccccccttagcttgacaaaaaaacaaaaatccaacaactgtagtagcctatcatatatgacccccttgaataggcatttatttacatccccagcaccatcaaaagaattgccccaaatcccaacgaccttagatgttctgggaattccagagtttttctgtattcaatgtgctgtttagtgtgtctttccccctgcctagaagtccattttgaatttctattctaagattatgcatcctgacttttcgagattcagttctgacatcaccaccaggatgccttctctaaaatcagggtagcgaaaatgtctattcttttatggttccataactcctgattacttttatcttagtacttataggctattattacaagggcctgtttgtatccatttaagactgcaagctccttaagcgtaggatcccaccttattctttttgcattgaaacattctaagtcaatgtttagtgttgaataactatctccaaaaataattgtaacagatcatcaatattcatttgattttttctagaaagaaagattgtctagaattacaagtgataaccaaattactctgaggtacttttctgataagttgcctttttattgcatttaatttaagcattaaattgttaacttaagcctttttaaaattatattttggtatatttaatttttttattatactttaagttctgggatacgtgtgcagaatgtgcaggtttgttacataggaatacacatgccttggtggtttgctgcaaccatcaaactgccatcaacattagatatttctcctaatgttatgcctcccctaaccctccaccccccaacaggcccaggtgtgtgatgttccccttcctgtatccatgtattctcattgttcaactctcacttataagtgagaacgtatggtgtttggttttctgttcctgtgttagtttgctgagagtgatggtttccagcttcattgatgtcccagctctcaggggaaccagcacctgatacttcaatgtagattcttttctattttccctaagtgtcagctggtctgagaaataaagagaaagagtataaaagcgagaaattttaaagctgggtgtctgggggaggcatcacatgtcggcaggttccgtgatgccccccaggccacaaaaccagcaagtttttattatggagttcaaaaaagagggagtgtactaatagggtgtgggtcacagagatcacatgcttcaaaggcaataaaatatcacaaagcagaaggtcagagtgatatcacaagttctgggtgaaaccagaattgctaatgagggtccatgtcccactgggcacacatagtcattgataaacatcttagcaggaaacacggttcaagggcagagaacccatctgactaggatttactaggctggaatttcctaatcctagcaagcctgggggcactgcaggagactagggcatgtttcatctcttatctgcaactgcataaggcagatactcctagagcggccattttagaggcttcctcctgggaatgtattcttttcccagggctgttaattattaatattccttactggggaaagaattcagcgacatttctcttacccattttgggcaataagggaaatatgtctctgtcctgcccagatcccaggcagtcagacctaatcgttatctcccctgttccctgaacatcactgttatcctgttcttctttcaaggtgcccagatttcatattgttcaaacacatgctttatgaacaatttgtgcagttaacgcaatcatcacagggtcctgaggtgacatacatcctcagcttacgaagataacgggattaagagattaaagacaggcataggaaattataagagtattaatttggggaactaataaatgtccatgaaatcttcacaatttctgttcttctgccatgccttcagcaggtccctccattcgggatccctgacttcctgcaacacccagcaaaggacatgaactcattctttttctggctgcatagtattccatggtgtatatgtgccacattttctttatctagtctatcattgatggacatttggattggttccaagtctttgctgttgtaaacagtgctgcaataaacatacatgtgcacatgtctttatagtagaatgatttataatcccttgggtatatacccagtaatgagattgctggatcaaatggtatttctggttctagatccttgaggaatcaccacactgtcttccacaatggttgaactaatttacactcccaccaacagtgtaaaagtgttcctatttctccacatcctctccagcatctgttgtttcctgactttttatgattgccattctaactgacatgagatggtatatcattgtggttttgatttgcattttcctaatgacaagtgatgatgagcttttttcaatatgtttgttggctgcatacatgtcttcttttgagaagtgtctgttcatatccttcacccaatttttgatgaggttgtttgttttttcttgtaaatttgtttaagttccttgtagattctgtatattagccctttgtcagatggatacattgcaaaaattttctcccattctataggttgcctgttcactctgatgatagtttcttttgctgtgcagaagctctttagtttaattagatcccatttgtcagttttggcttttgttgaaattgcttttggtgtttactcatgaagtatttgtccatacctatgtcctaaatagtattgcctaggttttcatctagggtttttatggttttaggttttaggtttaagtctataacccaccttgagttaatttttgtataaggtgtaaggaatgggtccagtttctcttttctgcatatggctagccagtttccccaacaccatttattaaataaggaatcctttccctattgcttatttttgtctggtttgtcagagatcagatggttgtagatgtgtggtgttatttctgaggactctgttctgttccattggtcaatatatctgttttggtaccagtaccatgctgttttggttactgtcaccttgtagttatagtttgaagtcaggtagtgtggtgcctccagctttgttctttttgctgaggattgtcttggctatatggactcttttttggttccatatgaaatttaaggtcagacatggtggctcatgcctgtaatcccagcactttgggaggctgaggcgagcagatcacctgaggtcaggagttcgagaccagcttggctaacatggtgaaaccccttttctactaaaaatacaaaaaattagccaggtgtggtggcacacacctgttattccagctactcaagaagtctgagtctagagaatcacttgaacctgagtggcagaggttgcagtgagccgatatcacaccattgcactccagcttgggcaacaagagtgaaactttctcaaattaaaaaaaaaaagaaatttaaagtagttttttttaattctgtgaagaaagtcaatggtagcttgatggggacagcattgaatctataaattactttgggcagtattgccattttcacgatattgattcttcctatccatgagcatggaatgtttttccatttgtttatgtcttctcttatttccttgagcagtggtttgtagttctccttgaagagatccttcacatcccttgtaagttgtatccctaggtattttattttctttgtagcaattgtgaatgggagttcacttatgatttggctctctgtttgtctattgttggtatataggaacaattgtgatttttccatattgattttgtatcctgagatttttctgaagttgcttatcagcttaaagagtttttgggctgagacaatggggttttgtaaatatacaatcatgtcatctgcaaacagagacaatttgactttctcccttcccatttgaatactctttatttgtttctcttgcctgatttccctggccagaacttccaatactatgttgaatacgagtagtgagagagggcatccttgtcttgtgctggttttcaaagggaatgcttccagcatacctagtttattgagagtttttagcatgaagcgctgttgaattttatcgaaggccttttatgcatctattgagataatcatgtggtttttgtcattagttctctttatgtgatggattatggttattgatttgcatatattgaaccagccttgcatcccaaggataaagacgacttgatcatggtggataagctttttgataacgctgctggatttggtttgccagtattttattgagaattttcacatcgatcttcatcagggatattggcctgaaatgttctttttttttgttgtgtctctgccaggttttggtatcaggatgatgctggcctcataaaatgagttagggaggagtctctctttttctcttgtttggaatagttttagaaagaatggtaccagttcctctttgtacctctgatagagtttggctatgaatctgtctggtcctggtctttttatggttggtatactattaattactacctcagtttcagaacttgttattggtctattcagggattcaacttcttcttggtttattttaagagggtgtatgtgcccaggaacccatcagaaggtcaccgacatcaaagaccgttggtagataaatccacaaagataaggaaaaaccaatgcaaaaaggttgaaaatttaaaaaccagaatgcctcttattttccaaaggatcattgttctccagcaagggaacaaaactggatagagaatgagtttgacaaattgacagaaataggcttcagaaggtgggcaataacaaactcctccaagctaaaggagcatattctaacccaatacagggaagctaagaaccttgaaaaaaggctggaggaattgctaactagaataaccagtttagagaaaaacataaatgacctgatgaagctgaaaaacacagcatgagaaattcatgaagcatacacaagtatcagccaaattgatccattggaagaaaggatatcagagattgaagatcaacttaatgaaataaagcatgaagacaagattagagaaaaaaagaatgaaaaggaatgaacaaagcctccaataaatatgggactatgtgaaaggaccacacctatgtttgattgctgtacatgaaagtgacagggagaatggaaccaagttggaaaacactcttcagggtattatccaggaggacttccccaacctagcaagacaggacaacattcaaatacaggaaatacaaagaccaccacaaagatactcctcgagaagagcaaccccaagaaatataatcgtcagattcaccaagattgaaatgaaagaaaaaatgttaagtgtaggcagcaagaaaggttgggttacccacaaagggaagcccattagactaacggtggaactctctgcagaaaccctacaagccagaagaaagtgggggccaatatttgacattcttaaagaaaagaattttcaacctagaatttcatatccagccaaactaagcatcataagtgaaggagaaataaaatcatttatagacaaggaaattctgagagattttgtcaccatgaggcctgatttacaagagctcctgaaggaaggactaaatgtggaaaggaaaaaccagtaccagccactgcaaaaacataccaaactgtgaagtccatcgacactatgaagaaactgcatcaactaatgaacaaaataaccagctagcatcataatggcaggttcaaattaacacataacaatattaaccttaaatgtaaactggctgagtgccccaattaaaagacacagactggcagattggataaagagtcaagacccattggtgtgctgtattcaggagactcatctcaagtgcaaagatatacataggctcaacataaagggatggaggaatatttaccaagcaaataaaaagcaaaaatgaataaataaataaaaaagcaggggttgcaatcctagcctctgataaaacagactttaaaccaacaaagatcaaaaaagacaaagaaggacattacataatggtaaagggatcaatgtaacaggaagagctgactatcctaaatatatatgcacccaatacaggagaactcagattcataaaacaagttcttagagaccctacaaaaacttagacgcccacacaataatagtggaagactttaacactccactgccaatattagattaatgagacagaaaattaacaaggatactcaggacttgaactcagctctgaaccaagcggacctaatagacatctacagaattctccaccccaaataaacagaaaatacattcttctcagcacatcacacttattttaaaattgaccacataattggaagtaaaacactcctcatcaaatgtaaaagaacggaaatcataacaaacagtctctcataccacagtgcaatcaaattagaagtcgggattaagaaactcactcaaaactgcacaactacatggaaactgaacaacctgctcctaaatgactactgggtaaataacaaaattaaggcagaaataaataagttctttgaaaccaatgaaaacaaagacacaacataccagaatctctgagacacagctaaagcaatgtttaaagggaaatttatagcactaaatgcccacaggacaaagcaggaaagatctaaaatcgacaccctaacatcacaattaaaagaactagagaagcaagagcaaacaaattcaaactagcagacgacaagaaataactaagatcacagcagaactgaaggagatagagatatgaaaaacccttcaaaaaaaatcagtgaatccaggagctggttttatgaaaagattaacaaaatagtctgctagccagaataataaagaagaaaagagagaagaatcaaatagacagaataaaaaatgataaagggggtatcaccactgatcccacagaaatacaaactaccatcagagaatactataaaatcctctacacaaataaactagaaaatctagaagaaatggtatatttaattttacttaattatttattaaaaatttaaaaacatttgttgagcatttggtagatattataccttaagctgacttcttgtcattagaagatgcaaaatgtagttgctgacataaaggagctcagaggtaagcagataattaaaatataatatatgtgcactaatagaagtaaggatttggaagaatggattttagctaaaagattaagaaataaaagacaatatttctgatgaaggaaataacatgtgaaaagctatggaagtaacttttggaagtgcattatgaaattacaaattattaaccagggtttcctgccttttcaggtgtagatcagttaatctaacatccaattttaaattttggggaggtctaaaatcttccaaaatttcagttaatttcttgtgccattaggtggagacttaatgtttaatggttagttctagctgcaaattcctgctttatgatttttttggattatgtccattcaacataaattcaagtagacattgttccaacttcatctaaacaaacaaaaaaacagtttgtaaatttgcagatcagaactggctcagttaatttcctggataatttgggaaaggatgagggcagtccacatcaaaggtggtaaataacttgaaactgaatcttttgtagaatttgttgtctgaggtttttgtctggcttcttcactacacatcatcttcttagtcagatcatcttcttaattctttctgttcttacttctcatctctcttccacactccttccctcctggatgaccttgagaatgctaggctttctatataaattgtgcataataatttatatcattctatctcacctcttaatatgtcttattttcttactgggaaaaataggctaggttggatttgtttttatttttatgaaaagcataataaataagtaattcacatgacttatttttattggtgacttaataccatgtatcttttcatccttaatactaatgggatgattcagagaaacaaggagcaaagggaggcagcgctgtagataaacatgactttcgtggctaagataaattttaaacaacaaagaactagaaaaaaatgaatttgcttacttttttttaccttgaaaaatctgtacattatatttctcgtctttcataggaattgcatttgctgcatttttatcaaatttatctgattctgtgcagtctgcttcttgctgattttaattcttttcctttcgacagcatcttttttctgttttcgagttccctacttcgggtgcatttcattattagtctacatttatatgctttcttttagtgcagacatggattagactcccattcttatgcagatgacactcagatgtatttgaagattagtcctaattgtaactgcacttttgacagtttattagtttctcatgaagatgtagagactgggatgttcagttaaatgttattgaactgaactacttattgatagttccagatgctgatttaaataggttttatcattcaccttcagatacttgtgtttgtatatttcatgaccaactgtcaagaatctgagaattctaattgattcagagaacagtgcctactcctattatctatagtttaataacaggtctttgatagatcaataattcagtatttttccagtggattatatcatacactatattttaaaattaaaggaaaataagaataaaatgaattctgacacatgaaaaatgttgcacatttatatacgttacttaaatccttatttttgtggttaaattgttatggaggaaactacagtgtaggatttcatttcaccataatgtagtaaacataactttgggtataactttccttcccatacactattaagagttttcctcccaaaaaggaagagaaggtatgtttgaacataatcattgaaagtatacaccaaatattgtgtagaaagactaaaatcttgacactcaacacaaaactctgtctcttatttaatggagttttttttctgtgtgtgtgaaataatctgttatgaggttgtttgcactttctttcctttctttttaaattcactttttctctacaattgctatgcacgtccatgaaaacaacagcgctctaacttccagtgctggtcttctcacttttcctatttttccatttcccttttttataatatatttcttccaagttttaaccgttttttacagcatatcttttatgatcttcattgaagattaagcctcaaatgcttttcaattgttgggtattttctttcttcctaggttactaatttattagaagtatttggaaaacattttttaaaactttggaaatacttattttctgttcaagttaatataggctttgtatcttctataatttctgaaaaattatttactatcctgagccatttcattttctcacagtcagtatttcatcagcacattgttttacattcaaagagtatacatctgccaacttggggatgcttttccttagcacatccctaaagcatttcaactcaaccatgtttaatggtaataatcacgtattcattttaaaagatgagatcctatcaaatgttaccatggaaatggacaccttgtaccttgatttggctaaaatgagtttgttcttcatttctacatgagctgcaggagaaaaactccgaaattactggggagtggtggggggagatggaaataaaatatgtaagtaaaacaattccttttctccatcagttcctaagaatagccttttgtaatctattacttactcccattgcatcttgtaaaaccagatttatctgctagtttagtatttctttttttttctagaatataatctctctagggcaacgactttgattgtcttattaatctttccacctccacccagcatagtgtttcaaacagaatatggattaatttaatatttgtgtgattcgtgatttttcagaataaaaactatccagcactcagccttcacaaatgaattaaaaacatattatctaatagtcattttgtttggtgaaattttttatctcattatttttactttttaaaaatagccattctgggccgggcgcagtggctcacgcctgtaatcccagcactttgggaggccgaggtgggtggatcacaaggtcagaagatcgagaccatcctggctaacactgtgaaaccccgtctctactaaaaaaaaaaaaatgcaaaaaattagccggatgtggtggcaggcacctgtagtcccagctactcgggaggctgaggcaggaaaatggcgtgaacccgggaggtggagcttgcagtgagccgagatcgagccactgcactccagcctgggcaacaaagagagaccccgtctcaaaaaaaaaaaaaatagccattctgactgacgtgagatggtgtctcattgtggttttgatttgcaattctctaatgattactgatgttgagttttttttttcatgtgattgttggcctccatgacacaagtttacccatgtaaatgtttgccgcatgtaccctgaacctaaaataaaggtttataaataaataattgaaaaggcaaataattgatttaatatttttctaaacaaatttttaaaatttttaagttctgggatacatatgcagaacgtgcaggtttgttacatagttatacatgtgccatggtggtttgctgcacctatcaacctgtcatccagattttaagccctgcatacattatgtatttgtcctaatgctctccctccccttgtcccccaccccaacaggcccgggtgtgcaatgttcccttccctgtgtccatgtgttctcattgttcaacttccacttatgagtgagaacatgtggtgtttgattttctgtttctgtgttagtttgctgagaattatggcttccagcttcatccatgtccctgcaaaggacaagaattcattcctttttatggctgcatagtattccatggtatatatttgcaacattttctttatccagtctatcattgatgggcatttgggttggttccaagtctttgctattgcaaatagtgctgcagtaaacacacctgtgcaagtgtctttatagtaggatgatttataatcctttgggtatatacccagtaatgggatggctgggtcaaatggtatttcattctagatccttgaggaaacaccacactgcaaacaaagttttaactatgagattgtatttgttttcatacccagaaataatatttgatcaataaataataaaaacattaattttattttggggtcatagattcctgtgatataactgcttactctcagtttatgacatagatatagagttttcagtgctagatgcttattgaagtttatacaattataatatgtctaatcctctcattcaaccaacagaatttttcttataaacacagataatgtgcttatgccagtaggttggaatacaaaataaattcacattttaaaatttaatagctaagcacactgtcactgctctgtcattttcctcttctggtgttcactcagtcccaggagccagattttttcctccatgagagaaaataaataattaaaatgaatccaccaaaatccccactctctcctcctatcaatatcatgataatagactcacttgtttatttttccttttgttgcctatgcttttgttgtcatattcaaaaaaatcattgccaagatgaatgtcaaggagatttttttcctgttttcttctaggacctgtatggattcatatcctacatttaagtctttaatccatttcaagctaatttttgtataaggtataagacaagggcccaatttcattattttgcaagtggatattcaattttctcaacaccacttgttgaagagactattctttcccccattttgtatttttggtgaccctgtcacaggttagttgactatatatttatgggtttactgctggactttctgttctgtttcattatctatctgtctgtttttatgccagtaccatactgttatgattactgtagctttgcatatacagtcatgtgtaacatatacaatcttggtcccataaaattataatgaagccgaaaaatttatatcacctagtgacattgtagccattgtcacatcttaatacaacatgttactcatgtgtttttggtgatactggtgtaaacaaaccaactgctgcaccactcatataaaagtatggcacatacaattatgtacactacacaatattttattatgataataaacaactatgttagtggtttaagtatttactacaccatactttttatcatcattttggagtgtactctttctgcttaaaaagaaagtgtactcttttagcagtaaaacagccttagacaggtctttcaagaggtattctaggagaaggcactgtcatctagaaaatgacagctccatgtgtattattacccctgaggatctgtccgtgggacaagatgtggagaaaaaagacagtgctactgatgatcctgaccctgtgtagacctaggctaatgtgtgtgtttgtgtcttagttttaaataaattataaagagtaaaaaataaaagtaaaaatagaaaaaagcatatagaataagcatatgaagaaataaaataatgatgtatggctgtgcaatgtgtttgcattttaagctaagtgttgttataagtgtcaaaagtttaaaaaattgtggagtttataaagtaaaaaagttacagtaagctaaggttaattcactatttaagtaacaatttttaaaaaacaatttatagttatatctatgaagtctgcattagtgtatggtaacaccttgggccttcacattcactcctcactctctgacttaccttgagcaacttccaatcctgcaaactctattcatggtaagtgcccctatacaggtgtaccatttttaatttttttgtatgatatttttaccttttctttgtttagatatgtttagatacacaagtatcattgtgttctaattgtctgcattttattgtatacagtgtatccagtagagtaacatgctgaaaaggtatatagattagaagcaataggctataccatagtgtagtaggctacacaatctagatttgtagtaggctacacaatctagatttgtgtagtaagcacactctatgatgtttaataatgacaaaattgcctcacaacacgtttctcagaatgtacctccatcattaagcaacgcatgaacgaagtttgaaatcagggagtgtgatgcccccaactctgttctttctcaagattgttttggctatttgaggggaatgatatgccatgacagaaactcaaactatcagccttgtttcaaagaatggatggtaagaataaaattcaaataccaatgatgatggttgagcaaagaaagattagaaaggtacctgaaacatgtgggtagcacttgccttggcctacttctgtgaagtcagggatagttcccttttcttgctgagatatagtcacaccatttctctcaacatccgaatctcattgtctgctgaaagttgtccatctttaggtaccaacatttatccatttccagtgatttcatatttgcccctaagaatatttattgtcttgcctaacacagcccaatgagaaacatttaaataagtaagtcctttgttggtacatctctcttcgtctgggctatcctgacttgcacttcacaagatttgagctgtacatactcactcattgttacatagttacatcttattagaatatctaattttcccaagtacaagttagaatttctagaagcgatagaaactattaagtaaaaaataatatggcctgttttgtctatcacatcatgtgcagcagaagaattatagtttatgctgttgtcaataccaagttactttcagagaatatcaagttagtctctgacactatgattattcatccttatgcctggctaataaacaaagaagccactgtaaagatagatagaaatgtaattacttctactaggggcaagactacaacacttaactaactctcaggtgaacaaccacagaaagggaaatgccgcaaatacatttgaatcaaacttgattcttctagcggattcattattttccatgtcacatatgtcagcaaacagtttaaataataataataacattactctgatatagtaaaggcctcaatgggcaagaatataactttcaggctctatcaacttcattgcatctcttgggaaagccattcagagcacatagatagctgcatgatgtaatcatattatcatattaggcttatcagagcttatgggtgacatagcacaactatctaagtttacaagttaaaaaaagctgagatctaggtgatttgaatttgctcaagtggaaatatgaagatgcagggatagttgaagatttgaagatacaagaactacaaacttcatcctaaagatgaaaaatgaaccacaaacttcatactaataactcctttaatgacatatgctatcatactcctcataccatcaacaaaatgttccttaccagaaatctttcaacaaccctaatacatagccttagaacagcaggcagtaggacgtgcttgttcacacaatgttaatgaatcctttgtggattaattaccacattctacattcaccaaaaggtagaagcttgaattgctaccaaagcccaaaggggaaaaaaattggaagacataaatgataaacaaaaccaaatctttgttgtgactctaagtattttaatcatttgctcactcattcattcattgagtgtcttccatgtggcaggcacaattttatgtgctggagattccatgataaacaaaaccaagttcttgctttcatcaatgtgacattctaatgaggaaaacagacaataaacaatggtctgtgtgtgtgtgtgtgtgtgtgtgtgtgtgtgtgtgtgtgtggggtatgtaaaggtaatacttaagaaactaaagtttagagatattaagcagaataggccttgtatggaatactgtttgagtagaaacttatgccaggtgagaaaaatagaaagtgctagggtcttaaagtgtgaacattttcactgtgtttaaggaattacaagtaagttagtggaaagagctttacagaatttacaaattctaagaatctgttggagtaagattacaaaagtccttcaatttattttaaaaatcatgatggaaaaattcaagaaggaaaattccaggagagagtgaaaaaggtacttcagggcacagtggaccgagagacaacaatagacagatctcagttgatatattctgtgcaaaaaagaatccttaacctgtgaatcatgtccttactcagccaaaaaataaaatgtcagcctgtcttacttgtgtagttgaaacattgtatctggcacaaatctaaatgcctgaaggttacagttaaagctaaacatatttcactgtacttaacattattcctaggcattttccaaagcatggttaactgtatgtgttttacctgaggaaaaaataggaatacattggtagacaagctaggaataaatcttttggcttctgcttctgtacttctatcgatgttagcagtattttgcaaggtctctgcaggtattggttcattttattccacaaacaggactgtaaaatgtatagggtagcccttttaatcttcctttataaaaacacaggtggcatgtgaatgaaataagcaaaatattttataaaatatcaactctgtctaaagcactaaaagttaagataatcataaatataggaaacgcataaatattagctaacctattagttcattataaactgctcaaatcaggatgttagcatttttatgataataagctgtcccattcagaacatgccctatctttccgtttctacaagttttatttaatgccccttcattgtttttttagtagttacctttataagacttctgtcttatatgtcttttgctaaatatattttttaaaattatatataattcctgctgcttgtataaattggacctttccatttgaattgctaactatttttgttataaaagaaacctatacagccgggcacggtggctcacgcctgtaatcccagcatttccggaggctgaggcgggctgatcacttgaggtcaggagttcaagaccagcctggccaacatggtgaaacctcatctctactaaaagtacaaaaaaatgaaccgggcatggtggcgggcacctgtaattccagatacttggaagactgaggcaggagaatcgcttgaacctgggaggtggaggttgcaatgagccgagatcatgccactgcactccagcctgggtaacagagtgagactccgtctaaaacaacaacaacaacaacaacaaaacaaaaacaaaaaaaagaaagaaacctatacatttttatatgagttatatattttaaaaccaaaatataggaatcttgaaaataatacagcatattgtgttagataaattattatatctcttgaatgtaagacaaaaattatattgcatgtaaataatgacatgtgtttcttattcaaattatgtaactcttcaaattttttttatttttttgccctgcctggaacctctaagacaatattgaatggtatcactagtgtggggatccacattttgttctaatctttaatgaccaaagttgtcatatttaatttataacccaatacttgctttgatttcatacattcattggtttatttacaaggttttttttctttttctactatttctatttttctgagactgtaggcatggaattcttatatactaggaaatttcagctgaatttctcaaatgtactactttactgtaatcacgtttatttatttcctttgtgttactaaaggctccattgaagaggcaaatttgtatcaaaataatgtttgaactcaataaaattgaatacagacaccaatctcctttactttgacaaatggacacaactaaagtttgtggaaatataaataataatggataataaagaaattatgaaattgaataagaatggagagatgtgtgtcatctatgtaaaaaatgattaaaacagtatggtactggcaaaagaataatcatagatcagtaggtcaatattaagaaaaaggctcagatacatatatgggtttcttatacatttatgtacggtctatataaatataatataaatggtattttcagttcatgacgaataatatagaatttactataaatgctcctttaccttgccccatatgaaaccaatttgtagaagaagtttaattataatataataaaactattaaagaatgagaaataaaggttgtatttcaatcttagatttgaagaaaatctttcttgagtgagatataaaatacaagatctaaaagaagacactgacagatttacacatatttttatgtttacagagaaaagttaattcaaagcaaaatcgaaaacaacaaaagtctgtaagaaagtatttgtagcacatataaaagggttaatattagtaacacccaggaagtttctatagatcagcaagaaaaaattgaaatgaggaaaagtgtacaaagagaaaagtcagagcaaaaaatagagacaacaataaatacttctgttaaagcatactaaaaatgtagagaaagaattggaaattaaaacagtgacattcctgacagaatgacaaaagcataatgattgatactattattttggcgacagcctggggaactgttctctttttaatattatttttgggagtatactgaacaaacttttggagagtaatttaggtatatttatcaaagttttaaatgctcacatattgtaactaattaatatttcttctaagaattaatcctacaataataacacaagtataaagcacaaatacaatggaattgaagagaaaattactcattgttgtaagccactgagattttgcagtttggctttccataataatgaatttgtttttattttttcaactataaaacataatacataaatgtaccaagatcttcactgtatttgtgttgctatgtgtgaactgctgcaactctgttcaaatagcaggtctgttctacatgtcttcttatttcccactgcaggattaaggaaacctcctaatcatcctgtgctattctcatagtggaagcctgtcaaaaacgtccagtagttctatcagcttctgttcatactgctaaatctgcaaaagaaaaaaacctatatgtactgacctagaacagtcgtcatgatatatgcaaaaaaatcttcagactaatattatagaattagctatgtttgttaaaacacacaaatacattaagaaaacaagaaatatgcaaaaactcatagtgccacaaaacaaaaatgtctgtagatatacaacttgttaagtggttactgtcaggtttggatggaagcagataaacagaccaaaatatttacaggtgattgttacttgccgttttataaatgtttttgccttattcttatagaaaaagaaaatcattttcatagaagacagtttttcactgtgaaacatatttatgaagattcttcatcagcatgaagagagcactattttatagttaatttaagagctgtgcgaaagaacttggatatttgtttctttagcaaacgtacctacatcatgaaagccattgtactatgagttaacaaagatgataaacaaggccttgacttcaaaagattctaagtgtgtatatagtttagaaaacaaaggatgccagagaattacgaagtattaagtaccactcagagaaggagtatattcaatcagaaagctatagccactacaaaccaattgctttgtgattgctataaatttctcatttctataaaggtcttagactctttcacgctacattccttatcaggccactagcacctaaacacttgtataaatgtgctgttcaaataatgtgctatgaaatgtataatccattacagaatccttagtggaagaattagaaacccttcttatggaaagaagtggcacatcaccttggctttgtttaagtaaatagaatatctgcaagtaaatgtaagaaggaataatattctagacctagaaaacagcatgaaaaatatagaaaattataaagagtatggtaaatcaaagaagagcaagatgtctgttctggcacaagtaaagtgtatgactatgtaaaatggcaggtcattgtactagaaaataaatttaggtcctcacaggaataattttatactccctattaggaatttgtactttattccatcggaaatagataccaagctttcatgcagttaggtaatgtaattaaatctgtgttttagaaagataaatatagtagcagtgaggaggatgtaatagagaagttggagtctagaaaaggggttcagtagctattatcagtacaagaaaaatgaggaagaagcactggacactgggaagagaagaaatgaagcaaaacagagatgtttccacagaggaaaacagaatagacctcgaggagtatatattatgcaaggcgaggatctggatagtctattcaagaaatatttaattgaaagtgcttcctcaaagcatctaatggaatgtccagcggacagaaaattagtctagaaatcaggagagatgccaaagctggtgatgtagatttgagagctatcaacacagaaatgtcctttccagtcatagaaatgaattagtttaactattcagagaaaccattgaacaaatagaaaagagaaggttaagtcaatttagaattatgctacttaagggtcagatgggaaaaataaaacaagaacaaataatatggtagagcagaactatttaaaacacatgcgaataatcaggagagcttaatactatgtaagggaaggcagagaatttcaaacaaagctaatcaatattatcaatattttgcattactgctgagatatcaaatatgtggaaaaatgaagagatactacatttagcaattatgagttcattgctggctttgaaaaagcaatttaaacactgaaatgagaatgagaatcagactgaaatattttgaagagtgaaaggggagagaaaaatggagtagtgagcatagagtatttacaagaagttaagtagtaaatggggaaaaaagattgaattgcaaataatggtaagggaagaaaaatacaatttattattttttctatacaaaataatatgattttattggttaaaatacagaaattatacacacacactcacaagataattaaaagtactgtaactattaaatcaacacaagatataaccatcaagttgcaggaaagttgtctgaaatagatttatgctattaagagaagaaactaataaagaaatctacatgtaacatacaagaaagacacacttttagtgatgtaaaaaacaagacttgaatcagaagacctgggctgaaattctgactactgtatactagaagcatgactttgaccatgtcaagcaaacttttaggaggtccatcaactgattttcaaagtggtgatgatgataactatgtacagatttaagtgcatatgaaaatatacatttaactgttcatcatttaaatatacaatagattatttttgacagattagaaaatgataatatgggcaggatttgatagaacggggcaaagatatccaaatcaaaagcagtggcatccagaaatttgtggtcatcaagaagcaagaaacagaaacagtatggtcactagctcatttattaagtagaagaaagatgggttagaaaactgagaaaatgctacaactttcaacttttgtgggaattcattacaattacttaaatgtaactgcttttttttttagtctgagttctttaattcatagttataagtacagaaagagaagtttttctattgatggttctcaactgcactattgtgagtcctagggtacttaataaacacaaatgaaaacacttcttagattgcttcattaacccaaggctctgtttcactctctttgtatatttttgttaacacaatattgggtacatatacctttctctaattaaacacacctatttaaagtcagagaagcatttatcatgccctcaaatttctattcataactagtgttttccattaatgttgaaaatatcgagcttgtgaatcccagggtgttaaaaacactgtattttgataagtgacattagaataccataatatatatttcaatgtggttataattgtgtcattttgaatgtaaagtctatttgcaagatattttattgttgtaattttacatgtgacatatgttcatcttttaaaatgcaatttctcttttagtgaaaacgtgtggctctaatcttcaaggaccaagtggtacctttacatctcccaactttccgttccagtatgacagcaatgcacaatgtgtctgggtcatcacagcagtgaatacaaataaggtaagagaacaccatctgtgatttaaaaaaaaagtcataatcataaagacaaaggcaaagaaataatacggaacatgcagtatggaaaatttataactcaagtaggattttggcgcaatattccctacttaacagtttataaaccagatttatatgagaaatttgggaaaaaataaaaataatacaattctactccaagctactaacatataaaccaaaaggttaaaattacaaatgaatgctttctgagatacatttttgaaggttgtaagtgtatcctttttaaaaggaatcatgaatagtggctgtttttgtgtcttttctgtttgacacatcattcaggtcaatcctgtttttatacatagctgactttaatttcaatgtttctctattgctatatatcacatagctatttatttgaaatagttggtttaatgtgctctgcactaataaagaatttatattatggatatttcaaaaagttgaattgcctttctatttgattctaatatgagtaacacatctaaatatgtatgtgccactatacctcaagcaaaattataacacaatgaatgtaaatgcagctgaaaattttgctgttttttctttcctgctcttgctatcctgcttctgtttgtaagatgtgattttatagcaatagagaggacctaaataggaaaaatcatcatttctctcaaatcttcaaattatgtgataacttctttgggctagattttaaagtttggtggtcgagctcatgaaattggttcagattgtgtttcatatactgatgtataattttcagataactttaagttatttaacctctctgatgttgtttctttatctatgaaatgtgaatgataaagacatgtattttatagtatcataagaaataagcaagataatgcaaacacagttgttagtaaagctaataagaccttgaaatacattattaattcattgttattaaagtatatattgcctcccgggaatttttgtgatcacttatcaagttcttgaaacctaattctaagatcagcagagttggtttaaaactcaaccaagggactattagatttgtctcatagaagagccctgatttataaatcagaagaactagatcagaaacctactctgccccaaattatctctataaacttgggtaaatttctaaatcaaacccctcagttgcatgaaggaaatcatgttatccacccaacctgtgtcatcagttcaattcaatgcaacaaatatttattggtttatttctctgtgcaaattattggttgttgaggaaaaaaaaaaacatgaagtgcttggaaaactgacatttgttgaacacttagcagcatgccgtacactattctcagtagtttttttctagcactttttatgaattatttaatccttgtaagtctctcatgagggagatacttttattgtctgcatttaagcaagcctataaataacttgtcaaagatcacatagttagcaaaggtcagaggtgtgtactttatgagatatgtgtaggtacaaagacttatctcacagtaaggtataaatatctttttccaagatagacatgaagcaaattcattataaagtatggaataaacacatttaattaatcttgcattgagatggagatattgttttgtcttcgcaattacatgtaattgtcatcaacatgtggtattatctcatgttcaataagatgtttgctttgctaactttaaatcattattattacagaattacctgaagtttcagaggttgtcacatttctacttgtttatattatctaatctactcaaatttatttctcctttttctccaacaaatgcaaattattttcttaggaggacataattactttcagttctttgctattttttattaataaatgtagacacttaattttgatctgttaggttaacttttttaagatgtcttacagaaatttgtttacaagaattattcatcatgagccacaataaggattatattttaccttgtgacctagttcaaacacacagacacacacacacacaccacagtttcacacatataaaacattttcccttacatgaatgcactcctgtattttccattctagtcgaatgtaatctgtttattattaaaacattgattatgtcccactaaattaatttcatgatgccctaacagtttatagcacatagttttaaaaacactgttagaagtatttgctttcttagattactccttggaacccttttcagaaggaaattgttggtataaataataagcatacagctatactagttggcatacatcccaattaaccaaggtgattaatacctctacatttataatttgttcagtaattattgttcatgttttcctgtatatttgagcaattatggtgttctaaatgtactaaaaagtacatggttgatggaaaaagtaacctgagatttaaaacttgatgaaattaattaaacaagtttcaatctgggctgtcactctcactatgagagcccagccacagtctctttttcatagagtagaggtcataataccacatcataaggttgcacagataagaacatgtgaaactccttatataaagtaagttcaccttaagtgacacctatttttattgccaaatgctgccatctcctcagaaacatacttccctcctgttatttactggacttaacatgtattaaagcaaaattatcattacatataattttcttctatatttcattatatggttgaataatttataggtgactgtcttattctaaaacattaaacattaagttattattactaatcagtttacagacattgcaattaagttcacagaaaataaaatgtaataactgagcattataatctaaactaatatacatttttgatgttcatttatgccccttccacaagcttctgtaagggaatgtttcctttaattatggcatttgagtaatgaaaataattgagggtttctttataacagcaagttaaaatattagactagcactttaaacatacctagtctttgaattaattgttcttcttgcattaaggtacacattcaacattagctccatgtgtgaaatgaagactgaagacatacctcaatctgtttgttcttctttattaatttccctcttatacttgtttttccaagtttcaaaagataatcatatattacttctccaactggaataaaaatatgttacattgcttgagtgtaaataaaaccctggagaattagaataggaaattccagattcatagctcctcagggacagatcttgagacaaagaaaaaaaaaaaaaaaagcttcgctaagacatatttgaagggaatcatatcctattaaccaagcaacaaactcatagaaatgcccatgtctgcatctatgcatctctgtctctatcatctatttctctatgtatttatttgtgtatacaggtatgtatgttatatatctatctatctgtcatctatcatctaattgtcattcatctatcatctgtcattcatccatccatctattttttcatccctctatttgtatctctatttatccttatatagaactcatgatacttaggatattataggccaattttaattaaaacacaaagtctgacttttttagacagaaagagtttctgatttgtctgattgattttacagtttttccatttataaaatatcatgcacattttccataaattgagttaactaatgatgcaagattttgagaaaactatatttaaaatacttgtgaaattggagtagaaattgcgtcctttgcagctattcacactaagagttttaaataatagatgtcaatgtaaaattgtaggagaaagtacagtttccaaaatctttttatttatgtgagcaagagtttgaaggatattggtctagccgatacaaatggaatgtgagctgcatctttaattttaaattttccagtagccacattttttaagagatgaaattaattttaattttatattttatttaaccacagatattatgatttcaacatgcatttggcataaaattaatgcaagaatttaccatctcttcttttattcttaatctttgaaatctagaatgtatctagcaagtttatcacatcacagttcaaactagccttatttttagtgctcaatagccacatattgctagtggctaccatattgaccatttccatcaccactgagatttctattggattgctctgtgtggagaatgaaaggtgatggtggtggatattgaagagaataaatgcctcattgcaaggtaattgcctcaggtgaagtttttgctaggacttcagggaaaggaaaaatggaatggcagaaattggcagaaatgactctgaaaactcgggttttaagattctgtactttatcacagagcatccaaatgtctccattttaaatttcatgatcccattccttctcagtgaattccctagcttccacataagaaactttgtgagtctgtaagttcagattacattctaattaggtaacttgcataattaaatttggggtatgttttagccatacctgcccagtgctacaggttcaccatagacggtctcttgttctctgaccatgatgtgagctgtaatttctctttctggcttcaatgcagtcatcaattgccatctccctccattgtccttgtagtcttggatatgttagccatcaagtgcagcaaccccttgccctctccccacaaattttgttttcaaaatctgtttcaatcacaaaagataagtaattgcatatgaattttttactgtccaagaactcagctctggcaagaccaaaaaataagcaaaccactcccacaaaacccatttttgaaagtcttaggctcactcttgatatgaatgactacactgacaaggtctagtcagaaaaatataatctgtattagctatttaaaatgaatggaatttaatttggggaattgttacacaggcattgcatatgtaatgcataaagagtaaaaattaatgaagaagcaataactatgtagacagataccatccttttttcatccagaaagaaaagtaaaaactgtggtattaccagaacctaagagcttgcagtaaaaacagtctagacctggtgctcaaatttcaaaggaggaaatctttcatggttggtggtcacacctctgaggaaaggatgtgagctagcaggtttaggcatccactaaagaaaaaaaaaagaatctgagaattgtaatgtgcagtgttctaacccaaatatcaaagggcagaatacagaagggttggctagagctaagagacagcagataaataattagcacagtattgctttcaagtaaaagggaaaagctacaggtggagctggtttaggagaaaaaacagtttatctttgttacatttgaaatacctgttagattggatatcaagtgggatataaaatccagatatccttttttaaaaggatagaggtgaaagtttgcaaattgtcagctatagatgttatttgaaaccatgagactgaaagatctcaaagaaagtcttagagggaaagccacagttagaatacatagtggatgaacggccaggtgtggtggctcacaccggtaatccaaacactttgatatgctgaagagggcagatcacctgaggtcaggagtttgagaccagcattgccaaaatggcaaaaccctgtctctactaaaaatacaaaaattagccaggcatgatggcaggcacctgtaatcccagctaccagggaggctgaggcaggagaattgcttgaacccgggaggcagagcttacagtgagccgagatcatgccactgcactccagcctgggcaacggagtcagactccatctcaaggaaaaaaagaaaaaaaagaaaaaagaaagtgatgaacaactggcaaaagctaatgagtaggatgcctagttgaaaatattcttgcatatttttctgtatacttcttctaatgttacatttttatgtgattgaagactgcccattcccaacccaggaaacaaatatccgtggaagaatcagattaagtgtctcaagtatatttgaactactatttgaaatgtaaatatataacattactaataaaaattccaaaatgtatttgtattattaatataatcagaacaacacttgctatttatttatttatttatttatttttgaggtggagtctcactctgtcacccaggctggagtacagtggcacgatctcggcttactacaagctctgcctcccagattcacgcctttctcctgcctcagcctaccaagtagctgggactacaggcgcccaccaccatgcccagctaattttttgtatttttagtagatacggggtttcaccgtgttagccaggatggtctcaatctcctgacctcgcgatccacccacctcggcctcccaaagtgctgggattatagacgtgagctaccatgcctgacctattttttcttaattgataatggatgaacaactctatctcgtgtgagtgtcccattaattattttcattcaaatttccttcatattacttacaaagtacttctcgtattcaagattggaaagcactgataaaaataaaatacagtgatcagaattactcaagtgtatttgcctttaaaaattaaaagatcaaatgagagaagcatgcagtccctttcttgtattctgggtccagtccttcttactatatcattgactccacttttttcaattaagtataaatgttgacttttgcaggaaaacaaaaaaatccaaatttcagtcctaaactgatattttaggactcaacttgaagtcacccttaattctaatcttatcacatgccctataatgaaaattaagtttgggatttatttttaagtttggtgttagtgattggaaatctgtcctgttttctacccatgtgtccattctattatctttcattgttaggttgggatcttcccttgtcatcactagtccctttttcaggtactgaagtcctattgctgatccataccctcctttctggagctttgaaacccaccaaaataacttctctaagcaaattttctgacttgctgctcctggctccctcactgctctgttgacccctgaaccaatcttcccaaaataacctttctcttcctttactgccatctacttgttgccatttatctaataggtgtcctctcaaattttacaactgattctatcctctgagactttctttctactggggaatacttacttattcattcaaataagtatgtattgagtagctactaatcccaggtgtagttcttgaagctgacgattcaaaggtcttttttttttttgagatggagtcttgctctgtcacccaggctggagtgtaatggcacgatctcagctcactgcaaccttcgcctcccaggttcaagcaattctcctgtctctgcctcctgagtagctgggattacaggcacacgccaccacacctggctaatttttgcatttttagtagagatggggattcaccatgttggccaggctggtctcgaagtcctgacctcatgatctgcccgcctcggcctcctaagtgctgggatcgcaggcatgagccaccgcgcccggctcaaaggtcctttatatcacaattcccttgtatcctttatgtcacgattctctctctcatgggttttacattgttctcaggtagattatcagggggaagaatgagaaaaaacgtgaaactgggcctgtagtagacttgaatccatgttagtttttttgcttacacagcatccatctgttctccataatttttaaaagccaaaaaactacctttctgccattccgggtggtcctggaggggacttcaatcaaagttacgctgtccctaacccttccaccttcatttgccaagaagatctcatacagtggtatgctggaagtaacttttatcagctcttgagagcactgatgtaattataaggaatataacaagctggttgttaagcatatccaataataaaattgaaatcatctgaactaaaatataatgttatattaaaaacaaaagtaataactacacaagatgaactaaaatataatgttatattaaaaataaaagtaataactacacaaaactcattatttcataatcttttactagactttactattagctatgcccctgaggttatttaaatctattttgaccatatgctggacctactatataatgatgaaagacagtgcatctctgccccaatctgtattcagtctctttggcagcttcaatttggacacagtggtacaatttacactatagaaataggcaaactcaagaaatcagaacttttcttcattgtgtagacatagaaagtgaagaagaaaatgttgatactaaagattcaattttgaagtgtattgagtctgtagcgattacattgtgaatggcacaaaaaaattgaggaaatattcttccagtattcaaaaactatgatctgtttcaataatgaagtcattcacatcattgacaaacaaatgatgtttcaacatatgtattcatttttataattgtttcactcattaacataaattaaatatcaaccaacattcatgtgagaactataccagtccattcatcaatttgtaaccatgagttagctacagatacaaatgtttggcagacatcaacaaaagcattttctgcaaagcatttggctgtgtggaatttataatcaagaatattgtatatttgtcattatttgtaaattctgtgttacacatcctttatataagtaaatttttaataagcatgtttttcaaagagccaattattaagcatttactaatacactcctcatgtcatgtgacccaagtttagtcactccatttcttactgaaccttgaaaaaagtagcacacactgaaaaatattggtgttgatttatcagaaggaaaacacttcagaataatagtaaataacaatagttaacgttcactggatgtttactatatatgaagaatgtttctaaagcctttgcatgcaatatttaatttagttttacaacaaccctaacatgtaggtacaattattatccctatttttcatatgaggaaatagagtcagagagagaaagtaatttgccaaaggctacaatttaactttgagaaactggattcaaaactaggcattgactcttacagtcatcactgattctttcctactacctagaacccaaagtttcctgggcttctatcctttatttagtctggaattttagcttttgcttgcttctgtgtcctaccccataacttaaaatacgtattttacttaagccagtcaaaatggttttctgttacttctcaccaaaaaactctgagacagggagataatgatatgcatcattttgtttttatctcctgatctagtataaatggagtctaatccaatatttaacatcccagtttgcttctagaataattctagcacattccactatagcctgaaaattgataatatgcttatttcttctatttttatccatatctggttggagaaaatccaggtgattaaaacacatgctagtgttggctacctttactttgttaggttgctaatagatttttgagatgtgattcttccaatataaacatgtaaattatagtaaaattacaatgattttaattagacaattcttccatataatgtaaagaactaagctgaaaatgtagaggagcataattctttatggctttttgaccaccccctgctctctttaaatgtaatatacttttatcaatattgagttattgttatgaggataattttgatgactccaggatgtcagcaaatctcacaacgaagaaaatacaattctttgagaggtgagtaatgaaagattaaattaactgggcatagaagaatataattcatagagaataaagacaggcatatgaggttgacttcagattataactctcgctagcttagtagaagtcttaattgtcggaagaaataaaatatgtcatcaaaagaataagtattgattatggctttaaaaaatgttgcataacactagacaaaagcatatttgtttttgtattttaaaactatgaatatttactttgttttaaatttgcgtcacatcacttgtggatcttaaaatttagagaatatggcttaccatgaccaaggtgaattaatgaaggaggtcaagggactggtatgattttaagtgtacatatttaaaaattcactctggagcttcccaccctacttataaaagcctttcttttgtggaataagacatggatagaatgtgaacctgagtcaaaagccctgaattgttgtgcagatcatctcacctctctgaatctcagttttctcatctttaaattaggggtaatcatccatgcctcaccatgtcataggagtcttgaagtatcacacaagttaataaataaaacagcactttgtacattggaaactaccttgtaagtttaaggaattatatatgcttatttttcatcccatcccttattccaaagataacttttagtgaatgacattatcagatagaccattatacatatattgagatatgttgagtatttaaggatgtgtaagcataagcatagtacctagctcatagtgggtgaccagttaacatttattgtataaataaaataattaattaatatgaataagcaatatatattgttcggaaattactaggtgctttaatacagcacagtctaagatgagtgcacaatgaatagcaaatattttgttggtatttgtactgctttataaataaatgctaactacatttatattaaatcatatttgtgcctgtatattattttctctagagctaccataaggcatagttactgggtttttcatatagttctgataaaacttcattacaacatttcatatcattctgaaacatagatttgatttctgttgaagtgaagtattaaatgagtttttctctgctcttatgtttttatggacacttgccccaaacttaaattcaggtaaaggacagccttttctagtaggagatgaagttccttttcagacaggccattccattctttggcttattttaaaaacaagtagtgaaggtccaatttataatgaaggtaaaattattaaactgtgaaatattacctttgtacattcaatacatttaagcccatgttttttctttagatccattaaatacaatcttaatcttcctccccataaagtcttcaggcatcagaatacactcttgaactcacctgtaacactgtcatctgaacaattcttgtcacttttccatctttagagatagccttttgccacttcatttagtcagcccatttataggtactagttctttgcgccaaatatttggagatttggtacttgtgccaagcttcagtgccaggtctgaaacctcagccaggcatagagagtcacttttctgcagactatagctgtcttcagttatgttcctgaaaaagcaggcccaagagaaggaattatatgctgctgattcattaagaaagtgtatccaggagaaactattaagggagtgggagaggcaggacaagaaggaagttaagcaaggtgcaatttcagacaaaatccaagcctctgctggatctcatgcagtgtaaattacacctgatagtttatcccaactcaaggcaaagaagctgtgctctcatacttctgcaccccatgatcatagggtaagtgatacccagatctttcagggctcatgtgtggaccaagtgggctcctgtagcctgaaagcagtctccagaagactcatagctatacacgtttagagacaaatgcatagtgtatggaagataatgaacagataacagaaagggcaagaagcatccaagggggttattgatcacctggagcattgacagtatctactacaatggagcaggcactaacaagaccaaacctgaggcagcagtacagggataaactgaaattaaagccaggttggcagtcttaacaaagcatgattcagaaagaacctagtagcagagtgaagatcttgatacaaaacaattagatggaaattagaaaaaccaactacaaggttccccaagccaagaaaagtagctctggtcactatttatagaacacccaggcttggcagtagaattttaaaggcgctgatcttttatttcccctcctcttaagtgaaccatatctgtatagcagtaccttaactattcctaacccctaccaatggtacttattttttttgttcaaatggtttatttaattgaaatactttatttaaagtgaattactctgtgcaagtacaataaaattaaatatcaataaatataaataaataaatatcaataaagaaaaaatgaggccagatacagtgactcatacctgggagctactttgggaggccaaggtgggaggatcacttgaggccaggaatttgagaccatcctgagcaacatagcaagaccctttttctacaaaacaatttttaaaaattaaccaagtgggcatggtggcacatgtctttagtcccagttactcaggaggctggggtggaaggatcacttgagtccaggagtttaaggatggatgagctataaccctgctgctgcattccagcctgggtgacagagcaacacctatctcaagaaaattaaaaagtgtatttataaagggaaagaaaaaaggaaggaaggagggaaggaaggaagggagggagggagagaaagaaagaaaaagagaaaggaaaggaaggaaggaaggaaaggagaaagagagagagagaaggaaagaaagaaaggggaaaaaagaatatttcttttttaacatgttaaaaaagaattatcttttttaagaataattttaacatgttaaaaaagaattatctctagatagaagattacatgcattttccactttaattttgtactaacaaaaaaagtatcaaataagatatatgcttcattttataatgaaaacacatttttaaataataaattaagtaaaagaaaggcataggtatagagtgagtcatattattgactacttccttttccttgaaactttatcctccccagcctctttattctctgttttcctgaatttccccctacgtttccaggcttttgctagtgaccttatccttaaatattagtgttcctctatattaataattcaaacatttttcattttacatccttccccttttccttcacatatctaaatacaaagtccaatgacttcattatatttaattagtatgccttgaagttgtttaactccctctcactcaggtttccattattctcctttggattaataaccagctttccaattagcaaatcttcatctcatttttctgcttactccaagcctgttactttccaaaaaattcagtgtgatgttttattctgagatgaaataatgtcttctttgtaaaatatttaaatggttctgcatagctttatagaggaagccatgggcaacctaaactactcttgtgttagactcatacttcaacactctatttagcccccaaagcacttctaggaccctgtattttggggataagccgctccttctgtagggaatatactttttcactttgtttacacatctccagtcttgtgaccctgtttattaatggcatcttctaggactcaggtaatcttttaccttttcctagaagcctgtcctatcttcccacctagattgggaaagcttactctgcataactgacccatgtgttgtcacattacattgtacttacatgtttgtgcacttattttccttagtttaacccttaaggacaaaaaccagttcctgagtccatgcatccttaatatctaatgaagtaactgtcatgtgggagtttttcaaatgaatatttattgaaataactgagcaattattcctagacaaaatagttgcttgtttatttccatgtgttttagctctttctaggaatgtctctggttcttaccaacaaagtaggcaaaatatgcaaatggcaaagcatttttgtttgtattttttccactactgttcccactactaaccattgggtatacccaccattttaatctcagtattatgattataccggaatcatatgcataatcagagctgtgttgaataataatttgacataaatagtaaggaattcaaataaattatggcaattaatgtactttatacaaccaaatacagtctttctggggccggcataggggaggaaaaagagagactgggcaaagaaggtcttaattaaaacaaccgagatgcacaggcttttcaattatgattaggtttggatgtcagtgacagaaaacgcattaacagagacttaaacaagatatgtatctggtccaagactaatggtgtctctgatccagaaatttctcagagtcatagtctaactcaccaccctaccattcccaatttgtggtctttatcttaggttgcaacatggtgtctaacccttctaggaagcaggttgggggaagtgataaataaggaaaacaaaggacaaatgtaagctatctcttaagaaatattccttgatgttgcttcaaaacatttctatttatatcatatttttgcaataatctaacaacattctcatacttagctacaagagagaatggaaaatatagtctttagtaaggacaacttgctaccagctaggaattctactatggtaggagaaggagtacatggatgttttggaaagatatgacaacctctgttacacatatttagtccaaaattgatgagtgaacaaagaatattcccttttaagtactagctagcaagagaaaagatattaggaaaaaactcatgattttattactgttactgatttttttgaattaattatattaaattgtagatgaattgagtgtatgtgacaggcactatgctaagctatttttatgtatcttctcacttaatcctcctattaattgtatgaatagttaatattattgtatagattgtataggtgcagaaacaagtttggaaaacttatgtggcttatgtaaatttgcagggtgagccagtggctttattaaatgaaataagaatgatgaagtctggatgctgttataaaagtgacagttccattgctactgtaacaaattactgtaaacttagtggcttaaaacaaataataatattaatataaattaaaacattcattattttataattctgtgggtcagcagttcagcatggggctcactgcaataaaactaagttgtcagcacactatattcctttttggaaaatctgggaaagaatgtttcctgttaatcgatcttgttggcagaattcagttccttgtagttccttaatatctttattttttcttggctcttagctgaggtccattcccagtcttcttcctccatcttcaaatccagcaaagatgtgtctagtccttctgatgtcatatttgcacattcttctgacttcttcctctaatgttaagacttgtgtgaatagatttggcccactctagaaatccagaataaacttttcatctcaagattcttaaattgaatcacaagttcaagtcccttttgacatgtctggtaatatagtcacagcttttttttggattagggagtggacatctttaattaggtattctgcctatcccaggtggcaatgaggagtaacaaggaaattggacagcagaagacactgtgtcctcacatggaaagtgagaaagacaagggagcttaatgctgcctcttttatgagcatctaaatcccatttacaagggaggagccctcaaggcacatcacctcttaaagctaccatctttaatactatcacattaataatatctgaatttttgaggggagacattcaaatgatagtatctagtgtgatcatcattcttctaatcaatgtttttgtaaacaaaagcacagagaagtataaagaaaccaaacataaaatctctctttttggatagaattgatgcttattctagaaagcatttatgtttattttattcttaaactaatattttagcaacttcttttatcatcacatatattttagttaattccataattgcatgtataaaattatggattgcaattttactagttagaggcagattcattttaacatcttgaatcaacatagtttttttaacatcacgagagtttaatacttacaataatagtcattgactttgagtattttatattcttttgaagatgtaataccactcattgaataattaggaataaatagtaaatattcattgtatgtcctttctatattttacattcttgatgctaaaattcctcatatactaatacacaaatataaaaagtacctagttgtatataaatatagacactgcataattgtgtaatgaatcacagatcaccaccaaaaacttatctggacttctgtggtctcaataatttaatttcttatgactcttgaaaggataatatgagatatgcagtaagaacagggcctggaatatatatgttcaaaatattagtgttaataatattactattgtaactactactgcaactgctaccaccaccaacaacactaataaattcccagagcgagatgggtataatgcctccactaacgtttgagcttagtttcctacggtgcagataacacacactctcatacatttcagatcttgaaatattcttgtggagactccctgctgatattagtcaccggaaaccatcagcagatgcttctaagtcagaataggctgctgccaagagagcttgaagaagaaactggcaagagctgtgagcttttgctttccgtcactgagatattttgcagcagaatggaaggttatcttaatgacaaccttagagttagtggggccatgctcaaccttctggaacattgtctcctaccccagctacctaacacctcaagaatagctgcaactgggttgtgaagagagaggaggaatgtgatattatacctgtgttacccacagcacttgcccttcttagtattacagctttttggtctcctggaatctctattcaatgtgaaggagagtcatttggatgatttaattgccctcacacagcaagaatcacataatgtacatatcaaagtgtaaaaatgtgtgtaattcctttgctcagtattacatatctgctttgaattttaaccccttctgatgtaatagtaaagtcacccacatcaatgatattaggggtaaggtttgaagggagcaacatctgcagagataggatgtagtagttccacctttttttttcctgctaagacctcttcagtgtccaccctatacattctcagtctgtgacgatctctaacatccaaggacaagcataaagcacctcatgtgccttagagtggccagatgaataccaatattgtaaatcttagctagacattacctgggaaatcctacagttttacagtgtagaacctgggattgcaatcgattttttagaaagacaaatgtgctaacatcaggaagcttctagttagcactttaaatagacaataaaaggataaacacaggaataaataatcatcatgtaaagaaatcacccttaatggaataaagaggaagccccttagaaatgtcaaaaatacttttctgagcagatgatttttcagccaatattatggaatgacaaggaactggaaatgcagagagaagagtgtctgagacagagtgagtagtcctcataaaggatttttatggccctgatgtcttctagaaactaaaaagattacaggggcccttggcatagtgggtaaagaggagaatgggcaacatggagactgtagaactaaagaaagattagatcatagaggcccctttgagatttattcaaatatggaatgagaaaccactgatgaatgtgatatctaaatagttcctcttttcattcagatttctctcaagttcctcaccctcacctcctctatcactgaacacctccaccactctctatcatcttaccttgatttatctttctttaaaacacttcataacacatatgagtgtttgaagactttatattctataagattattatatattttttaaatttactatattcttcccccagtgaaggaagaaaagttagtctgtatctatatcactataacagtgctggtaaagagtcatatttttaaatatgtgtatacaattaaataagtcaatagcttttagatagaagttatattatctgatttgtgttttaacttaacctccaaaacttaaaataggagccttctatttgaagcacagttcacaaaataggaaacagtagtatagctacctttcctcactctttttttattaaagttttacttataattgacacataaaaattgtttctggggttcagaattatacaaggttgcagtgaaatacagatattttgatgtccctataccttatataatgatcaaatcagaataattattatatttatcaccttaaacatgtattgctcctttgtataataacattcaaaatcttcttttctagctatcttggaatatacactacattgttattactatggtcactcaaacttcaacttggtacccattgacaaagtaactttcccagtttctccttcctccttattctctccagcttctggtaaccacaataatacaatgaaaactataaagcactgattaaagaaattggagaggacacaaataaatggaaagatatcttgagttcgtgaaatggaagaattaatattgttaaaatgtccacattacccgtagcaatctacaaaatccctatcaaaataccggtgacctttttcacaaagacagaaataaaaacccttccccagtcttttcctaactactggctccagagagaattcattcatgggctacaagtctttcctcctgcatagctgtggcaggtaatttctcttgtaccctaacttcctggactcctgcctaagttgcttgtccaggaagacatagaagtaaaccgggccttccacagatataaactgataaagattcactactcaataaccttgtttaaataaattacataaacaaaaataaggttaacaacaaagaccatgcattgagaagctggtatcttacatcctgtcttttggtgtcttaagaaaaataacaaggataaactgaggctggaattaaaactcattgcatggttcattatatatgaaagtatataaatatctgtatatcactactatagttgtgtatctaatcattttgaacaaaactttcattttctcaaagtctggagtcaaagtttttttatataaaaatagatatagataaataaatgaaaagagaggtatcctagaccatgatgaccccattattaataagggacaaaaaaacagaaaaagagcccttcttaacaaatttatttgaattagcctcatacatatttttcaaaatattttggatatatacgacctaacttatacaaatttgtaatgaatagtctcctaaaaccaagaatattatctgcaaggattttcttcaaaatctgtaaattcaagttgatcatttatatgtattatggaatttaaattatatcctccagtagctaagcatgaataaatgatggaaaggaaccaatggttttgtactgtggtgctatggatttaatatttgatgaatttttcattttatgtagcttcttcccttcagtgaaacatttgtagtgctttatgtaatctgtcattgttacatgccaacagtcccctaaaggagaagaccagtgtacagatattaaaggcatagaaaaataaaacaaagctaaaagcttttatcactccatcagtagctctcagtgtccccagactctcctccaccccatctctaaaatatgagcccttgcaagattgaaactgttaacctgatgctggcagcaaagtggattagcctagagaattccctgaggtggcattttgcactgttgaatggtctagcctagagtcttgggatatatattctgtaataaaatatgtaagtaaaatattaaatattgcaatgcataattcttctagaatatgagatatttattattttctctaaaatgatatcactttcaaatgaataaataaggaattctgatgtgtcatagtttaagcattttgtatcatacaatatttacctatttcataaatttcatataagtttacctttgtatatttatttttaagtagctaatttaggatgattattacttaaacatcattaacatgaattttccatatagatgtgaaatgtatgtcacttataatacataccacaaaagcagccaagttttagaattattctgaattatatgattttttaataaaggtactccatattttgctctctctgcattagacatttacaagcaataacatttgataagacagtcctgccaaggcatagatttttgtgtgggcctttgaataatgctttcatgtgtatggaaaaaaagggaaaaaaaactattataattattttaatttagagcaaagaaaccttgtctgaatccactcttctccatccctacttccacagtccaagtttaggtcttcaatctctctaaccctgccctgttatccttcaaatccagattgtccctgctgccaaaatgagcatgtaaaaaattaaatataaccctgtcaacattgttcaaaatcgtaatatgctgcttttcatatagaagataaagttcacagtccttaacatggtctgctttctgccttcatcgctagtgttccttctcatcactttttgcctcacagtttatgtttcagaaacaaaaataatatttttttcactttgccgtatttcacattctaccctagaatgttctttcccagttcccaactccaccttccttggcagtgtctggggttttccacctcagggaatcctttcctctatagtctccaactggattgagtggctgtcatctctgctaatataacccagtgtgtctatatcccaaagcaatcaacacagggtattgtattcatcttgcttatgtcatgtttccctcattggactatgattgccaaggtatagaatgtatatgaagaaagaagtgctttaattagatgtcaagttgattgtgtaacgtggtatttgcataccttgagattaattaaagtttttatattttgtaattatacatatataatgcattctgatttccacaccggggagcaaaaataattgttaatattagagtgacttattgccattctgaaataatcataatggagaaaagctgctcccaaaaaaggtaaatttttagcaacatagagtttgggggaaaaactcttatcttggaatcaaatgggattgctgaaaaaagaacttcatcctcaagatccattgtgaacagatacgaatacctattttaagataattgacatagctaataataactgccatttatgaggtcctactatatatcaagcatcctatgtgttattttataatccttgcttattgtaatacatatttcaaccttaaaaaatagaaattataaacactatttcatataagttagagaattgctcaaaataatataacttttttttagagaaatggggctataatcccaggcttttcctgtggacttatctatattatcctgtctcactaatgagtatagcttggtattggtattggtattggcattagttaaagcatcattaatttgtttggttaaacatcatcaaaggctaatttgaatgttgtactaattatgtaaataaaaaatgtctaatattgagtattttcttcagctttcagaattattttgaattaacaaatacagactttaccatgaaatacaaaagaacttgtatcaatagatgctttctatatttttttcccgaagaatttatgtaatatttattagttgttaggtttcagaaattgtctctccctgccatcactatttaatacatgaggcatatgcccaacatcaaagaacatatttataaattattataacaacatgatatgaggtatttgggatgcacggaaaatattttctaaatttcagaagtttactttgttaacgtagaatagcatgatgtttaagcatgtaattactatcatcaagcaaacttgaagtttagtttcatcaccagtagccaaataaacatgggaaaattacttgggcaaagcattcctttaaactgagaatttattaaaacgatttgttcattggaatgtcttcagtttacatatgggaaacctcaaatcgaatgacttaaataacaaatgcattatttaaaaagcatactgtccagaagcatgcaagccccacgcacacagaaaaacaccgttcctaggttctggacatctcaacatgtagttttgctttatcttcaaactacgtattgtgagatggttgtaatagctgaatacattcagatagaattacctcaaagcagactgattttttgtacttctttgaaaaccaagaaatcattttgcaaaagcctctcagcaaattgctaatcatcttccagtggccagaattaggtcaaatacgtgtaatcgaatcactggcaaatggaatggggcatagagtgattaggacccatctcaggaaactcataattggatgagcagtccctgagtattaggatgtacagaaaagaatacaagagaacaaaatatatgtcctgttgagaagaaaaggtcaagggtaaatacggaaggtggctgttgggtaagcaatcaatagcatctgccacattttcccctttggttatcaaatacctctccagacccatttttcttctcctgcattcactttggaaaaaatacctatgtaaaacatactttctatctacattaatagagaaaacctaaaatttcatccatttactgcatacaaagatatgtccagaatccctaagtgatacactggcttctccattatatttacaggtagttcctcattgtctaaagaactgtggctaaaacataggctatcccaaatccaatataaaagtatagaaaacaaatagggtaactccataaaaactcccactcagaagaagagagaattgaagctacacagagtggttactgggtcacagaacaatatcatgtccttctggataagactagtgaatactgatttctctagaaatggaatgagttcctagataagcttggaatgtaatagaatccatttaccttgtcatagtgctccacagcttctggctctgattcctgagaggatttatttttacctgttgaacaagactgctgtgctctagaatttcagtgccactacatattacaaccactgttgcccctgaaactgtgtttctgttgcttttgacactctttgccagaattcaatctttgtttccttatttatacacataagatgtgtatctgattgataagggaatcttagttctcatgcctgtacactggatacaatgaataatggggaatctaggatctgaccatattgggaggtatgctgtacttcctaccaagattcctaatttcccagacaaaaggaggatattcaggtgctgggcagccagaataatgtataggtgtacacaacatagacttttagggtcaaaataaaataatgcatttataattctgagaccagtgttttacataatataaatatgttccatttaaaaaactcatgttaatgggtattaagtgggaattccgcatggcttcagaaaatatgacaatgtagaagttatggtattaaattatctgtgcaagattcacagaaagattatgagacatagcttctgtaccacttttaacaaaatatcctgtaaaaacctatgtattgagccttatgagaaatggatctaccaagtatttaatatttaatgctatctatggattttttacttctggaaagtcagtgttaaaaagcattatgttatttttaattgacttcattagtagattaaatgttttaattcaaacctcaataagcaacactaagcaatccagttggaattaccatttcacaatggaaatcaagagagtgacttacttggtttaaaaaaatcaagacaattatacattatttaaatactttaagggtatattttattattccagtttttctttcattagtcctatgtgctaaatgcaatttatgtttttgtttatttactccacaaatgattaggaagaagtaaaacaggcaaaatgtatggcattctttttacactaaatgcataatatttttcctattttcttactaaatgtttcagccctactaccaaataaacatgtagaggaagcattcctattatacttatgactatttgttgattttttatattaacttttctatattatacaaaaataaatgggtggaaatgtctatttggccactttcatattattaaagtatcaataaagaaggaaaattttacatcagactcctgatgttacttattacattatagaatgaacaagttttgttgtcattttgtttttgttttcctaagctttatttacacatgctattaaagatatttttcttttaaccatatctcaatatactaagttggagttttactgtaataccttacttatattaatggcttcaaataaggcaaagctaatttttatttttttaatgcacaagttttacttctgtggactatttcaataataatgttaaaaataagcataaatgaatcaaactaaaatgaatgtattataaaaattcaatcagaatattctagcttctcagtaattgtatgtcactgaaactgttcaagaattattaagtgtctaaaaattcagtgaaagctcagtggttaagtgcttatccaaaagtatatggattagttagtaattaattcatcacttaatttaaagtgagatagagctctcattgttgcatacatacatgcatgagtctcagttacaatttaggcaaaataaaatctaccattaaatgggtgtccaaagtctttaggatatgatcatactataatggatatcaagagtttggcatagaactagcaatcaattaggcagtcatttacctaatttgtatccactagcctattagacttttaagtcatatgaaaggaaacattctctaattttaattacagtgcactcatatatctactgtgaaataggttggggtgatgaagatcatgggatttatccttctggcaggatgacagatgaggtactttgagagttactctcactgaaatataagaaacatggtagtgttcatgtcattattagttcacaagaaaacaaaagaaatgtataaaactatgtatgaataccatgcaaacctacagacacacacacacacacacacatacacacatatatattggaagcattccctcttaaatgaggtacaatttaatgagactaattgtcatctgttctagtaaacattttaccagatatccaagaaagttaagattttaaaattacataatttggaaaggaagaacctaaaatattatttacagaagacatgcttgctatgtaagaaactaaaaataatttacaaatgtttttaaataatatggaagctttatccagtgcctagttagatcaataaacaaaaaataaatttcttttctatataccaaaaaagttccaaatataaagataaaataccactttcaataacaaaaagcattttcaagaagtaatatactaaaaaaattattaaaatatatttagagatccaaataaatgaagagagaagtcaggcttgtgtgtagggatattcaataccttaagatgtcagttctcaccaaatcagttacagattcactgcaattccattagaaagcccaaaataaatttttgaagaattttacaagttgatatgtgaaagacaaatggtccaagagtagtcaaaatactcccaaagaacaaaagtattaagtgtgtggagtatctgacttataaggtacagtcttatcttatagcaataataaaaataagccaatttgtggtagttcgggtacatacaaacttaccaagagaacaagatccagaatccaaaatccaacatacttatatacagaatagtgatatatgtttagggtttgctgatcattggagaaagaagggctatttattaaataaaaagtattgagacaactggatgttcatattggagggaaaaatgaaaggaatattgtgctaatttatattgctgtgtaaaaaattacccaaaattagcaacatgaaacaacataaattttttatctcacagtttccacaggaaaggagtctgggcatggatatctgggtcttcttttcaaggttgtaccggggtgaaatcaaagctttggtctgggatgtgatctcatttgaaactgtagggcttcttccaagctcacttgttgtcagaattcaattattgtggttgtaggacttaggccctcagctcctaaaggccacccactgctccatgctaaatgtgcctttccacagcatggcagtttgtatcttcaaggccaacaggagagcatctcttctgattttttgtttgcttgttttttgatctctcatttctggaccttcttttaaagggaatctcctgaattagtcagggccactcaggataatctcccttttgatgaacttaaagtcaactgattagagatcttaattacacatctttaatattccttcaccttttccatataatataaactaatcataggattgataatccgtcattttcataggtcttgcccacactgaagaggaggatattatataggttatctacaccgagggattagaatattggaagacatcttagaattctgcctcccacacattcctactttgcagtttctgtaaaagtcaattcacaaaagataaaagatatgaagatacatctttatgagcttgtgtcattaatattaataatttttaccagagtaggatttgtttatctattattttatgagtagataagtaagtcctactctggtaaaattaataacttttcttataaataatctaacaaggaagctgtgaacttgaagctattgcaacacatataatgtaagggattagtatccataatatataaagctgatctcaactagtgagccagatccagtggtgtactatgagtgagccacaggtagaactaagatattgatttaactccctctatggaacagaaggtcctgggcaaaaaataaaaataaaatttccattataagcagcttcatctgttcacctttgtgtattacaaatattattgttttcaaagtgtgctataatggaatgttttcagaatcaccaatataaagaattcttgcaaatgataacaagtagacaagcagtctgaggaaaaaagatgccaaaacacaaacagttgtgtcacagaaaaggaaatataaatgatatataaacatataaaaagatatgtaactcaattagtattaaggaaaatgcgaaaaaaaaaaaaacacttttacatctactagagtggtaggaataaatgcattcaatgtacacgaatgtgaacatttgaattggtaaaacaattttggaaaaccatatggtactaggttataaaatgaatttttgctgttattacctagcaagtatactgcctagagacatacctgaaaatgtgtaccaaaagatgtttaatactgctcatgaccatgttgcttatagtagccaaaaaaaaaaaaaagaaagaaaatgggaaacaatctaagtctgtattgacaggtaattattaatgggaagtatttatattttactataagtggaacaaatacacatattttttaaattatgatcatgtaaaatgtatagttcaaagtctttatacacatgctgtatttaaacttggccaaaacaattgttttagtcaatgcaaatattaaaatattttataaaacaagaaatatgtgtagtcaaaaattgttggccaggtccagtggctcacgcctgtaatcccagcattttgggaggccgaggtgggcggatcacgaggccaggagattgagaccatcctagctaacatggtgaaaccccgtctctattaaaaatacaaaaaaattagccaggcatggtggcgggcacctgtagtcccaggtactcaggaggctgaggcaggagaatggcatgaacccaggaggcggagctggcagtgagccaagatcgcgccagtgcactctagcctgagtgacagagcaagactccatctaaaaaaaaaaaaaaaaaaattgttattataacaaaaaaaagccaagatataaattcctttatttttaattatttttataataacaaagtagcaaatagttataaatattactaaagaaatatcttcttcatttattctctcataatatggtaacttcaggcattcattttatcaggtgatgaataatattttgttataaattattttttgctcaaagcatgactctatgcaggacattatgtaattttatgtaatttctttctgtactgattcttaattacattttttcaatattatagctatttttaaaattgcaatttaattaaatttgaatttttgcataggtatataaacaatatatggatacatgagtatattttagcaagaaataatgctgaattacatagcatggtatagtgtgcctctcaaagtattgtgctcccagttttgccgctcattttaatatatttgaggaattcttttaccaaacgatacataaaaataaacttgataccattctggcaatctagattcaagtttagctctaacaaattttaagctttactacttaatggaaatagcacactctgtttctgcatgttaactttataaaatatatatgcaaatatgtggaaaaccactctccacctacatatactttttataaagccttcttaaagtagatttgctttaatcattcttcaagtaagagtattctataaacagaaaccatgcaatttcattgaaaatttaatgcagaaaatacaatacagcaagtaaaagtcatgtaatgatatgattgaactttaagaatattctaacatgacttgctgccatactatgaaattatatatatatttatacataattgaactgcttgtgtgtgtgtgtgtgtgtgtgtgtgtgtgtgtgtgtgtgtgcagagagacaaagaatgcatttctgtcattgctttttttgttgtttttattgcacaacgcagtatatttaaggtgcatgtttctgtttactgctaggttatccagataaattttgaagaatttgatctggagattggctatgataccttgacaattggcgatgggggcgaagttggagatcctaggacagtgctccaagtgtaagttcccaatgtttcatttttgccttagcctatcgggtactaataaaattttactttcaaattattgttttacattgatcgctcccactactaccagcagaagatgcacagtaacttagttattattgttaactttcatagaatctgttagtgcttcttcaatgagatttaaggcactttgtctcagttcagttgggcttctctaacaacatgcagtaaactgggtgacttataaacaatagaaatgtatttcttatagttctagcggctaggaaatacaagattaaggtgtcagcagatttgacgtctggtgagggcctgctcatctaacctgatgcttctcaaaatagggtctttttgcatcacaaatgcatcacaaatacctggtgcacatttgaaaatgtagatttttaggccctcaagccgaacttagtgaatcaacatctccaggatgtgaatttatcaatctatattttaacagaatcactgcatgatccttatgcacatcaaagttggagaacaactgatataaatgttaaaaaaattagtatcagcatagacagctactactggtaatgcccttattgtatgtaaattgactaaaggtaagctatttttttttcctttttttttcttttccttttcattctcttctccctcttctttttattttctttttaattttacaagaaggcctcctagaactattattccagaatcctgtaataaaccaagggttaaactcatagtcacacatagtatgttgtgggctccaatattactgctctttagtgttacttttctagaaaacaaaacaaaaaccaaacttactcacctgtcttcatgcactcttgacctcaacttcaacctctttcccctgtctgcaacgtggatatcattgatcaacatgatttggtggtctatctctggcctactacagttctgttttgtgtttcctaaggtgtgatggacaaatgggccagcattttacatgctttatatgttcaattattagttcgttttcacactgctttaaagaactacctgagactggattatttatgaagaaaagaggtttaatttactttcatttccacaggcttaacaggaagcatgactgggagacctcgggaaacttacaatggtggccgaaagcaaaggggaagccaggatggtggcaggagagagagagagatggtggcaggagagaaagagagagagagagcaaagggggaagtcccacacactttaaaaccatcagatcttgtgagaactcactatcatgacaacagcatgggagaaatccacccctgtgatgcattcacctcccactaggtccctcctccaatttgacgtgagatttgggtggggacacaaatccaaactatatcagttatgttgctcacatttttgtaacttcattcttaacacttcctctcttgaaaatgatcagcatttttgttgcacctgagcaacaatttgagcctgttaggcatattaccatactgaactgacattttccagaaataatcaatagtttctactaaatcttattgtagttttatacctgatagcttagatttcattataatataaaattgcatatattttacatgcaatatactgtaaaattgtatatatataaattggcagcaacagagctgctctgatgattagctgtgcttttttcctatcattatttgtcaaatacagagttttaaggaactgaaaattacatgtaaaaatttgaatttatggcttcttgtaaaactggtgaccctagatcttcatagtcatgtggcaaaaattggctaggactgtcttctgcctcctatggagagggcctctttgtggccctaatccctctatcattttccacttgagcttctaagatcctttgcgttgcctgcctgggcctatagctaattaagtgacacctgatataagacaaaatgtggattgctttctttatcaatttattcattgttttgcaagtgaatatgtttgtttctttacctgacactcataaacactgaagtttcttggatattaatgatacatagtaaatttggtgattaatcctcacacattgcagatgtttctctctacatgtttgttagatcctatcacatgcactttagagataaaattgtaaaacatgtatttgatgagatatcttttcctttttctccttaagacagaaaactggattttaggttcagattcttaaaaacatggacaagaaaaggcaggctggctagtcaattgactaaaaaatactttttaagaagctttcattcatgtatctgccacaaaaaaaacttccatctcagcattggataaaatattagaaatcatcttgtccaactgacatccaagagcatagatgctatgtcctcctattgctgttttcttaaaaaaacaaaaaaaagctatttgagctaattggtatcacacaattgtgggtagaaagattatatatatatatatatatatatatatatatatatatatatatttatggtaacctagtaaaatacagaagaaagatgtcaaaattatcttaaatactcaactattagaactggttaaatataaaaagagtacatttgttgggattgaggagtggtctgtacaatccctaatgttaaaaaaaatgtgtgtttgaaccatatttttcaccctatttcaatgttagaaaaattcggaagacaatcatgaattctgatgtaccaattgatatcctttttggacagaaaatcattgtataagtaacatagaatgactattaggtattatttttcaaaagaataccaagtacccaaatggttgttcctacaccatcaaatttaaagtttccaatgagaactgcatcttcagtagggattaaaaattaggctttggggcagggccagtatggccaactagaagcagcagagatcggaggctgccattgaaaagaaccacaacagtatgcaaatcctgcactggcaatcgagatatccagattctgtcatcagaactgactaggtggctagcatgatccaaggagaggaaaaagagcagtgtggtgcagcagcccacctgagagccacatggggcaggggagcccccattccatagccaagggaggtggtgagggagtgtgctacccagcctgagaaaccatgttttttacatggaactgtgcaacccacagattggatgatcccagtcacaagcacacgccaccagggcctagggtcccaaccagagatccacacagattctcaatagccactcatctagaatctgcttaagcctgccgagctctcaggggaaggggtggccagcatctcagctgtggctgcctgttgtctaagtcatttgagcttcttgggggagggttggtagccaacactgggactgatagctgcctaacacactaagctcccagggcaggggaagggtggcagcaatctctatagctccaggccacgcttttcttctgctggagccagagaggctgaatggcttggtctcaagaggtatcccccatagcccaacatactggctgtggcagactgtggccagagtgcctcttcagacctgaacctgacccatccctccccactgggttgggcctccctgcaggaactccaagaactccagccaggggctcagggacagaactctgatctccctgggcttgagtccctagtgggaggtgtggccacagtctccagggaccagcagaattagtttttcctcctgatagttctgggcaatccaggcagaccagacgagtgattttcctttcagcaaagcacaccctgtccaccaagggacagtcaaagtgcttcattaaacaggaactgttccctatgccactcaacttggtaagaccctccaacaggagttctcagacaccctatacaggagtgttcctactggcatcagataggtgccccttgaggtcagagatcccagaggaaggaacagacacccatccttgctgttctccagcctcctcaagtgacatctccaggtgccggagtgaaccagatgaatagggcctgaagtgaacctccaggaaactgcagcagccttacagaagatggacctgaccattgaaagaaaaacaaacaaacagaaaggaacaacagcagcatcaacaacaacaacaaaaaagtccccatagaaaccccatctgagggtcagcagccacaacgatagaaactagacaaagtcatgaatgtgagaaagaattaacaacaacaacaacaacaacaaaaagatgaaaatccagaaggccagagtgtccctggtcttccaaatgattgcagtgcgtctccagcaagggcacagaactggacagaggatgagatggaggaattgacagaagtaggcttcagatgttgagtaataacaaactgctgagctaaaggagcacgttctaaccaaatacaaagaagataagaaccttgataaaaggttacaggagctgctaactagaataaccagtatagagagaaatataaatgacctgatggaggtgaaaaacacagcaggagaactttgtgaatcatacacaggtatcaatagccaaattgaccaagtggaagacaggatatcagattttgaagactgtcttgctgaaataaggcatgcagactagattaaataaaaaacaatgaaaaggaatgaacaaaacctctgagaaatatggaactatgtcaaaagactgaacctatgattgattggagtatgggaaagagatggttagaatggaaccaagttggaaaacacccttcaggatattatccaggtaaacttccccaacctagcaaggcagcccaacattcagattcaggaaatacagagaacaccactaagatactccataagaagatcaactccaagacacaaaatcatcagattccccaaggctgaaataaaataaaaaatgttaagggcagccagggagaaaaatcaggtcacctacaaagggaagcccatcagactaacagtggatctctcagcagaaaccctacaagccagaagagaatgggggccaatattcaacattcttaaagaaaagaattttcaatccagaattttatttccagccaaactaagcttcataagcaaaggagaaataaaaccctttcaaaagaagaaaatgctgagggattttgtcaccatcatacctgccttacaagagctcctgaaggaagcactcaatatggaaaggaaagacaagtaccagccactgcaaaaacacaccaaaatatgaagaccaaatgacactatgaagaaactgcaacagttaatgtccaaaataaccagatagcgtcatgatgacaggatcaaattcacatgtaacaatactaaccttaaatgtaaatggactaaatgccccagttaaaagacaaagactgacaaattggataaagagtcaagactcatcagggtgctgtattcaggagacccatcttatgtgcaaagacacaaataggctcaaaataccaagcaaatggaaagcaaaaaaaaagcaggggttgaaatcctagtttctgacaaaacagactttaaaccaacaaagataaaaaaagacaaagaagggtattacataatagtaaagggatcaattcaacatgaggagctaactatcctaaatatatatgcacctgatacaggagcacccagattcatacaacaaattcttagagacctacaaagagacttagtctcccacacaatagtagcagaagactttaacaccccactgtcaatattagatatatcagtgagagagaaaattaacaaggatattcaaaacttgaattgatctatggatcaagtggacctaatagacatctacagaacgctccaccccaaatcaacagaatatatattcttctcagtgctacatggcctttattctaaaattgaccacataattagaagtaaaacactcctcagcaaatgcaaaagaactgaaatcataacaaacagtctctcagaccaaagtgcaatcaaattagaagttgggattgagaaattcactcataatcacacaactacatggaaactgaacaacctgctcctgaatgactcctgggtaaataatgaaattaaggaagaaatgaagaagttctgtaaaaccaatgagaataacgaaacagcataccagaatctctgggacacagctaaagtagtgttaagagggaaatttatagcactaaatgcccacataagaaagctacaaagatctcaaattgacaccctgacatcacaattaaaagaaatggaaaaattcctggacacataacaccctcccaagactaaaccagtaagaaatcaaatccctgaatagaccaataacaagttctgaaattaaggcaataattattagagtaccaaccagaaaaagcccaggaccagatggattcacagccaaattcttccacaggtacaaagaggagctggtaccattccttctgaaactattccagggagttgaaatggagggactcctccctaactcattttataaagccagcatcatcctgataccaaaacctggcaaagacacaacaacaaaagaaaacttcaagccaatatccctgatgaacatcaatgcaaaaatcctcaacaaaatagtgacaaactgaatccagcagctcatcaaaaagcttatcccccacaatcgagtcagcttcatccccgggatacaaggctggtcaatcatatgcaaattaataagtgtaatccatcacaaaagagaaccaatgacaaaaaccacatgattatcttaatagatgcagaaaaggccttcaatacaatttgacacctcttcatgttaaaaactcaataaactaggtattaatggaacatatctcaaaataataagagctatttatgacaaaccaacagcctatatcacactgaatgggcaaaagctggaatcattccctgtgaaaaccgacacaagacaaggatgccctctctcaccgctcctattcaacataggatggttgaagagaaagaaataaagagaggaaataaagagaaataaataaagagagtaagtcaaattgtctctgcagatgacatgattctatatttagaaaaccccattgtctcagccccaaaactcctcaagctggtaagcaacttcagcaagctctcaggatacagaagcaatgtgcaaaagtcacaaaaaatcctatacgccaacaatagacaagcagacagccaaatgatgagtgaactccagtttacaattgctacaaagagaataaaatacttaggaatacaacttacaagggatgtgaaggacctcttcaaggagaactacaaaccactgcacaaggaaataagaaaggaaataaacaagtgaaaaaaaagattccatgctcatggataggaagaatcaatatcgtgaaaatggccatactacccaaagtaatttatagattcaatgctatctccatcaaactaccattgacattattcacggaattatggaaaactactttaaatgtcatatggaaccaaagaagagcctgtatagccaagacaatcctaagcaaaaagaacaaaactggaggcatcatggtacctgacctcaaactatactacaaggctacagtaaataaaacagcatggtactggtacgaaaacagtcatatagatcagtggaacataacagagagctcagaaataacatcacacatctacagccatctgatcttcaacaaacctaacaaaaacaagcaatggagaaagggtttcttattcaatgaatggtgctgggaaaactggctagccatatgcagaaaactgaaactggaccctttccttactccctatacaaaaattaactcaagatggattaaagacttaaatgtaaaacccaaaaccataaaatctctagaagaaagccaggacaatgccattcaggacacaggcgtgggcaaagacttcatgacaaaaacaccaaaagcaattgcaacaaaagccaaaattgacaaatgggatctaaattaactaaagagcttctgcacagcaaagtaaactatcatcagagtgaacaggcaacctaaagaatgggaaaaaagtttacaatctttcaatccgacaaagatctaatattcagaatctacaaggaacttaaaaaagtttacaagaaaacaacaaacaaccccatcaaaaagtgggtcaaggacatgaacagatacttctcaaaagaagacatttatgcagccaacaaacatgaaaaaaaaaatcaacatcattgatcattatagagatacaaatcaaaaccacagtgagatattatctcacaccagtcagaaaggtgattattaaaaagtcaagaaacaatagatactgggaagcttggagaaataggaatgattttacattgctggtaagaatgtaaattagttcaactattgtggaagacagtgtggtgatttcttaagggtctagaaccagaaataccatttgacccggcaatctcattactgggtatatgcccaaaggaatataaatcattctatataaaggtacatgcacacataggtttattgaagcactatttgcaatagcaaagacacagaaccaacccaaatgcccatcaacgatagactggataaagaaaatatggtacatatacatcatggaatactatgcagccataaaaaggaatgagatcatatcctttgtgggtacatggatgaagctggaagccatcatcttcaacaaactaagaaagaaacagaaaaccaaacactgcatgttctcactcataagtgggagttgaacatgtacacaggcaggagaacaacacacaccagaactggttggcggtggtggtgagtggaggaagagagaagagcattaggacaaatagctaaatgcatatgggacttaaaacctagatgacggcttgataggtgcatcaaaccaccatggcacgtgtatacctacgtagcaaacctacaagttctgcacttgtatcccgaacttcaagttaaaaaaaaaaaaaaaaattaaggcctcattccacaaccaataccttttaggctgttcattcaatggatgtaaatttgccctttagtgagagtgtgagcaatctaggaagtttttttttaatcagttctatttaaacaatcataaaactatgagactatcaggcacacagagaaattcagatttagccgtttttgtaattatgtatattatgtttttgtgaaactcaaaaagagggcactggtccttactatacaatttttaggtagtgaaaggaaaacctctatgtattttaaatatagcaattgattaacaattgacctctttcttaatcaaatgacacttctgggtaagcataccaagcctttcactttgttcatacctacttctcatagggtttaatccattctcatttgatgtcaagtgcctcaaataatctactatattttttattattggttttgtcagacttctaaatgttctcattattaagtacatatgatacccttctttccttctatattggagggcaggaatggaaatgttttaaaatgaatttaattatgtaataaataattgagatcaagtagcagatgaggctagagggattggataattaagtaaatgaaataagaccgcaactaattttttgaagaaggtgatgccaaaattagctagacagcataaaaccagaaaaagaacaaatatgttgatgggacattcccttacatcccaagtgaatagtcaagtggaaatagctgagttttcttctgctactcttaggaaaatgaaagaaaatagtgttacttttttttatatttccacatgactgttgtcatgttgtcattagtttgtgtagtctatcaaagtataaatacttcatcatgtacaatgtcgtcactctgagaagttatattaattttgaaaaatctgtgatttctagttttgttctgtattcttccattcaaaatcagagaatgtgtttctaaaactttctgttctccctcagaaacaaaattatacttctctgaaaatgtaactctcttttcctcaagtaggaataaatatgacagaacttggcttgggcccacctcctagaggtgttttaataggactggctgactggctaaaagattttacagacttagagttgaatcaaaagttccttcgaactctaggactctgtgatagcagaattacctggatttataatcaccaaagaagctgacataaatttgagtgaacctgaattttaagacttatatgatttctctgctggaatgtggaggaattggaaagtccctctgccagacccagagaccaattggccaccctctcctctcaacttcaactccattcatcataacccatgtcaacccagcctgcatgttcaaagtgtccactcaccctgcaaacagcctttcatttcctctcaacttcagctgcattcatcataacccatgtcagcccagcctgcatgttcaaacggtccacccgccctgcaaacagcctttcattgcacctagggatgcacaggtgaggtgtgtgttctacttgtgggatatggacctggaaaaaaggcctatgctggtcctggtaacagggaattccgggtaccacatacctgtgtgttctagaacagtgctttgcaaacaaacagtaaaatagatttgattttgatttctgatccctcttgaactgataattttataacaagtttctagaaaaaaaagaaataaaacacaataaatacaagctcattaattttcattatgaaattcaccagacataaaattactttttcaaatggctctagaaatgttgaaaggtaacacacagtttctgtatttatcatgttgttgtctggaagctactgcagggtctcaaaggggaggtggagaagggacacagatttcagccaggcaggcacattcctgagcaagagttaaactagagaaaggtcagaggagggccttctacaggggaagaatcagagaaggggcccatcttgcccacatttcaaaacagtactaaacacagggcatggtaaattttcaaaaatgtattttaaaacctaagctgaaggaaatgtattttaaataatgcttttctaacagttaacactagttttcatttagacattttattcagcaatctctttacttgtctgtgaattcctttttgctttttaagtttaattcatgtgctagagagttaattttggcaccaaaattattttacaagtaaattgatttaaaaagattgaatagctgaaggtaagaacacatagccaaaagaagaagccatctcatatcaaaatatttaagtcttttattagaagatgacttcagcctatattcaatttttatgttctaattattttaataaacacataatatatcactttgatacatatttaacatgttatggaacattctaacattttctaattccgtcaaagtattgaattaagtattgtaaatataaggctttttgtgtttcattttgtttcagtatttaggttctaaaaggtaaaatcaattacttattctattccataaaaaaatagttcataaagtcataacatattcagtagctaaaatactcctgcaaaaaaaaaatcagttacaaagcataaaaaaatattaattataaaatttctttttttatgaagtataaagaaatttttttgtaatttgctaacttaaaaataattgaaatgtgccatatcttttcaccttgaggctttagctccaaggaaatattcattacaaagttatgaccaataaaattatttagcaatagagaaagcattgtaattggacatcatacgccatgctaaatttgccatatagataaaaatttctaaaatgatgaaaatttaaactgcaaatttaaactcacaattcagagatttattgcatctgtcatttgttgtgccatatctatggcccattttatcttttctctctctctctctatctctattatctctttctgtatctctgtgttcattttcacaccattagagttacttggaggatgttttttcccaaagtttgaaatagcatttattcctggcaacttcagagtcgtctagtgacaaaagtcaatagagatcagaatatgaacttgacatttgataataattcagataaaggatttgaacaataatattttaatcttttaaaggatatcaaaagaactttgtttcacagattctttcccatgtgctatttttacacttacgtataaattcatctgatagtggaaatgtatataatttattggagagaactaatagtgatggtaatgcaattactggccttgagattacttccagctctccaggagatgttgattattagtctacccttttcatctgcatacagcagaccaagagggtgagacattaattctaccagatatgtgatactccttcatttttctgcattttcttttgcatgtgtcactattagactcattagattcatggtaacactgtaagaactaaatgaaaacaagcaacataaaagtttaaaatatcttctattaagacacctctgaaaattttgtgagtatgcactaacgttggatgacatcgaattgagcaaacatcttaaagaaggtaaaaaatgcttgtatggatatctaaaccttcttcattctatcactttggaattctgaattctccaggataagttagtacaatgtcaaatctcattctcagaaatatgttagtttaggctaacaacactttttcctgattattctccttttaattttaaacacacacacacttctgggttaatataataatttataaataaattttttatttattgaatttaatagtattttaataaataatattcttactagctttatggaaaagatagttctgttttctgttaggcttgtaaatagatgactatcattgctcttagtttgttgagccctatattttgtcagatatatactattgtttttactattcagcaacattcttttttaaaatctaggccctactccttttggcaacatactagtaaacatgatatttgccttgaacaaattcttctgcatccaaggagttatactttcctaactttgcttttgacttcaacaaataccgacaaagaccatgggctaatgaaagaagagcatatactaaatatggcgaaaggtgatattttttagagattaattgccacggtatgaaaagggcttggagaattgaccagtcagacaaattcttagccccttgtgttataattattaagacaagaaaaataaatgttttcttactgccgttttctctatcttgcaccctcgctttcctctttcactatgcatacttacaaacatacacactcatcccttgagggcagcaatcatcttctattcatctcagattttcctgaattccttacagaaagccttgtgttactattgttaggtgttaacagcaattataaaggaagagggaaaaatattctactccaagacacatctgctgagacatgtcaacagaaagggtatctttgtaaatattagtcatgagctgtagatatgccatgagctgtagagctctgtagtcccacctagggattttagcactcattgataccacttccaggaaaatcaaccaaactgatgggagcagttttctcatcatgtggatgagatttcacatgtagttatccatatgatctgctatagggcaataataaatatatgctcttggaacgcagaattactttagaccacaatacaaaaataatctttgtcattttgtttattggcaacaaatgactaaatatatggaataatttattctgtgtggttcatcattattttttcattgtgatttttgctacatatgtctaatgttaaaaaactgatgatttccctgaaaaaagggtttacttctgttttgcttgcatttgttttatatatgtatttgtttttgaatacattgaattgtttaaaatgaactaaagtaatttttagttgtttttccttttgttctcaggaatatttgcactgtagcaggcatttcaaaggtggctgtagaagaagaaattaggggaaaatatagaaagaatatataaacaagctggatttcttcccacaaataatgagtgttataagcaagacctgattggagtcttaaatatatacaatgaagtatccatattccaactttgaatacaaagatgtgtatgctaaagatttggccttcaaattcagttttctaaaaataaaactcaatatagaaatctatttgtaaaagtaataagacccatgacaaacattatcctaccttattatgcttttgaattagccaataaattaaaacttctgaatcctatgtccctaaataaagttaaaacaacaattattgacaactcagctaagtgaactaacatttatattgtcccattattccataatgctttatacattttgattttaaaaaccatacattattcttccactgcattggcccacattctgaactgtcactctactgtgatgtgttagggttttttctttttttttttaacttaacttttctaatcatcgtcattttagtgaatttcgtgtacttcaaataaacatatacattactttttataacattgtactagaaggaaaaatattaaatgcatttttcataaaaagcgaaagttgcatatttgtataatacaaaaaatatgttagaacataggactacaattctcatgtctaatggatgcatccaaaggccttgagtgattatagaaagtcaggcaataggtcttaaggaatgcaggaaatttcaccccaaaatagggctcccttggtataatgaaaaaaaaatttttttttttttttgagatggagtcttgctctgttgcccaggctggaatgcagtggtatgatctcagcacactgcaacctccaccttccaggttcaagcaatcctcctgcctcagccccccagtagctgggattacaagcacacaccaccatgctggactaatttttctgtttttagtagagatggggttttgccatgttggccaggctggtctcgaactgctgtcttcaggtgatccactcacctcggtctcccaaagtgctgggattacaggcatgagccactgcacccagccataatgagcattttgaattaaatggccttagagatcaagtgctggaagagacttttccctatatctacataaagataagactgacccactaaggagaacaattgttcttgtttccctccctgttattttattaaacattataagagagaagaccaggaatgtaagcacacctgaacacaccctttttcaatacaatgactgtctccaaagatcatttaaattccaaaaagaactatttacaagttattttaacttctgttcctctattcaatcattctccctagtgattacttattgcccctgaatcaatttcctcttctctctgtcccctaacctgttttgccaggatccaagtccccattctttctgtaacctcaagatgatatataaacttctggaactcacttcgacatcaggcaatcactctgtgattctccttgtgctcacagttaaataaatgtgtatgcctatttgataagtgcaagaggcagataagggggaagttccccaaagcatttccaactggcttgtgcactgggaggacggggcgaagccttgggacatttgcaccatttgcagggggtggagcctggcctttcctgtcccaggatggcaacgtgggattcagttggtcaggtgaagaaccacaggactccatatcattttgctgacttgtttttcctttttgcccaataaattcctctactcacccttataagaggaggtgccagctgggctttctgggtcgagtaggggctcagaaactgtgaaactcactcatttcctgcatcaggacttactttggtcctgaatgaacactattgaagataaatgcttaaaatattcctaacaccaggatttgtgcatgtattttcttccccaagaaagctataaacagcgaaaattttgctgtaagtttccctgtatccttctctccctctctcccttccccctcccgcaaaactaaagttaaaagtaatgttaactgcccgttttcctgtgaccagtgggccttatctatcctcccaatttgaattccttgtgaacatactttgtaaagtcctgtacaatcctatctcttttgccatgctgttgccataaagtagataaaacctaagttgcaattccggttttcctcaagatctaagacatatcacaaatggttaattgcctttgtttttcactctggtaacatattgccccacgtatttcctgccttaaagagtttaaaaggcaatcacataatctaactctggctacccattcgtttgggaccccttccatgctgtgggagctttgtactttcactctgctcaataaagcctacagctttttctctctcttggtccatgtctctatcactcactgtggtcagccgccacaccaattctttggcgtggctaggcaagaaccttaggcgttaacacttagatgtctctatgagcccaatctttcctggtcgtgtgacaagaactcgtttttttctacaacattttctcttattaatctgccttattgtgagttgatttttcaatgaacttttgaagtgggctaaggcctttcatctgcacaaggctaataaaagtgtaatagattatgttctttattttatatactatttcaattcttgaaaaatatttttgagcgcacctatttaggactttatctcattttagcaggaagtgactgactaggaagactagaatgaactatgaacactgaagttactcagcctgtaaataaacatgtattaaagaagcattttttaaattaacaaataatacattcaaaaagatgtattaaatattgatacaactgtctgtggcagcaaatctgttcgggactgcagcagctcaattcttgcctcctcagaagaaataattcaacagagaggcataaagcagagtgagagaccgaggcaaattttagagcagaagtgagtttattaaaaactttaagggcaggaatgaaaggaagtgaagtacatttggaaaagggccaagcaggctacttgaaagatttaagtgtgtgttttgacctttgactttgggttttatatgttggcatgcttccagggggtttgcatctcttctccccaggttttccttggggtgggctgtctgcatgcacagtggcctgccagcacttgggatgggccacatgcccagtgtgtttactgaagttctatgcttgtgtacttgaggcatttttcctcttaccagtcaagtgttacagttaaactccaatgttttacctcttagcatacatgtttaagcccactcacccaactcctgagatcttatcaggaagctgttgatcaccagtttcaggtgtttctatctattgggagactgcctttccctcctgctggctgcatcaattagatagacagtttaataactgcctggccatcacctgatgatcacctaatattcctggtgtggggaggccctttcctgccctgctcatgtctgactacttactgtaacacagctatttaaagactcatttgagagtcttacaagaatatgactctttcctctgtagcccacagcatcctttactgtcagggttgaaggtttctaccatttgaatctaaaccaaggtgtttgagagggagctgagaagaactggccattgaggttttatacaaagagcagggttttcagtgagacatcaagtattgagaaaatataattaaaataaaatcacctaccaacccaatgaatccgcttcacaaaatgtaaaaagaaatgaaacagcttttctgttaaataaaaattaagccagattgtgatctgcatcagaggcaatctgtagaggagatttcaaaaaagagaaacctcaccctttttatatagcttgacagatataatccattacacacatgttaattgtctttatcaaaagaaaaatatacacttctatctttataataatcaagaagttacataatggagccaagtgcctaggctttaacactcagtgaaacaggaagacaggatacaatcttccttgatgttcttatttcaaaaagatagctccaaggcctctaagaaggacattcttagaatgtaaaacttgtaagtgttttctttagcttttaaaacatttacacatatctgaaagaaaaagaaagcatctacaactttaggttttctataggaaattctaaagagaaggggggttgggggagttctcttacctttataatttcaagaaaatttttacatttttttaaagatttgcatttatacttagaagttttcttttttgttactattttataacacgataattattaaattatgtgtattgctgtttctactcttctctgggcagtttgcagttatcaaaatatatagcaaatccaatgtaaaatacaaagcaaggtaattatcagaaatataattgaattaatttataaatttattgtattattagccttgaaggaataacctttaaatatttaagtgaaccaatagtgaatagttcaagcagattcttgattagccatgaacaaaaattctccatcatccattaattttataaactgttgtggtatctacattgcttatactttcaaataattatctatttgaatattatttttgtagatcctcatgacatcttactaaaccaagcctaaggtgtaacttaaccctagaactcaaatatctaaatttttaaataaaatattttttggagggccaaaatacttattcagagttttcatcaatcacgtaagtaatattacatttataagataatctaggacttttagcatttatttcatttttccaatttttttggagatggaaaacacaaccattttctagtatccttatgaggcacctcttaagggtacagattgaacttccagtatttaatatacatgactttaattgttacaattcttgtggaaaaagcctataggtttcacataagcccaaatcaataatttaattataataacagtcaattaaatctctgcaaataatagacatttacttttgtttctatattgatatttggactggagagacttgtgtcccaaagctaattaacttatattagacttatcatttgcagtcttacctataaacgtcagatttgtctgttaattagatgtttttcattctaaattatccttccatttaaatcagttaaaaaattgtgtgtgcctgtatgtgtgaaatttatggattaatatttagacacatattagttacttttactttgggattattaaaaaattagtaagaagatggtctcacttttactctgccaataattggactgttgaacttataagcagatcatacctattcttgtgtaaaagaaaaattgcaccagacaagtcaaacaaacaagacttttcctaaaactattgcagtaggggagagagactgaactcaactctgctgaaacaaaaagtgggagggtttttaagcagtggagtgagttagtggaaaatcactggaaagctttagatgagagattagtcaatgtatacagaccatctgcgtttcaattgtttcttgttgaagttaagctcctatcctcccatagagactgggagacaggtgctacctccttcaatgattacatttcaaaggaatggcttggaggttcttgagaaagatattctttgttgaatatttacatccaaaggggtagagaatggatttataattgcaagtttttttttaacttaaatgctttaagaaacagtaggtcaggaacctgtagtcagaaagaaacccacctaaaattttctaaagtttagttagggtgactggaacattaagcccatcttaatcactgggagtccaattcctagctgtttggaaataagtgattgtgggaactattattaccaggagtacacaaagaaaaagtagtgtaacaaataacatttttttaataaaatgtggttcttaaagtaattgaaataatgttactgtgaataggacaacaaagcagtctatgagcataagctcactagaatttcttctttcagttgagttcagagccaaaattacttatctagaaaatttttttgagtcctttgtaggaactattgtcaaattcttctgaggtgctggctccacatgaatctgcgtgagattttctttcactttgctagccatgtggatcatcaagagcacttgatccttctagcacaggatcagctaatcttacctctggaatactttcagataaatcgaatctcctggtcaatagggtggcaaatttctttcaacaggtccttccaggtccttatggttttgtgtcttagggattctaggaaagaaagaagcaccttgaagtatgaacatgattaagagagaattcagttaaattgggcacaggacatggtttctgactgaatttcataggtctggcaaccattagttcaaaggggaaaaatatcacgcttgtttgcagatgtcattctaatttttgacaatgctaacagtaaaatgctaggccatttttatccagtatattgcctaatctcagcaaatgagttccattcatcttatagaaatctataaataattgcataattactaggtgacagtgataataatgttgtaaccgagcgagttgtagagaaacgccacactctgagactaattcaggagtccttttattgctggcgaccgagagacggctagcgctcaaaattctcttggcctcgaagaaggggctagattttctgttatactttggtttagaaaggggagggggagcctagctgaagcaatcttacagaagtaaaacaggcaaaagaaggttaaaaagataaatggttacaggaaaacaaacagttccaggtgcaggggctttaaatccatcgcaaggtgatagacgcggggctttgggtgctatcaaccggacacaaatgcgggggcttagggtactatcgactgggcaaattcctggaaactgtggatatagcttgccacagtatcttatcagtaattacattctttgatgggctgggagtcagcttgcacaagttaagtccttgaagaaaagtgggggtgggtaaggggctgcaagtgaaggaaccaaaatggagtctgtccggctctctcagctaagggagaggcaattccagttaaaacaaggtaggatatcacaataagatgacttcctttctctgattcattatgcttctgtagccccaaagtggaaatcatgggtattaaaagatactttaccgggcttgcacattcacatttaaagacggaaagacttcagaccatccaaacatcatatatactataactagacaaaatatcttactttttgtagacattaattctatgaaatccaactgccacttaatttctgggaaagctggttggggaaaactgccacatgtaccttaggaatagactgtaaataattcttctgacaaacagctcatctctttaatatttttggaataattttatttttatgtaagtacagtaatagtctggggtctttaaagtccccattttacttagatgagtatgtcaatgacacactattaatcaaatgaataataagtatggtataggggttactttattaggtaattttcatagttcagtcaaatgttttatcctcctttataattcattcatcagtttccttttgtgaagcatatttttgaaaattaacaaaagtttcttgtattaaaagtgaggcttccaagtttacaatctgttacattttaacagttgcttttgcagctctgtcagcaaaatagttgcattaaaaattgtgtcattctgctctatgtgagctctacaaatggttactgatctgacaggacagttgtacagcttctaaaaaatcagctatcagttttccatgagatattttacttcccctcaaagttgagaagcttctatttctccaaatttgctctcctatttgatggacaccaaacatgtatttcctacctacctacctacctacctacctacctacctacctacctacctacctatcaagaattgcaactccagtaacttctattaactgtgctgcttgtgtcagcttaattctaggcaaagcataagctttcaaaatgtcgtataagaggtcatcatagcatacaaaaccttaaatagggccatttttatcccaagtacatgtccaccagtaaatattattaaattgtcattgctaaaaaccacaggctctttggctccctatgtaatggaaattaacatgaggcccagcagatttcccagacaaggtatttatttcagggcttgtgcttaagcactagggagacggcagagtcacaagggtcctccagctggctctccaaaaaaagccagtagggattttctttactaggtaactcatgggaattgacatcaggggtaaggtacacagactgttctgtgcacagcacataagtggtagagtacatgggtcagcatatcttattgtgatggttatcttgagcagtgggccacctggtggtctggccagaggcaacagggctgtaaatcaattgtgcagcattccttcccaaggtgggaaactgcaaacttggtttgatttcgaatctcctaaggccagtttctggaattatttaaacaaacggcatggttacacattatgagagcacagaagaagaacatagaatggcttttttccttgtatgactactaacaggtatgttatcagtgaagtagtggtataggtttgtgatcgggggaatgcaagaaaggatgttctagtggaggtgagctgaagcgaggccccatcctttctctgcctcattacagacaagaatatcagataaattcatcagagcttagtgtcttctcttacccctgtaatacaatcatgatcatctatttgatcaggatctggtaaaagagtaacatgatttaggatattgcatctcctaagcacaatactgggatcaatgcttgttcttaactagtctgttggcatacccacacattctggattttttgcacttgtaagatagctgtcacagcatgtgggacgcgcatataagtgactgcaggtaagggcttgagccttttaaaaagtttatatgctacttccacagaatcttgtcatcaacagtgccactacctccaaggaaactgagaaatttgttattaatgtgtcatctattcccaacttttgagttaaaattccaaaagtagccgctttattttcatagcaaagcaagtggaaagtctttgcaaaatttggaactcccaaagcttatactatagccaattttaattggaacacttcttcagattctactgaccaaataaaaggatccgaggaattattacacagttatttcattagagttttggccactttacaaaactgaaattcactgtccacaatattctactagtcctcaaaatagtttttttttttaaggcctacataatgccttcagcatcaacagatgctctaaatattttatctcagtttggcaattttgcaatttgtctattgaaggcttatgcccttgtgaagggggagttgtaacaaagctgaagtgtcagttttttattgctctttagtttctgagcctaccagcaaaccatcaacatgctgatgacttacagatcccccactgggacaaatttctttaagttttttctgtaaatgattagagaaatggaaggagagtcaggaaatccttgaatactttttcataaatactgaactcctttctaagtaaaacagcaaacagcaacagaaatgtaaacttgtttactagagcaatgagaaaaaacagatcatagataaatcggagaaaaaactttgcagaggatggtagcaaagtactaaagtttctgatgttagaaactaaaggcgtgaatggagcaataaatttattttcttctttaagatcttgtacacaggtcaatcatctttatcacatttaccttctttcctttctggaagtatggcagtattaatattacagggtgagtgtctttataaaattaccacttgtctttgaatttttttaactgtgtttatttcttctagtagagcctttgacaaagggtattgtttgaccatggccattgcttatgttttttgtaaagaatttctattgattctacacctcaaactaaaccacttgctagggcccaaagtgatgaattgacttgtttcagttcagggcacttatccagcacagtgtgagaaagctgcttttcggaataccccttttctttcagaaggtacacagtaatcagattccttttattccagggagttccacagacactccctatggaatatagaatatggtagtctttaattttcccagcaggtctccctgcaataggtttacaggaggatcaggagaaaactaagaaaacctattcccaatatgaggccctatttgtgtgggaactgcagaagaaaaagagcaagtagaaggctaactcaaaataccaacaacgtgtgttcattaacaccagatggaaagtaagacttttctggggaaatcacagaataagtagcaccagcaactactagaaaatgcacacctggaatcccagcactttgggaggctgaggcgggcagatcacgaggtcaagagactcagaccatcctggtcaacgtggtgaaaccccgtctctactaaaaatacaaaaattagctgggtgtggtggtgcacacctgtagtcccagctgcttaggaggctgaggcaggataattgcttgaacccgggagttggaggttgcagtgagccgagatcgcgccaatgcactccagcctagtgacagagcgagacttcatctcaaaaaaaataaaataaaataaaataaaataaatgcaatgagttagcatgagagaaagttattgaaatgtacgtatcatcagttcccacatctgagatcccctcaatctgtcagttttaggtcattcccaaattatttcccagccttctgggctttcctgattcccttatttctgcagttgctgtatcctctggattctcttttctccagtcccgcctccaacatctggcttctcgcagtatggcatatggttttgttttctttctttgctcactctacaggctggccagaataggggttatgccttttactaaatagttcttactggataattaacatatcagttttttttttaatttattttcttcttcacatttctctagattgtcccaaaactaagtaactgctgctaacatttgaatctgtccttgccatcctaatacccttcctctaatttgaatttggatagtcatcaaaggacctgagacaaaaattttgaactacccttggatccataccggtagattctgagaaagcctcaacaaactgctaatggaaatcaatggcagactcccttgtctttcggatacaccattgcagtttcacgcagctcacttttagaggaaagatttcgagtacagctacaaggagttactttcagtgagtctccaaatctcttagttatcccttatttgtggagggtgatgaacagttatctacctcttggttcaatgggtgatcttctggtccccagtgtgcttgttccatcacatgagtggagtctgctgattgcagaactccacactgtatcctgtgcaaatctccatgcccgggactgtaaactgaaaacatgctgcagaggatgcctgcaaacttctgggaagcagggaaaagaagcttttatttgagatatatcagctggcaaggaggtctgtataacttctcaatggcatcagcttcactggtgatcaaataagagctggtctttctcacattgtgacaagataaatgtagaattatatgactttttggcttattttccatgttactgtttattagactaagactattttttttccaaatagcaagtgagaccactctacatctttttgtcttcatgtggggacagtcttttatacaagttcccaattattccccaagcacgttccttcataatttctgctttcctaaatacatgaaatataaatgataagtgacttttgggggcacagtatgtgctaaaacattgagtaggctcagggttagggcatgaggcacacaaatctgtttcctcaaacaaggcagataattcattatcagcgaaagaagttgtggccttgtcctttgtagggaaatacactaactaggagaactggaggtctaaaacaccattgctttgatcttctcaggagtctactaaggcagagaaggataaagagacacaagggatgcagaaagagcagagatagcagaaaaaggaagaagaatcaatgaaagtgcctttaatttatccatttcctcttccattcttctcaatctttccttctagttatgcagatctttttaagtttccaccaagaataatatgtatccaataaatgccagcagttcatttgctggggatgaggtcaaagaatcataacaaattctgaaaggtttggtacttgtatgtattccaaatatgacagagatattagctgtttaggagaaagaattgcaggcaatatccttggcttcccctatttttccaccatcaaagttaattgtaatcctgatgggatttgagtccagattacccatgcatactcattaataaaatttaaaattttaaatttaaattaataaattttaaattaataaaatttgagtttggagagagtggtctatccagatactatttcaaaaaagcaaagatcaagaagggagaacttttataattataattataatatggctgctgtggggtctactcaattcaaaactaccgttcatatcccaatcctctttaccaagtagttggggaaatgtgattaaaaataaaatcttttgccagctcagtaaaagctctccataaaatggagggaaaaatgaaacagtttttctgttgaataggattaaaccaaactgtgatgtgcatcataggaaatctgctaaggagattgcaaaaaagagaaataatatatagctaggaatatacaatccattgcatacatgttaattgccttcatcaaaacaaaaaataaaacatttcctatcattatgacaagcaggaagttaaatcaaagagctaagtactaagtacctaggctttaactccccagaaaagtagagacagggcatcatcctctttgatgttcacagtttaaagaggtggctccaaggccaccaagagagaaattccaggaatgaaaaactggcaaaagtctcatttaactattaaaatattttgatacatctaaaataaatggaacttataatttcaagttttctaaaagaaatgctaaagagaagttgaggggagttttaatttttgacatcagaaaatttaaaaatatatatattttattattatttttagatgacatatacccttacaccagcaatgagttgggaactaggtgaaatcagggcaataggataagttagtaagggaacaatttagcttgcaagtgttagttgttcttcatgaactgacaaaataccattctagaagtttcaggataatagaacagttcaggattatgaatgttataggaggatgtaaaaaagagcaatacttcaattttcccagaaaaacaactcttagtattctctttgaggtagtttgctggtatgtttgatatggtatagctgatgtacatgctatgtaaatataagctctcattcccgtttaataatgggtttactttactttctattctgcctccaagctggagtgtttaccctttcccataaacctgcacctgcctctctacagtagctcaaaaaactgctacctaagaatcaccaatttgaaagttcacatgccccaaaatttaattaaaagatgtttcaaatgattatgtgtatatatagacaatatatatgtgtgagtttgttttatattatggtaatttaaaatggtttttggcaggaagaaggaaatgaagataatctgaagttccatgatgcattatggtatcttggtatcttatggtgttcttcagtgtaatatataatcccataattaaataatagtagtttaccaagtttctttgtgacaaattcccataaatcctgtaacactggccactggttagatacttgtactgcaaatgaggtttgttttaatagttgactacgcacagggcattttgctgccatagtcacttccaggatatggtcaactacactgccctctgctggtgtattcatagtagagccactatttaagagactaaacactctcgtaggtttttacaatgaaaggaaactttatactttcctgatgtaattttccagcaatccttatggttttagcaataaagtaggcaaacattcagtattttcttcctttggaaacctgtctttctgtatataatttagaatctcttatcaatgtggacatttactctgcagtgaatccattttttcctctttcctattcttgatggacttccccgcaacctaaggtcttatttactaatttgctttcatccttctaatgacctttggcttcagttctaatatgcaattacaatatcattgatgatagacaaaacgtgaagtaatttcccttcttatggttacaaaactgtgcattactgaatgagggattagtaatgaatggatacagttatgctgcatcagatttgcagcatatttctttaaataaaactatttacagaaaaacatatgtgacatgggcagcctataatgtaggtactatattttaaggcttgtgtattcgacatcagtattgcaaagggttcggttatactcttggccactttattgttttgcacagaaatattttaacaatatttctctagaacaaagttctgtgaaactgggaatgttaagatatatttgtggtgttaaaaatacttgaatatttgtatagatcctccttttcttttcagttcaaaagacaagtactgtgtaggagtttttgatggtctaaaatatcatgaccttgcctcaggaacatgaaagatctttcctagttaaacacagaataatatttttataataaccttgatcactaaattgtgtagttttttcttctgtcacatcaacacatactcctctatgtttatctgacttttttttctagcaaagaaagtattgagaaacacatctgtcttataatttgtatgcagaggatgttttaataacccatctctcccttctttgtccatctctttttaggctgactggaagctttgtaccagacttgatagtgagcatgagtagccaaatgtggctgcaccttcaaacggacgaaagtgttggatctgttggtttcaaggttaactacaaaggtaatgattaatttctacataggaaatgttatcttaataccaccagagaatatttttaaattcacgtttaattgcatctacaaaattaaaagttttgcagaacacatgctacatttcaacaaagatcatttcctccttaatttaactacaaatgttaattacacttatctttaaataaaatgagtttttcctttaaaatgtgtctattttgcatacctcatctttctcccagtatattatactatccttgtgtttcaatcactgtagactcctagccttccccaaaatagacatgtgattttatgtactttaagtaattttcctggcaaagattctactaattattaaatacttaaatataacagtaaaggtctgaaatccctaaatattccaatgtacaaatctttttttgtaatctatcaaacatataaatatagctcacaaatttgtgaaattgcttttgcccatcccagtgtcagtaaagatacagatcaatgattaactatgtgtgtttaacaaaatattttattctagtttcatttatcagaaatagatgcaagcatgtgaggtcatagatatcttccacacatgttggaccttgattaaaaccaatacatacacacaatgtgcatattagaaatgcaaatttgcaattctgactgaaaaaattactaataagctcaattaaaaatctattttttaaaaacaaaaatatacaagagatcatcagaatgttatgttgcttgaattatcattactattgtggtaaaaattattattttctatcttaccaattaaataattactgtgaaaaattcttttacttgcataataattttcaattagaattttctcttacaaacactgtcatgcttttgattctggacacatgaaaatgaatgcatgatgttgtcagagagacagaacacattcattctgtgtttttttttgtgtgactaaatttggtactgtattaatttgaatagttcaagaaatctatgtaaatgccagtttattaaaaaggttagcttgattatagttttaatatattcctcctcaatttaaaatccacctctatccccagtaaataaaacaaggttacaaaatttaaagaacaattggcttatgttacatgtatttatctgtcttttttttccggcaacttgtattttacatgcagggggtctgtgtgcacatttgttacttggaaatattgtgtaatgctgatttggagtacagatcctctcacctcgtcatacttcttgaaatgtatctttttctgtttcttccccttctccctctaaatggctaaggaaacctggcattcttatattcctgtgtttctgttattttctccatcttacgaaggttacctgtcagaaaatctatagtgatttaaacattagaaactgtatgaattattaatgataatgcttgaacaagaaacatttattaaaactcatgaataggttggagcaacagggagttctatcgatatttacacagttctcccctctgctgcggttcaagagctggaagtacattgtagagcagcacaattaaacattatattgttctccgtctgctcagttttcaacaatagtaattaaacaattcacagagatgatatatttgaaaccaacccaggacattctaaatgaataatgccctactttttctccctccttttccttagactggaagtgtctctcccagtccaacctgctgcacattactaatgataatcttccagcatcagaatgatgatcatattactctcatgctcaaaattctgtttttttatccctagagataaaataaaaaatctccatacatcatttcctccagctttctccatctaattttctttttccataaactctaattttaccaaattatccataactctctgaaccctgcaagttgtttcacaactctgcttctttggacattcagtaaatctacctgaatcactgtttttaattttaacttagcaccttctcgctcatccttcaaggcaaagttcaaatatttactcttctatgaagacttcgttagctctacccatcacagaagaccacttcctctattttataaaccgtgaatcatatgtattatataactaaatagaaaatatatcttacttgtctttgtatttctgctagcaatatccatgccatcattataggtagctaataattatttgttcaattaaactgaataaatgaacctatataaattaggtatttatattaggcctatataaattaggtaatactaagcaaaatatgtcctcaaaagtttagtttaccaggattttttttgtactgtgaaaatcatgtttttgcattctacataatttaaaacctgagctcatagttgaagtagggttcacgttgagaagttacaaattttgatgtgcacatagttttagcaagttcacctactaaaaataattttcataattaccatgctctttgttgagtagtgtgttggttctaaatggaacacctgctaaaaacctttccagatttgtctaaagatatcttctggttttgtaatctgtagattttgcatgagacagtattaaatgtacatgtcctctaaattaaatatatctatttattgagtagtttgtctcaaatttttaacattttaaacatagtgactaaaatgtgtaatttagtccttgttttttgtgatatagttttattcctaaattgtgttttactaattaagagagtgtttttgaaactttattttaaaggaaatataatttcaaatgacgttttctgttagaaactcaaaatagaaaaaagattaaaagctgggcttctctggtagaacaaggatgggaagaagacttggtaccttcagttgatctgattgcttctcattccctccaaatgtaggaagaaccttaggactccaaaacatatagtttgaaaatgactgttctaagactgtactattgagagaggaacaaaaatttatgtatgaatgtaaaatagtacataattacctgattaagttgtcattaactttagaacttctgctttaaatctgtggaactatgaatgcttttttctatggagtttggaaaatgtctattttaaaacataaaaagcaacaaatgttgcaaatcaagaaaacagtccttaattctaaatttagttaatttttattcaactaggattcatttcgtgtttctgttcatgacagtgtgctgattactgtataccatagcataaatgaataaaatgccaccaacctcttgggtagttaatgatattcctaacttttaaaaatcagtaacatccttgtagatgtaacaaagtcgtggccattctgattcacaggagattttttttgtttgccaaaactattatttaagatgtgaactaaatgtcttgctgaaaaggaagtataacctagctgtccaccttgccccatttcccttagaaacattagttttgttttgttgtttttatagggtcattattccaaatgcgtattaatcagaatgcaagaaaaaaagagagttcttttcaatggacacattaacatccattaacattgagctactttttggatatattttcaactttgtcttagcttaaggaacattagagcaataattaacagttatgaagagccttgcatattccaattattttgcctacattaactcattaaatctgattagaacgataagaggtaagaattattactcatttttacagatgagaaaactgactaggatttaagcaccatgatgataggaagtttggtctgctttgtttattgctgtattcccagaatctagcctgatgcctaacatacagaaagcaaacaacaaatatttgtgggatgcctgaataaatgaatgaacatgaatggttaatcataatcatattgcagaatatagttgcaactctgagtttactgacttcattcttttttccattatgcaatattatatcctaagtgattttgagagatttttaggaaaagctggaaaccctaatcagtgtgaagagcaggagaacaccaaaagactgagttaaattactgagctccccttagctcatcaggtacacatcaaaataaaacataggcatgcacgtgcacatgcacaaccacacacacagacaaaaaccatctgatttcacataggagatgtgtgcatttttttttattttcatatagttacttggtatttcttaagacttgaattatttaggaatgctaactgattattacttttataaagaaaaatttttgatttttgtatacttgtgtggtatttggccacagtatttaatgcttttgttaattttaattatttcatgattaggcattgtaataattaggaagacatgtattggcatattacagaaaacccaactaattgtggcttaaacaaacatgtgtttactgttgccacatgacatgtctagagggtatacaccaatgttatttttatctgagactcaggtgcgttcttgaattccctctaccatcctcagcatatttgtcttcatcctcaatcttataatttttgccagaggtctattgtaggagaagattggacccctcaaaattccattaaattatagtgatgagagctagcatttctgtcttattcttctttggatggcagtgaatttatatttgaacatttaatatatttgacaagggtatgtggaaaagaatctttaccaactgcagagagttcaaatacatttcatctaacttctagtcaaacatttttctgtatccattgacacaatcatgtatttaattatgtctctcctttaactgtattcatagtttttttttccagtactgggacaaactttcatttctgtaataaaaccttgaacatgatgaccaatcccttagtacaccctgggatcaatttgctaacagtttgactaaaataattatatttgtgaatttgaattagagtttctttttgtgttggttttataaaatttgagttttagaatatggtagtattaaagaatgagtcaggaaatttgtcagtgacttggaatagtatgaataacaaacataaaagttacatgttttttagagtaagaaagaccctagccataaaactatctggacgtttttacttaaaagtaaatatttaacaaatttaatttttgttcctttgactataaatctcttcagatctcttcttcaattaatgctggtcacttatattttgttagaaaaatttccaggtcatacacaataattttcaaatatatggacatttcatgtacattttcttttttaacaaaagtttctttgaaaaaaataataaagatatagcataccgatattttacttatgggtacgttaatttcaagggggtaatttttttctctttctctctttgactgcatctgcttttatccctgactggcagttctttctttttgtactagtgactgaactattctagactctgataaaccttatttctcctaattctgtacagctctacaggtttgggccaaactaatcagaattccctttgaaaggttatcagtccaggctggacgcagtggctcatacctataatcccagcactttgggaggccgaggtgggtggatcatctgaagtcaggagttcgagaccagcctggccaacatggtgaaaccctatctctactaaaaatacaaaaattagcagggcgtggtggtgcgtgcctgtgatcccaactactccagaggctgaggcagaagaattgcttgaacctgggaaggtggaggatgcagtgagacgagaccgcgccgctgccctctaacctgggctacacagtgagactccatctcaaaaaaaaaaaaaaaaaaaaaaaaaagtttatcagtccagcatctggggcaattgatatagtttctgggtaaaagaaaatattttttctaaggtggtaaattctaagggtgatttcacttggtgatactggtataacttttttttaatattaataacttgctgatagaggcatggcagaaccaatgaatagaaagaaagacatagcattgtggacataattggaactcctaaatttagcagttcctgaaaggaacttggtctttcaattgtgtgaggctataaacttcttttttaagacatggtgagttcagtttctgtcactaaattagcctctcaactaaatgaaccctgataaacacatttgttatgtctttgtttaattatttcaacacagtgttaaattaagtttagtctaaatcttcctctttatacatattttaagttcagcttaaaggtttctccatacacagtgaaccataacttacctgaatgagtaaacaggatgtgacttcttcttttaccaatcactgagttctggccaatcaaaggcagccaactattcaaaccacgttcaaataaggttttattacagtcatgctgtaaccaatccagctatttccgtacctcacttccattttctgtgcatcactttcctttttctgtccataaatctttgactatgcaggagtgctgaagtctctgcaaacctttttttgtttgtttgttttgggagcttccagatttgcgaatcattctttgctcagttaaactttgttaattttaatttgctgcaagtttttattttaacaacagtaagaagaaatagtctatactatagttcaatgctttcagatacatgtctttctttattttaaaaatatgttaacatggaaatacagtgcagatgggcccaagaaaaaatgtgtacccacaggaaggaacagttatatgtgagttaattaatgttcactatgctctttttttttcagcaaaggaaacatagaaatatgaggattaccttctgctaccagtatatattcatcatgagcaaatttctttatcttagcacctgtgtcttaatgccattttgtatattatatatttatatataatatttatatagtatataaattaatatatttaattaatatattaatttaatatgtaatatattaaattaatatattagcaatataaatatgtttacatatttatatacacacagtaagttgtattcccattcagttttgttctcaaatcatgagaaaaattaacgtgtttcagaagtagcatcaattcctttgtccttatatgattgataatggcagaaagaaacaattgtttctcatcactcaaaccatattgtgtagtaaatgttttctgtaaactttctataaatgttttaaatgattttttcacccttaagatttttgttatgaatagttcagaaatagacccacatattatggccaattgattttcaacaaagaagctagagatttgaatcagaaaagatacatattttttaaatggtgcagaaacagatgtatagccacattcaaaaaaaattaactgttaactcatgcaatatacaataatcaacttgcaatgtattatagacctaagtttaagagctaaagctatacaacttttggaataaaacatagaagaaaagcctagttaccttagcttaggaaaaattatcttaggggaccaaaagcatgctatctgttatgagctgaatatttatattcctcccaaatttatatgttgaacctctaacccccatatatgatggtgtctagagatgaggcctttgggaaagaattaggtttagatgagatcataagaatgagtccttcttgatgagattagtgcccttatatgaaccagagaccactctgtctctcttcaccatgtgtggatacagctagaaacgaaccatctgcaagccagaaaaagagccctcaccagaacccaactattctggcaccctgatcttggaattcacagcctccagattgtgagaaataaatttttgtcacataagctgctcaggctatggaattttataatagtaaaggagaaaactaagatattaaaaaaattgataaattggacttcatcaaaattaaaagtatttgatcatcaaaagtcactgttaagcaaatgaatttcaaatcacaggctggataagaatatttgcagaaacatatttaataaaggacctgtattcagaataaagcaaacaaaccaatttaaaatcagtaaaagagttgatgaaacacttcacaaagaagagatacagatggctagaaagtgtatgaaaaaatgttcaacatcattgttattaaggtaatgtaaattacaactacaaagagatactactacatacccactagagtggtgaagattaaaaaatgttggcttggcaaggaagcggaataactggaactctcatacactgttagaaggaagataaaaatggtataaccattttggaaaacagcttggcaatttcttaaacatatgtctacctcacaacccagcctttttactcttagacattttcccaagagaaatgaaatcaattgtccatataaagacttgtatgagaatatacatagtagattttttaaaatttctacaaactggaaacaatccaaatgtccatttataggtgagtatataacaaaaattggggatgtctacacaatagaatactactcatcaataaaaaagaaaatactcttaacacatgcaacatgaatgaaaatcaatatcaatatgctgagtaaaataagccagatgaaaaagagaaggatgttatttatttaaaattctagaaaatgctaacaaaatctatagtgactgaaagcagattatgttttctgggcacttggatgaaggaagggatagattagcaacaggctggagaaacttttactgggtgatagacacattagttcctttttttttttttttttttttcacaggatatgcctctgtcacccaggttggagtgcagtggcacaatctcagctcactgcactctctcaagtgatcctcaagtaatcctcctacctcagcctcccgagtagctgggacaacaggcacgtgccaccatgcatggctaatttttgtattttttatagagatggagtttcaccacattgcccaggctggtctcgaactcttgggctcaagtgatcctccagcctcagcttcccaaagacctgaggttacaggcgtgagccaccgtgcctggccttaatgttcattatcttgtcagtggtgatggtttcaccaatgcatatatgtgtgaaaatttatcaaactgtatactttaaatatgagtggtttattgttcatcatatctcaatgaatctgtaaacaaatgtgttaatattaccaattatcatttcaaactgaacgctagtgtaagctgtattatttcaatggtatttctattttgagagaataagaaaaagattataagcagaatattttcaacaattaaaaaggcaagaacaatgtttcattcaaaatgagtaagtagaagagaagaaaatattctcacaattcattttttaaatgttgaagtggttatactctgcagagttgaaggtttgttcttttttttctcagtaggttatatcggttacaaacaagaatgtcaaagatataatagagattacgataggggaaatttatatccaagcaccaaacaaagggctgaaaattgcattcatttttccattttcctttaaaatactcaggcttatgcaaagttgtacaaagtgaaaattcattataatcaaccacttaatcctgatggtacatgcctaagaaatatctgacttgctcttttgtgaggaactgattttttttttttgaaactggaaacatctttctttttctccatatatatgattttttttcacttttgttccatttatttgctattttccaaaacttaattagagtatttctcaaaaaatcctaccatttgtagaatcccaagatttacctttgctatattcctgattagagtcaggtttaaaaaatgttttcaccatatatttgtatagtggagaaatgaaatgatatctggcaagagtcgtttttatgtatatttatttgtctagttagcacatataaacagagatcctatactatacatcattgcaaccccacagtacttaccacaataaataaatatatcaatctgtaatctgtaaaagagattggttaatgtaaaacccaaatggcttttaatattaaataattactgtactattaaaagttgattcttaacttttaataataaaaatgtgtattaaagcagaaaactaataatgaatgaataataaatatctgtcaggactgtttaaagtttgtaattccccaatattcccatgcattcattagttttctagtggtacaaatcaatttagtaaaataaaattatgtaaggcatagttatatcttttttattttacaaatatttccccatattctatcctttaactcaagtgaaatccaatttagtgggatcaaagtcatctatagaaaatcctaaaattatgatttgacgtttctttaaaacagcattatgtcaataataaaaactttgtttaattaagtgaaaagtaaaactgaaatttctagtttcttaggaactgaattatctgtcatatactaacataatataagcatgttacacagatacatttcagtgactgaattatctgtcatatactaacataatataagcatgttacacagatacatttcagtgttcatacaattagattggagtcaaaactcatttatttaaataattgtttttctctgtagtgttccatatgcattgctgatttagtgtttgctgtaaggacagtttccatatcctaaaactagaagcttagattaagtagtctctgcatttcttttgagttctagcatacttttattaaatttgatattgatatatttattgtgctatccaaaaatattgcactcaatattgattcattgtagtaaactgagatatcttaaatgggacaaatgttctttgtatgaatcctgagacactctctctcagaacttgctgcacaaatttgataccttattgtctgatgatggtctcttagcactgagccaagaaagacttgggttttcacatttttgtatcttttgagatgtctctttatataatttttattaaaaaacaaatcctggagtctgtaagacacaatttcttttgcctaggaaaaattaccaagtcacatgtgatattttgtgtgggaattttttgataacatttccatctgcctctcagaataaagagggcttttaagcatgactcatgaaaatgtttatatttgagtaaggttgattctgtttgttcttgctctttattaacttagaggtttattttattttacattcaatataccaagttctttcagaaaacaactgcttctaaaatgtctaacttaattttgtttgtcccaacctgctgtgagaactaagccttttgtttctacatgccaagaattagaatgagtggtagtagaatattaaaagttatgtcaatttaaaaatattttatagagtttcctctatgtgccaggcattgtgaaggggatagggtacattgtaaaatataaaagacttagtcattattttcagtttagtgggacaaagactgatacttaaaaataattttaagtgcgattaatactaaaaatgaaaaacagaatgtgttttttggagactataataagacacctaatgcagccttcaaggaaagatttccagaggcggtgaactttgaatgagacctgtggctaagtaggaggtgggaactggggcagcataaccaatgtgtgcaagtggttccattggagctgagagaattctaggatgcgtggtgggaatggagagagaggtgttttaggagtagtactagataaagctgaaagacaggaaagaacatgccatgatttggtgtaaaaggcatgtatatagctatgatgacaaaagatgtccatttctccaatgcaggcaaaagaacactcctcccttttcatgtatgcaggtttcccaattttcccctgaagacaagggtcagtatttattaaagtaggggaatcatagaacattggagctgaaagagacttttttaaaacaaaaatttaatttttcatttttatgggtacatggtagggatataaatttatggataaatgagatattttgatacaggcctacagtgtataataagtgcatcagggtaagtggggtatccatcacttcaaacatttgtcatttctttgtgttaacaaacattccaataaaactcttttaattattttaaaatgtacattaaattatttttcactgtagtcaccctgttctgctattaaatacaagatcttattcattcaatctaactgtatttttgtatccagtcaccaccacatacctcctctcccgaccaccccactttcattcccagcctctggttaccatcattctactctctatctccatgagttcaactgttcaatttttagcttccacaaatgagtgagaatgtgtgaagtttgtctttctgtgcctggcttatttcactttacatgttgtcctccagttccatctatgttgttccaaatgacaggagctcaccttttatctggctgaataatactccattgtgtatatgcagcacagtttttttatcccttcatctgttgatgaacacttaggttgattccaaatgttggctattgtgaatagtgctgcgacaaatatgggagtgcagatatatcttaaataacctgattttctttcttttgggtacatacctagcagtattttgaggtacctccatactgttctccatagtaataatttacattctcaccaacagtgtatgagagttctcttttctccacatccttgccagaattcaccattcactattgcctgttttttggataaaatttggaagaaattcatttttatatcatttgacccagcaatcccattactgggtagatgctaaaaggaatataaatcattctactataaagacacatgcacacatatgtttcttgcaacactattcacaatagcaaagacttggaaccaacccaaatgcccatcaatgatagactggattaagaaaatgtggcacatattcaccatggaatactatgcagccacaaaaaaggatgagttcatgtcctttgcagggacctggatgaagctggaaaccattattctcagccaactaacacaggaacagaaaaccaaacactgcatgttctcactcataagtgggagttgaacaacgagagcacatggacatagggaggacatcacacaccagggcctgtcgggaggtgaggggctagggagggataacattaggagaaatacctaatgtagattttgggtttatgcatgcagcaaaccaccatgacacgtgtatgcctatgtaacaaacctgaacattctgcacatgtatcccagaacttagagtataataataaaaaaagtcttttttatcagagtgacatgatatctcactgtagctttgatttgcatttctctaataatcaatgatgttgagcaccttatcatatacatgttttccatttgcatgtcttcttttgagaaatatctattcagattagatctttgcccattttttattcagattattggttttttttttcctattgagttgtatatatattctagttgttaagcctttgtcaaatagatagtttgcaaatattttctcccattttgtgtgttttctcttcaccctgcctcctttgccacagcaaaagcttttaaacttgacataatttcatttgtccctttttgctttggctgcctgtgcttttggggtaataaataagaaatgtttgcccagaccaatgtcctgagagtttccccagtgtttccttttagtagtttcaggtcttaaatttaagcctttaattcattttgatctggttttatgcctatggcaagagataagggtctagcttccttcttctgcatatgaacatcaggttttctcagcaccatttatccaagagactgtcctttccccagtgtatgttcttggcatctttgttgaaaatgagttcattgcaaatgtatggatttatttctgggttcttgattctgttttcttggtctgtgtgtctgtttttattgccactaccatgctgttttggttactatagctctgtagtataatttgaagtcaagtaatgtgattcctctagatttgttctttttgctcaggatggctttggcaattctgggtcttttgtggttccatatacattttaggattattttttctttttctgtgaagaatgtcattggtattttgatagggattgcattaaatctgcagattgctttatagacatgttaataatactgattattctaatccataaatgtaatatatctttcctttttttcctgttcttttaaatgtcttgcgtaaatgttttataattttcattgtagagatctttcacttctttgattaaatttattcctaggtattttattttatttgtagctatcataaatgggattactgtcttaattgctttttcagattgttcacttgtcttgattgctttttcagattgttggcagatagaaatgctactgatttttgcctgttgattttattatcctgaaactttgctgaattttaaaatcagttctaacaggtttttggtagactctttagatttttccaaatataaatttatattgcatgtaaatgaagataatgtgacttctttctttccaacttggatgccctttatttctttcccttgtcttattgttccagctacaatttctggtactatgttgaataatagtggtgaaagtgggtatccttgacttgctccagatcttagaagaaatgctttcatttttttcctatttagtattatactacctgtgtgtctgttgtatatggcttttattctgttgatgtatgttccttctatactcatttttgtgggtttttatcatgaaaggatgttgaattttatcaaatgattgttcattgttaattgaaataactatatagatttgttcttcattctattaatatgctatatcacattaattggtatgcagatgttgaaccatctttgcatccctgagatgaatgccacttggtcataatgaatgatctctttaatgcattgttgaattaggtttgggagtattttgttgaggatttttacatcaatgttcatcaaacatattggcctatagctttctttttctgatgtgtctttgtctcgttttgatatcaggatactattgtccttgtagaatgagtttggacatataccctcatcctctattttttggactactttgagtaagattagtatttgctcttctttaaatatttggtaaaatcaactgaatccattgggtcccaagtttttctttgctggaagacattttattatggccacaatctcattacttgttattggtgtattaaggttttggatttctttatgtttcaatgttggtaggttgtatgtgtctagtaattgattcatttcttttaggttttccagtttcttggcatatagttgctcacagtagcatctaatgatcctttgaatttctgtggtatcagttgtaatatctccttttccatctctgattttattcgtttgagtcatctctttttgtatcttagtatgacataaggtttgtttattttgcttctttttgaaacacaaattttcattttgttgaacttttgtattttttttgtttcaattttctttatttctgctctgatctctattgtttctacgaattttaggtttggtttgctcttgcttttctagttattaagatttatcattagattgtttatttgaagtttttttactcttttgatgtaggagcttattgctataaactttccttttagtactgctattgctgtatctaataggttttggtatgttatgtttccattatcatttgtttcaagacattttaaaatttccttcttaatttcattattgatccactggtcattcaggagcatattgcttaattatcatgtatttatcctcttgttatctatttctagttttattctatctgcaaatatctattaggaccatttggcttatcctgctaattaagtccagtgtttctttgttgattttctatctggataacttgtctgatgctgaaacttgaatgctaaatctccagctataattgtattagaatctatctctttctttagcactaatatttgctttatatatttgagtgctctggtgttgagtacatatatatgtatagttttatatcctcttgctggattgacccctttatcaacatgtattgaccttctttgtctctttttatgttttttttttgtcttgaaatctattttatctgatataagtatagccactcctgcttttttcttgtttccttttgcatggaatatctttttccatccatgtattttcagtccatgtgtatctttgtaagtgaagtgtgtttcttctaggcagcagatatttaggactttttaaaaatccatttagtcactctatgtctcttgattggagagtttagcccatttacacacaatgttattattgataagtaagaattcactaccttcattttgttatttttctagttgttttataatcttccctccgtccttccctccctccctcccttcctccctccctccctcccttctctcccttccttccttccttccttccttccttccttccttccttccttccttccttccttccctccctccctccttccttccttccttccttccttcgtttatgtgctggtgattttctctgatggtatgttttaattcttggctttctatttttttgtgtatctgttgtagtttttgttaccatgagatgtggaaataatatcttatagcccatgattttaaactattaacagcacttattgcaaaacaaattaacaagcagaaagaaaactgataaaaactctactctttatcccccacattttaaaaatttttattatgtctgtttatgtcattatactacttcttggaatttgttgtagttattagttttgaaaggttcatattttagccttcccactaaaaacatgagtagtttacacgccacaattaccgtgtttttcttttttatctgtgtacttactattaccagtgaatgtcttacctttatataaatgcttatcacttattaacatttttttctttcagattgaagaacttccttaagcgtttcttataggacaggtctgatgttgacaaaatccctcagtttttgtttgtctgggaaagtatttgtttctccttcatgtttgaaggttattttcactgggtatactactatagattttttttttctttcagcactttaaatatgttatgtcactctttcccggcctgtaaggtttccactgaaaaatctgattccaggcatagtggagttccattgtatgctatttgtttcttttctctttctgctgttaaaatcctttctttatccttgacctttaggagtttgattattagatgccttgtggtattcttaattggattaaatatgcttgatgttttataaccttctagcacttgaatattgacatatttctctaggtttggaaaattctttgtttttatccctttgaatacattttctaccctgatctttctctctacctcctctttaaaggcaataactcttagattttcccatttgaggctattttgtagatcttttaggcatcctttattatttttattcttttttcttttgtctgctctgactctgtgttttcaaatggcctgtcttccaggtcactaattgtttcttctgtttgatcaattttgctgttgggagactgatgcattcttcagtatgtcaattgcctttttcagctccataatttctactttattactaaagatattttaatctatgtgttaatttttttttatttggtaggattctaattccttctctgtgttatcttgaatttcattgagcttcctaaaacagctattttgaattctttgtttgaatatctttcactacaggattggtcactggtcctttctttagttcatttggtaagatgatgttttcctgaatggtcttgatgtttgtggatgttcgtagatgcctgggcattgaagagttaggtatttattgcaatcttcacagtctgggcttgtttgtatttgtccttcttgagaagactttccaagtaatcaaaaagcattgagtattgtgattaagtattttgtgactactgccatatccgcattaaggggcaccccaagcccagtaacgctataaatcttgcagtcttatggagatactgccttagtggtcttaggtaagattcaggagacttccctggattaccaggcagagtcacttgttctcttcacttactttcctcccaacagagtctctctgtctttatgctgagctgcctgcagttggtggagggatgacacaagtactcctgtggtcagcaccactggggctatgttgggtcacagctgaagccatcacagtactggctgtctccgaaggcctgtggcaactattgcctgtctactgctggtgtttattcaaggtccaagtgctctttagttagcagatgatgaatcctaccagactagtgccattctcttccaggtggttggtttctttctggtccaaggtgaatctagaaatgttgtctgtgagctagcatctggagttatgaattttagttatttattgggtgccttattttactgtagctgagttggtacccaagttgcaagacaaagttctttttactttttcctcttttttcctcaagtagaaggagtctcacctcatggccatccctgttctacaaccatggtaagtactgccgggctaccactaatgtttatttaaggcccaaagactctttagtcagattatgcagaatccttccaggcctgggtcttttccttcagagaagtgctttccttctggccagggcaggtctataaatacctggaatcagggactttaggagtctgcttgttgatttattttactatggctgagctggatgcaagacaaatcctctactctatcctctcctttcctcaagcagcaacagactctcctggagctgcattgcctggagttaggggtgggtgacagaagctctcctttaactgccccagctggtgtctcactaggttgtatgaacctcatattcactggctctgagcccagcacagcaccaggatttgtcaaggaattccagtcctcatggcttagactgctttttaaatttatttagagcccagaccactttcgcctatggtagtagggctagtccaaactcagattcccactgctgtgatagacaattcccttctggccaggattggtctaaatgtttcctccatggacaccagctgaattctgccctatgttgctttccactctgacagggcaacactgagttcctatgcaaagtcacgcaattgttgtgttctccctactccaagcacacagattctgtgtgccccactgctgctggacgatgtgggaggtgtggtgtaggcagtgcaaggctgtctttacttcccccttcagtgtctctttccttgacatgatattaaaagcaggtactgtggttgctcacctgatttttggttcttacagaagtgctttcttgtgtggatagatgttcaatttgatgattttgtgtgtcagatgttgacggtcactggaggattctattcagctgccttactttgccctttcaatctggtagagatgattagataattttattgaatatattcatttcctttaagataaggaaattgagactcaaaaagattgtttgacttctcttatagttcctataagtagtgcctgagccaatggggaactatacactattgtatctgagaatgccactttatattgtactatattgcttcacactttgcgtttctacatggcgccagggtatatgtaattgtcacattgacaaatacatttgcgttactgtataagaactttgtcaaataatctataatcaccacaattcctatgaaaagaatgtgttttcccctcaatgtcaataatcatttaattttaaatatgatatagtggtgattatttattatatctaattggggaagaaattctaaatcaaagaaaaatattaattcaagtggaagaaacattagtgaaatattagtaaaatggtattccttatttactgtaagtagaagataaaataggatatatgtgtgacatttaggtttacagaatttgattttttaacagcagaggagatcagagttcttcatttgattaaataaaatcccaatgtgatttttgctttttgcttatctcacatgagaaagaaatcttgataattttcattcagaattttagaataaaatttagaatttagaattttagaatagggctgatctgactacatgcaaagaggtacttatttatatgaataagtcattttctaaatatggcattgcatcatttgatggacactttgatggtgctgaccatcccaaattcaatagcttaacacaactatttttttcacaactctgtgatgggctgaagatggctgaattttgaatttaaaggctgaattttgacccatgaattattcattctccttggtccagtaggcaaagccatgcatggtctttttctgacaagggaaaaaagttcataggctaaaattttaattgtacaactatttttaaagctctacttgcatttttttcctaaaatctattggttaaatcaaacacattgtcaagctcagatttaagggacaggaaagtagattctgtcctcaaatatgagggaagagggtgaatcttttaaaataataatatagtttgccacaaagattaacccacatattaatgaaaaactttgagctactgctgaggtcaatgttaaatacatatacacacacacacacacgcaaacacacacacacacacatctttgcaaaatacagtgtcaagataatgagaagacaagttacagactaatagaaaatctttgcaaagacacatcttataaaaaactgctatccaaaatacaaaatgagtgcctaaaattcaacaataagaaaatgaccaaccttatttaaaaaaatgggcaaattatatgaacagactggaaaaagatacacagatggcaattaaacatatgaaaatatgttcaacatcatatgtcattagggaattgcaaattaaaacaatgagatagtactagctacctattaaaatggcccagatccaggacactgatggcaacaaatcttggtgatgatgtggagcaatagaaattctgtttcattgctggtggaaatgcaaaatggtatagccattttgagagatagtttggtagtttcttacaaaactaaacatactcttaccataaaatccagcagtcatgctccttgaaatttacgcaaatgaactcaaaacttatgtccacacaaatacctgcaaatggaggtttacagcagctttatccatatttgtcaatttggaagcaaccagaatgtctttcagtaggtgaatggataaataaactatggcgctaaaaagaaatgatctatcaagccatgaaaagacatggaggatacttagaagcattttactaagtgaaagaaatcaatctgagaagtctacatactatatgatttcaactatatgatgttctggaaaaggcaattgagacaataaaattatcagtggtttccagggattaggtgggagcgagagagattaagcagagcaaagaggatttttaggtcagtaaagctatgatacataatatgacaatagtagatacatgccatcatacttttcaaaacccacagaatatacaacaccaagcctgaattctaatgtgaactacggactttgggtgataatgatgtgtcagtgtagtttcattaattttaacgaatgtaccatagtagtgtgggatgttggtagttggggaggttgtacgtgaaggagggcagggagtatatgaaaactctgtacttcctgtttaattttgctgcgaacacaaaactgctctaaaaacaaagattattgattttttaaaaaagtagtcattactacttccaaagttgtccacaaatatttataaaatgttttattttgtgttagtagaagcattggaaagcttaaggtggctgttctcactgatatatttaatatgattttctgatttagtctactactcaatttccatggcaatgttttaggttaaaaaaaagtatcagggcatcagtaagcaacatattctggccagtgctctcaagtgtcattcatgtttatttcagctttcacaacattgcagactacattaaatatatgttggaggcaaactttgactcaaactgacttgaaaaactcattcaaaataataatgtcttcattttctgcttgatatatccctagtagcgataaggaaatggaatattgtctctgtcttttaattcagtcgtggtcaccaagtcatggcattttcaaagcaattcctcaaatagaagaaaatgcattttttgtttctttgaggaacaatagaaactcaaattgaattatctttgtataaatatcttggcttacaccttttaaaataatcgtgtttgaacatactggcaattgttatggttcataaataatatcatcaacaactaatacttattaagaagtatctgcatttaaagctgttagatacattaaataggcatcctaaacaggatgaaaatgccttatacaaatagaaaaattcaaacaacacaagctataaaatagagtataaaatacaaccaatatttatttacattaaacatactacttttctttccgtggtttgtgttctgtgaaattatgtgggagaaaaatttcatattgcttttacttaaatgaaagaaccagacaaagcctggaaagtttgctgaattttatcaataacacgtatttgtaaatatattgtgtgcttattatttttgcttgtctttcatttttgggcacagcatctccaaattttggtcacaaatgatgcataaccctccagaaatacagcttaaaagaagaaaatgaagatggaaaaataacatactaaaaaatgtacaaaagcttttcccatgcttaatcattctatccagagccacatttatgtttcggatccttttacagcagaggttgggaggtcaataaaaatatatgatgagatttaaaataaattaaattgtatatttattgttaatctttacacacgagtgaatcaactaaaattccttacccaaggatgtgtttctcaaacagccttgatatagaattaacatatagaaacttctgagggaaatgtaaggaaacaatataatggtcattgctttagaactaaaagacaattttaaaaattaattcaaatattcattagcatccaggaatatgtaataggatttttggtcaagctcacactacctcaaacttgctgctcacaatatgtcttaaggcaatttttccaacccttttagatctgaaaatagaagattaatgttcaagaaaatggagaattgcaagacaccatagaaaatatgagatttgaaaatctgaccttagtctagaagacaggatttagacagcagcataccaaaagtaaatgaaagaaagtaaattatatctttttgacacttcaaattcttgttgcctaaatcttagtcaagttgaagcttataagatgatgatgtattttcgtaagaaaaataatttggtggattatttagtaggaaaatttatgaagataataaaaaaactgagaaatatgattcaataatggggtaaaatacaataataattttaaaaagcaacattgggtaagaaccttattttgttgtatccactgaatttcctttcacaatgtaaattattatggttattgtgcatatacaggtgatacggctgttatgtttcccatggtttaaataaggagtcaataggaaaatgtaaatgaggctctatcattttctaaaagataagctgtcctctgaaaaatctattttctccttatgtggcttacttgcaattgtcaggaatgagacagatcctaacatttttttgggcaccttttatatatcaagtatcatgctagaagttgtaaatgtgctgtcttagttgtaatcctacaaaatactgacctaattattgtaaaactacagcaaataaaggtaactttctatatatagataaaaggtattagtttttatgattcagatttagaatactattgtgaaaattagcacattttctaaatatgtatattttatgcaaagatggaagatagttaaaacacacaatgggtgcttaggaaatacaaatatattgctttgtgaattaactagattggcaaagtgggttaagtagatccatgacagtgagactcacttttatttttagtttgtcacatcttacatttaaataatcatatgactttgaggcccactcagttgtgaataataattgatttattttgcctgcttgtaactagaaagtctgtgtaaattttcaagtatgttaatttattcaccaaaatattttttgctacgatttaaaataaaagaagaatgattacaacttgacttactaaaaaacgaaacttaatttataaattattgtatataatataagtaacaaggaattcaaaatgataaaagcttgattcagtgatatttaaatcacaatttatgtgattcattcaactaacatttattaaatacttctagtttttggatttatgctatgacagatgctatatgcttgagttcttcttttaaggcagtttctgccttgttagacaagaggtagacatggatatgaacaaataaaaatgtatacccattaacataataatagaagttttagtacaagtttctattatgataatatatcatataataatattatattatgatggtagtgcattggagaaagccctgtaattaatttgacaaagggacaaggtatcagggcagtcttcagatgagaggtgatatcaggtcagcaaagtgggggcatataagtggtgggcatcttacactgcataaaaagcagtgtataatcctgaaagcctggctccaaaggcctatctataagtacttattatttctgaagcataatggtaacaaggagggagcaccagcagatgagattaaaaatgtggctttagaccttaggaagtcatcagaggaatttaagcaatcagttgtattatatgatttatatttggatatgattattctgtaaattgtatagacagtgaatcaaaggtgaaatgtgaattaagaggctactgcaattatacagaaaagatagaagcccttacccaagatattgacagttggggttttaaagccaatagaatctgaagacctttaaaagacaaaatgaattgtctctaatgcccaaacaggtgtgaaagtagcattgaagtataggggataatcaaagataacatacagctttcttctttagtgactgggtgaacagctgctatgacattacaaaaatataatgtaaagagggaagataaggtgtgaagtagaaaaataaagtagatttcgactcagtgcatataatttcaccgtgaggcataaaattggagctgttaatttgcagctggaactcaagaaagagatttgggctctttatatggaaaacctgggaataaagtacggaaaattctcacaggaagatttgagaaacaagtaggtactatcagctaaaaggtggatgtccgtatgttgtgtagataagttccacaattcagaggtgtgttacatatctgaaatataaattttgatagatttggtggcaattaggtaactgaaaactcaacagtgcacccaggtgtcagtgagaaaattataaggcatcatttcaaggttgtagatggagagaataatcatgagcagggataggcatgtcgtcatgtaccagaagttaatgtgtcaggatgaatttgatgcagataaatttatagagaaagaaccaaaaaaagtatgagtttccatagctgatatgttctcttttatttgaattaagaaacaaggtgtgcttaaaacatttaaaacaagaggacaagtaggtgaagacagtaccaagatggaggtagttgctctagcctcacaatgcctcaggtccaaatgtagattggaaaactatatcttgctttcctaaaagctcacgcagagttcccctatgttactatttttttgttacattctttctactttggcaggaaatataatatttatatacttttcgtctatttataaccccacctattatttcatcttcattctaaaattaaaatataaatttctcactatcggttaatttgccaaaactttcccagtcctctcttggttgaataaagctctaaaaaatctggtagattccttagaagagcacatgtgtacaattcctttagttcttcaggttcaaagcttttttctgtagtctattcactcaaaggaaagcttagggcactcttacttccttaagtttcttaaaaatactccttcactgttgtcttgctgtacatgttgctttggaaagttgagatacctttctaattctcatgctttttgtgtgttatttcaacttattacctggaggctcttaatattttttcttttaattttctgtaacaaaaagatttattagaatttgtctcagagtgattgtaccaggtcaatgttcttcagtacccagtaatccctttcaagtctagactggagacttctttattgttgaaaacttttatagattatacttgtaaataatagttctgtttcatcatttttacttgctttttcaaggatactaaatcaacttatttatttctcttccatgtcagctactttctctctgatccattttgtttattctttatttcatttttattctgttagcattttttcctgtttttgaacgggtgggttgcccctccacacctgtaagcgtttctcgtcaggtggaatgagagacttggaaaagaaagagacacagagacaaagtatagagatagaaaaatgggcccaggggactgggactcagcatgtggaggacctgtgctgggaccggcctctgagttcccttagtatttattgatcattatcgggcgtttccaggagagggggatgtggcaggacaataggataatagtgaagagaaggtcagcaggtaaacatgtgaacaaatgtctctgcatcataaacaaggtaaagaaaaaagtgctgtgcttttgatgtgcatatacataaacatctcaatgcattaaagagcagtattgctgccagcatgtcccacctccagccctaaggcggttttcccctatctcagtagatggaatatacaatcgggctttacagggagacattccattgcccaaggactagcaggagacagatgccttcctcttatctccactacaaagaggcgttccttcctcttttactaatcctcctcagcacagaccctttacaggtgtagggctgggggaacttcaggtctttcccttcccacgaggccatatttcagactatcacatggggagaaaccttggacaatacctggctttcctaggcagaggtccctgcggccttccgcagtgttttgtgtctctgcgtacttgagattagggagtggtgatgactgttaacaagcatgctgccttcaagcatttgtttaacaaagcacaccctgcacagcccttaatcgatttaaccctgagttgacacagcacatgtcttagggatcacagggttcggggtagggttacagattaatagcatctcaaggcagaagaatttttcttagtacagaacaaaatggagtctcttatgtctacttctttctacacagacacagtaacaatctgatctctctttcttttccccacagtttttagtcaatgccctttattaaattttcatttgaaaccttctaccttgagccccttataatttatctttatttctgatatgactttgtcattttttctgtatctttcctgagttaattcattttttgtttcattaaaatctgttttatgtccatttataattctagtatttatatttctgattcaaggaagtttttatatcttcaattgtgtgtttgagtatatttgatttactgtattcggttgctttcagggggaaaattgttttcctcagaaatgcgtcgtttccatttctgatttaccacaatattgttgtgtagatgtgattgacttttttctattcctattcatttcatgaacaatgtttatggtttaagaatgccctcttctgtactcttctctacaatttattttatagattgtgttggtatggataagacacattgttgtttccttcttgtttctttgggattcttcatttatttttttgttgtggttcttatttttattgtgagggagatacatacgtatagagaaagagtagcactcattagaaattaattattgctctctgagactgctactttcaatcccaaacactttacttttttttctttttctttttctttttttgagacagagtctcactctgtcacccaggctggagtgcgttggcacgatcttggctcactgcaacctccacctcctggtttcaagtgatttatgtgcctcagcctcccaagtagctggaattacaggtatttgccaccatgtctggctaatttttgtaattttagtagagatagagttttgccacattggccaggcttatttcgaactcctggcctcaagtgaatgcccaccttgacctcccaaatttctgggattataggcgtaaaccaccacactctgcccccacacactttaaaactcctcatttaatcagtgctgtgaactaccaagtgtgtttggtactttaacattgaatgtttgactttctccttgcaggtggactctgtgggaatttttctttttctctatttccagacaagtaagagtatagcattctctttttccaattaatgttgaaggtatatgtcatgcatgtatggttttattttcatccttgattttatttatagatttttagagggagtgtggaggaaatttggaaacaggcaaccaccatttttttccagacattattatacaatcttgacattagaattgacatacagcttagaactcatcagtttgaaaatcctagtttacagatgaagaagtgggaggccaggaaaattaagtgaatagatcagagtcaaatagctgttataggtaaaatctgactaaatggttttcttattacaagtctcattcttttctcaaaaattgatgtcagtatgtagaaatataatgtatgttattatattatatagataagcaatgcttttgtatattaaatttaaatcaatatttttagttttcattatgatccttaaaataatgaatgatcaagatcgtaattgagtaacaatcataatagagatattggaactgatgagattaatattttcagtacattttacaatgaggcaacacccaatgaacttgaaatgtggttgtcttagtccgttctgtactgttgtaacagaatacctgagaatgggtattttatttaaaaaaaagaaatgtatttctcacagttctgaggctgagaagtctaaccaaggcattggtaggtttggtgtctagtgggaataaagtatctgtttccaagatggtgccttgaacgcttcatcctctgaaggggaggaatgctgttcctcatatggcagaaggtggaagggtcaagaaaaagagcccacttcatgagcttttttacacaggcattaaacccacctttaccctttaaaggtcctacctcctcataccattacattggcaattaaattttaacatgaattctggaggtggacaaacattcaaaacatagcaacagtttacttgatggagccaacgagttgtatgagctttttttaatttttcatgtacttgaaataaaagaagattaataagacagaccactttgtatttcaagatatttgcaataatttgaaagctaaaattgtgcttttgtgttgatttattattaataaaactgtctatctttaacatacaacttgcttttagtagaaatctaatttaattttggttcattgtagtgttcagttacacatgagagtaatatatttacactattgtacattaattttaggttgtcactgccatagattccctttattttagtaatatgtatgtgtgtgaaaaaatattttataattttttcaacttaaataaatgttcaatggattgtgggaaaatatgggatttttaattataactctgatggtagccaaaagaaaaaatcttttatgtactctcaataaatcaaatgatgattcattacaagacaaccaaaatatctaattaaataaaatatttctaaaagtgtaattattgaggtgcaacttattaaaaatattattagccaattatgtccagtgaaggttacaggcctacaatgtccacaaatatgatattcaaatcttttctaatattttcatggtattcataagatttaaaattcagcactttgtttttaattgatggtgcaaatgtgaaatttaaaatgtaattaccttttacatatccctgaaatgtggctaatatcaaaatgtttccatagaccagcaaagtggatctcatggccttaacagtgtctggaagggacggtggtagacaagctcacagagttagtagcaaagataggagcatccctgtatagatcatgcaggtcttagaagtgtttggattttaccctgaattcagaagtcattggagggttttgagcagaaaagtgattatgtgttttatattttccagagatcactctggctgatatattgagaatatatcataagaaggcaagcacaaaaacagagagagtagttaggtgatgttccaagaatctaggtgagagatcattccatattagagcaaggtggtaagagtcagaagagctaagaatgtgagaagagtaggttcagggaaaaacaattcaaaaattatgttttacatgtataaactttgaaatgcccatttatatccaaataagcaagcatatggagtaggtaattggatatgtgaataaatagctgaacattgaggttgccacagatgatctattgtgccaaatgctactgagaaatcaagaaagatgaagactgaaaactgactactgatttaacagaataggtgaccttgacaaagcctgatgggaatggctttatgaatggttggtgaaagaggagttacccataataaacacagacaaccctgtaaaagaattggagggaaacatggggcaaaggaattttgttttgttttgttttgttttgtcttttgtatgaaagatattcagcaagttctcatgttgatgtggaaagtctagtccactactactcaaagtactgttctacaagctgtacgtgagcagtccaccaggagacaatgagtttgtgccagaatgtaactcagtgcactatttctttcatttacaaagcttcactctaaaaatgtgtcaggacaataaaacactgtgtttaaggacatcattgatttacattctggaagaagtccttattttgtaggagattataacagacatatggtgagctttacttttagtctcatcaaagaagttgaaggaataaaattgtttaagcaatagggaaaaaggacaggtataaaaagtgaaagcaacatagccctcattagtaaatcttcactgttttttagtttttacgaactctcaccacacccaggttttctgtgccattcgttgcctgccaggatcctgactgacatatttattaaatctttattaatgcctctggatatcaaactctcctgctattatgcatatactgtttatttatatttatatatatttatattatgcatatttatgtggctttgtaaatcatctgagttttgattaaaagaaagaagaacataaactatatgtcaaattcattgcaaaacactagatagtcatagctgtcctttaaattcacctgaagtactttaaaaatatatcctacccagcagataatttgattgtattcatctaaattgggcccagagattaatattcttgtttccctagggtattctaatgtacagccagacttggaaactactttgctaagaattcagagatataaaaggcttgctcaatgaactcaaggaattaacattctagcagagggaaaggggcttgtaaataaatagcttcattcaatgggtgttaaacagcaaggtcatttatgagggtatttaaaattgatattaatgataaaattaggagtagatacataagtggataatcatatacagaagagttggacatcttcaaggaaactatacccttggacattattaaaaataataataatagctatacttacaattcagttagtaggtatgaaatatgagtctagtgctttgcttatattaatttatttaaactccaaacaatcctactggggtaggtattattactcactagttttacatgtgaggaaactgaggcatagagaggttaagtaacttgtacttggatgtataactagtaagccaaggtttggttccaggccatatggtttcagtgtccatgttcaaaacttgagtctatttcttgctaataaattgtcggtaattttccaacctgcctaggtatcatcctatatcttggttctgttaaacttgatttattgtcctagtttatgttgctccacactaccttcatgcttctctgctcaaattaaccactgtctctctccaagtagcccaatgtcaaattattgtaatattgtttctgaggcatttttctgtaaatctttgtaaactcaatttgcttctctactttccttttctattgtcttcatgtacagcttcataatctctacttttcatcattgttttcctatattattactccttacttcatttttacttcaggaatcccaaaatttactatagaaaacaattatcagtgattactctaccatttatagtacatttctacaagctaaaccctgatgcatagtcagttattgttgagttccctttgtctttctaaaagtcttacaagctaagtcactatttatattttgtagttgtttcagaggtttgctatcctgctcaagattgcaaatctagtaagtggttgagcagggatttaaaccccccatttctaattccagagttcttaatgatcacagtttgctgtgccaatagaaagactgatctccaaagttggaacataagttctgtttctctgctgctgcttctcctttttcattaacttgccccctggtcatagcaaagtggccaactatcaaaggaaatcagcctttctacccctgggctatgaagtgcagcagaaatgctttctcagggttttgcttttaccgtttattgtccactgaattatagttacattgctagtaaagatgctgattgttaaaaattgacagcatagccctcattagtaaatcttctcaggtatgagttgctgagacatctttatctatagcagtaactttttgctactttataaatatatgtattttttcattatcaaatatataacttaacaaattcaagtgcttagaaaatataaaaataaagaaagacacagcaaattatgagagagagattaatttctgttcctggatttagagagaggtctctgttcactctaagtgctacatctgacattccaacttctgaccaaaaaaaaaaatatattccaagaatatctcttcttcttctggacaatttaattaccattaattttttcagtatggagaaacatggattagatttaaatcaggtaggttaaattttttgaagttactttgtttaatgtatgtgattatattttttccctcaaaaagtaaatctgtatccaactcctctccacctgtggagagtagagagaagtgagaccttttcttcaatacaatcattgatcctgtagaaattttttccttcattggaaactcagtgagggaaaggctaaaggaagtgagagcagtatggggaaggttagctctgaggcataaaagaaactaaacactttagggaaaagttagtggtccaaatcatcaggtcttacaggcaatggaaaactctagtctctccactaattaccatccaaaattattatatattagagtcaggtgaagcatgcaatattccttgatgttcaacgagcatctgaaaaatatacctaggagatctttccgagtagaaatacaggaccgcagagttgcaatccagatgcaaagaaaggagctggcttgaactaacaaatgttttccaatgaaaaattgaaaaacaattgagactgaggacatgggaaaaaattctagcaaataagaacttagccatggtaaggcttttgaaaatgtttattaagtgaagaatgaatagtcaagaaacatattgaacatgagtggtagaaattaggttaggaagctgcagcctgacactcatatagaaaacgatgtaatcacctcctgcacgctggattatactgtcttattatttcactgttcatgaaacagtgtcccgaatcaggtacttaataaaagaattcagtcgcacacattcaaccacctaatgatgatattcatcttggcatcatcctatatccctcccttgttttagttcctgcattgactctcactaattccttcttccaccagcccttccgtatttctcaaatccaaattcagcctcttattggtagtttttttcagccaaatcctcaagacctcatcattttttgcctgacaattaaaaatcatccctctgatttccctgtttttctcaaaaccatactttccattgctcacaataaaatctgaaatataattctgacctgttccttctcctttttacttttagtgactccccgtcatctgttgtgtaaaatctaatatctttataaaggtattaaaagctcttcatgatcagatcttatgacgctgtccaccttttttccttgtttttcctcttacctctcattcactatgtgcaccagaaatattttgtttcttgaatgagccatgctactttatatctcccttccttgcttgctttatatactaatcttttctctacatataatttgtaatcttcttctgatatcccctcaactcaaccatagccactacacttcccagagtctaaatgattactctaaacaaaattatttactaatctcatttgtaaagacaccttaactttcaaacttattaatgctaacagcaaaggttttgaaatttttttgaacatacaacatattaaaaaacaagttcaggaatacttaaaaaatgagtatgtatttacttactatgtatatagtaagttatattgactaatttttaacaatataataaaaactcttcataaaccatttcattgtaactgcttagccattacttttaagagaaataacaaatgaaaagtttttgaactgtgtacacttagccctcaagtttaccattgagcctaaacatgataaattgaattttaaaggcatatttgaaagacaccttttattttaaaggtgtggtaaaattagactcaattacttttagttaaaatgtaaattcaccgatgtttggaaataagtacttttttttttaaatcctgaaactcactgtttatttttctttactttgttctaattttggtatttttattaaaactccaaagaatcatatgttgattttaataagatcagaaacaagaagtttttaaatttttgcttaaaatgaaaatgctgttccctccactcattgaataaaacctttacatctctccccagtatgtaaatatagcaatggaagccatggatgtatttctaaaagacattttttcccactaaaatttccatttcttagttcatttcaacagtatagaaattgctgaaatgtcacttgtattaatcctgttggaagtggttcgttttaaaaaccatgtagaaaaagtaagatattatgttggaccactaataaattcattttgaagatataaaagtttaaaactttagggaaattcagtattttcagctacttataagttaggaagaaaaggcttaattggaattttttagatatggagctgccagcaagaaaaaaaaagctaaagaatttcatgtgttgctaggaaaatttgagaagcatctatgcttcatactcttgtccagagcccaatgtgtattcttgttacattttgaaagtaatttagtgcccacatgaaacagagggttatcctctataccaaaaattttgtttctgttcatttagaagcaaagctcaataaataaaataaaaaaaaattataatagcaaactccattttcttttaacacgaagtaactaacatataataatatagtttcataggaataaaaatagaagtagaagctcttattttttatctaggatgcattattttagcatctggatctgaatagttgtttaaaatgaaaatgttcaaatattcaaatattattcaatgttcaaatgttcaaatattatttgaataaaatggtgatgctattaaatttaaaataatctttgtggtactagtaaatatattaggataatttaaaaagtagaagcatttactatccatttatctaacaatattctataggagttttactctgtaatctatttcctttgcctctttcttgagctctgtaccaaattgttaatattttcatcaggttcaccacaaatttttaagcttaacttgtccaagtcaaatttgttacatgcacaacaagattttttcattttatcattttaataagtaattttttgagcagatgccaaagatttttatttttttaacttgacaaaatattagtatttatcatctacgacatgatatttgaaatatatgtacattgtggaatgaatgaatgtaggtaattaatatatatgttacctcacaatgttatcatttttgtggtgagaacactttaaatctactctcgtagcatttttctagaaatattgttaatacctatagtcatcaggtacaatacatcgcttgaactaattagttctatctgactaaaactttgcatcctttgaccaatatcttcccaacacaccatcgctaagatttcagcatctggttaccactatgctactctctgtttttatgagatcaacttttttagactccacatatgagtgatatcatgctgtattgtctttctgttatttctggcactatagccctctcactggtctctctatccctattatatgctttcttcctttcaaatttatctttatgaaacacaactttgattatgtaatttcctatgtcattaacagaaaccagccaaaattcaaacaaacaataacaacttgataactttaagtggtttatttcatgtaatctattctataataaagtacaaacttcttcgtatgccatattgtattttttacaatctgcccacctcttattttcagtgtgtttaccaagaaaatataaaacaacagagaatctggcaatttaattaaatagaagtcaggtaaagaggtctactaaatatctgttgcctagcttaaactatttaaaagcattgacaattcactgccatatcctccatcacatttaacacagtgctatggacagaacagctgcttgataatacatgcttgaattgaatcatctaatccgatatcctttatttatgacaatacatgtacaatgaaaagtaaaagaattttcccaatatgggtaaagaatccaaaactagaacttaagtctctgtaagcaaagtaacatatctgctgcctcgttctcataattaaaaagatgatgcagataaattttagttaaagacttcacataataaagtagttcttagttcagaaataagtgtgtatgatcaaagacacaagaatgccatctggtggtgacttacgcaaagcatctgtattaaatgacctctactgctggcagaaggtaaaccagaaggttgaggttcataataacaacttttcaagcatgatagattatattaaaggtgaaaatcttataaatatactattgtccacgtagctgtctttgtgaactaaaacattcaccttcaagattttcggttgcagtaaagtcaggatccactggcaataccacaaggccaattgcattgattcctcatgcacttacatacacatgcacatacacatacacatatatactcacatggatacatatgtatatggaacatggtgtattaatacactagcacaacttgcacaaatgataagtaaataaatatgggtgcatgcacaacgtttcactgatggagatgcaaaataaaaaatgtttgtatagtatagttttaaagacatgaattaagcacagacttaaaaaaaaactttttgtaaatatggttcacaactttttaaactgctttcatacaaattacaagagccagaattttggcaaatattaacatcttgatttatgcttgactaggaaaatagaagaggggtaacacttatcatgaaaaatatttacaggatattttatctctggtatagatagatcctagtagcttactttgaaaatattgtggatcagacagtaaaatgaaaaggagctaaaagaataaattagctaagtaatgtaaaaatacattctacatacttttctaaaaacatattcataatattgaagttaagaatttagcagtgtatttcaaaccaaactagaatcaacttttgaaataattccattggtggtttccctttttttaaatgatagagatattactgttcagtggcatgtttaatgagaaataaaagaaactatggcatgaaactaccagtaactacatctcgagttggctctatgttagtaaataaattagaaaaattgaaaaggtaatttgaaggtgtcccatggaaaattggaacagagattgtgtctgcttctgttgaaaagggatataagtgaactcttaatcagtcttcagcttttttgtcatggacattcttgtactgacaaagaccatgttcggagggcacgattcttgaagctcatttgaataatcacatcttctccaagggaatcttgtcctttactatgactttaaaaagaagagtttcatccagaaacaatgcctcaaaagacttttaactcaaagcagaatgcatttgaactagaaaacccttgcagatctgctgggctatccctcccctaaaagagcagcactggcctggctgttctgcctcaagatgaagattggtgctggagattatggtgggaataagtctaccaaaatgtaaaaacacctttaattacaaattgcttttaaaactcattgaagttcaaggggaaatgtgatgataagaatatttttatttgtacaataactgattgcatccaagcaatgcaatatgcactgttaatttaatgggcttcaatttccattagcaaatattataaatcttttattaatggacgttttacatttatatgtaataacttttcatagaagttatgtagaaaaccttttggttattgataatttaacagtcaggtttagcatgaagtataaatgaagaaaataatgtgacaactgacacatttcatttttcattgaaatattttacgttgtcccaacaaataactgaaataaagtgcctgcttgaagtcatctgggtctatctttacaaaaggaagtgagaaatccttcttctccccattctcctagtccctgtcagtgactgctcttgaagaataaaaagtacatattaattcatctcactttgctaaataaaaaggtttcattcctaaaagtttgatctaatgtctgcttgctatattgattgttatttgtcacaatatctgattctgaaaatttttagcaaaattgattatagaatagtgttttgggagtgtggtggcaatgaatgcaatggttaagaatttagtactggagtcacatggcctggtttattatttggattccaatacttattagcattgtgaccttgaagagttacttaccttgcctcagtttccaaacctggaatatatgattcataacagtatctcatagtgttgttgaaagaagcacatttaaagtacttagaaaagtgcctgacacccacaacactaaataaataatagctattattctgagaatggtaattatgagacacaatcttgcttaaaaataggatttctttcagtcaagattatattctgacaaagaaaattacagtgaatagcaaaaagatcactaaaaggctgcgaaaataacacattttacaataatagtttgaaaataaaatcaatttatagtttccaaattgaatagcatatggtacttgatacattaatcaaatacagaatgggtattctatcacaatattatgttctatcaccatatgcaattgctgtttagtagctaatctttaaatattgccagcaaagatcaaatcatgtagtaagaaccaaatagaatttcaaaaattgtttctgtacatttcaatgtaatataaatgttatgaatcaccatagacgatttctttatcagtctcaagactcaaatctacattctggtttctcttcaggttgtataaacctttaactatttacgaaccctgagttctgacactaatagagaatttttgaagcatattataattatttatgatgataatatcactaactcttctatagtacagagagcttttcctaggatgggtcatcaaaggcatgatatgtgtatcacttaatataattggaaaagcctcctttatctcacagatgtttattttattgatcctgtcttcctcctgaaagtcagaaccaaggaggacttttattaatttcttcagctgtaaatttaggccttttatcactaacttgccttaattaaaccaaagcttgtgtaatagagtaatgcaaaactataaatctaagaacagtattactctgatagaaatctatatatcttcgaaaacatgctatttccagagttataaaattaaaccctgtctttgaattattattttgtgtaataatttcacaaaccaattatataatcctgcctcaacacaaatacaaataggaaacacaaattctgttttgcatttatttctgtatcttataaatgcaaatcattgcttaagtttgttaataaaataaataccatccccattaaaaactagtattcatcaaacacttttcatgtgtgagataccatgttaaaatcttcatgtgcattatctcctttaaatgttatcatgaggtagaaattattattttctgtttagcatataaagaaatgaggcttgaatagcttaaataacttggaaaataccttattattatgaagttgaacagtaaagtttgaattcaaatggtgtaaccacaaagcttatattttacaatatagttctcacctggtcagtttctctatttgagtagttacttaaaatatatgataagaaattgatcctgcagaaactggactcgtgtcaagattagaccaaagatttaatgttagctatattttgtgacttaatttatattagaaatataatgaagtaaaattagatatatgctaagaatattttaaattttgggagttgcactttaaaaatcatatttttttccttttttaaattttttttttttgaaatggagtctcgctttgtcacccaggctggagtacagtggcgcgatccctgctcactgcagcctccacctcccagttcaagcagttctctgccttaacatcccaagtagctgggattataggtgcctgccaccatgcctggctaattttttgtattttcagtagagatggggtttcactatcttggccaggctggtcttgaactcctgacattgtgatccacccgcctcgggctcccaaagtgctgggattacaggcgtgagcaaccgcacccggcccctttttttaaatctttgagatggagtttcatgccattgcctaagctggagtgcaattgcctgatcacggctcactgcagcctggaactcctgggcttaaaggatcttcttgcctcagccccctgagtagctgggaccacaaatgtgtgccatcatgcccagataattttttaaacttttttatagagatggggtctcgtcatgttgcccagactggtctcaaactcttgggatcaagcaatcctcctgcctcagcctcccaaagtgttgggattacaggtgtgagccaccatgcctggcctaaaaattatataattccttagatgcaaaggatcaatcttgaaaatctcttatttagagacttctggtctcgtctggtatgtagggatcacctctcctgtgcataagagaaaaatactgaacaaactaaaaatcaactgctcttcttagatccatcaaagaactgaggtcacagagcaaactattttcccccaaattaagagacagccagatacaaaaaatattttaaatgaaataattaccctatattgatgatgggagcttctgttactatatttgtttgctaaaaaagaatgaaagaagataatacaagacctcttatatgtaagcatacagaaataaaattatttcttagtttttcaatattacatatatgtatatatatacatctaaatatatatgcacatataacatcgtcacaataattatttgcacttgaagtaacaagttattttccttctatgataacttccttaaaccaagcattattttgcaaacttctatgaaaaatataagcaaaaacaatcatttaaacattaataaaaaaagctttccatagatcaatgtgttgcattattatccaccgtgttaatatactaaaatgttgccaaattctttaggataaaataaagtattaaaagttttttatggtgaaggtcaaaataaaatatatttccaaaaagtaactcaaaataagaagggagggccaggcacagtagctcatgccagtaatcccagcactttgggaggccgaggcaggtgaatcatttggggttgggagtttgagaccagcatggccaacatggtgaaacctcgtctctactaaaaatacaaaaattagctgggcatggtgacgtgtgcctgtagttccagctactcgggaggttgaggcagtagaatcgcttgaacccaggaggtggaggttgcagtgagcagagattgcgccattgcactccagcctgagagacacagtgagacttccgtctcaaaaaaaaaaaaaaaattaatacataattttttttaaaggagggagaaaaaacgatttcaaggaactctttcctcaatccataacaaaccgcatttttcattctaacgtagtacatgtacaactcagaacatggtgccaaggcaattatgttattaactgattttattaactgattgttttctaagaaaagcagatggtaaaataaattatattcttgggaatttttcttacaattcctatttctggaaagtgttcttccatgatggaaaattaaagcagatttagtgaaagggctcatatatcaagtaacttgagagagaatgcctccctgtttccataatattgccagtgaaattatgctgtttgagatttattcctttaggtaaggagctactctttaaaatactcctattaggaacacctgaagatagttttaagttgtcattattgttgtttggttaccagagaaagagaaagccctgcagttggtccaagcacctggtaggaatcaaccctttgcaagtttaatgagatgttctaaaacatgcattaaatatatacttggaacaagtgaccagtacatggtacctgatttttcacatacccagaacggagtcctggataccaagtgttaaaatggaagtggcagccctcacgattatacctaatagcccactcagacgatatttgtttctaatccccacgtctttaggctctggtagtttgcagttcttaattcctcaagaagcaaagattccaccaggatatgtagcaccaattccatttcccttgtggctaagattgttcttcaaataatctcaatcttgtgaccagttgcagaaatataaaataaaataaaataaaataaaataaaactaaataaaataaatacagcatttattcttataagtattttcttccttgctttgttatggacatattaacaaagtatatattaatttattatatatttattatatataatatatgcaaagtatatattaatttatttgtgttctttcctctcctcttcctccatcatttaaatataaagcatattggttgtggttatccttgtcatacagacaaggataggttgtaggatatcagaggaattgtgatggaattaggtgttaggatctctattagtccgttctcaccctgtttataaagacatacctgagactgggtaatttataaaggaaagaggtttaattgagtcacagttcatcagagctggggaggtctcaggaaacttaccatcatggccgaaggggaagcaaacttgtccttcttcaaatggcggcagcaaggagaagtgcagaacgaagtgggggaaaagactcttataaaaccatcaggtcttttgagaagtcactatcatgagaacggcatggaggtaatcgccctcattattattattattattattattattattattattattatttgagacggagtctccctccgtcgcccaggctagagttctgtggcgcaatctcggctcactgcaagctccgcttcccgggttcacgccattctcctgcctcagcctcccgagtagctgggactgcaggtgcccgccaccacgcccggctaattttttgtatttttagtagagacagggtttcaccgtgttagccaagatggtctcgatctgctgacctcgtgatccgcctgcctcagcctcccaaagtgctgggattacaggcgtgagccacctcgcctggcccgccctcattatttaattacctcccaccaggtccctcccacgacatgtggggattatgggaagtaccattcaagataagatttgagtgaggacatagccaaatcatattggaactaacagtaattgctaagaatatgtatttctccttttgtggagggggtaaacatgtcttcatctatagagttcagtatcaatttctccaatatgaagtgctcatatgagactttgaagtcaaaagggtaacagaaggtgctgttattcctcaacgggacagacaggtttaggggcttcatcaaatgacagatatttcagaggtttgccagaggtttcaggcactttgccctggagatttcctattttgaagtaaatcagcagcaaattccctgttattcttggaccttctgatttgctgaatgcttaaagtcacttcccatcctgaccatcacgtttcctgctcttttctggttttaacgtctaatttcctgtattaatccttgttgcctaaatgacaaaagtttctgttttcctgttagaaccctttttgaaaaagagataattgctattttttttttcctaaaaaacacttgaaattactgctgggagaataataaaagcctccatgattttctccaaatcagggcttgggttctcttcttaacatatttcatattcctaaaacttcagcctctcctcatcttttaggcaaaatttgagatttgtatatttcgaaaggagaccttaagtgactcttatctccaccaatataataggtttcaccatgagagagggagaccagagttgattacatccggccttacagctctgttcagcagttttttctttttaaaatcaggtttctcaactactttgtactgtgtaccatcctaagtgaacaaaggatcctcagttgttacataatctgcagaataccaggatgtatacttcctattgctcaggtctggccactttctaacagctttctgtcaagcttgctgtgctttctgcatgtgcaccttgcattattcatcagacttttctcttattcagcctttctctagccacacagctccattcttctttctcaaacttctttaatatttcaagataaattttggcaatttgtattaacttcttttttcatgaagaccacaaaaacaaaatgattcagtcaattaaaaactagatgacttattagcacaaacaaagttgggataggaagttagaactctgaagctgattgtccttaaaactcctcatacattgggtgagcaaactctttgctgttactacataaagttgacaatgtgtggaacttgtacaggcatttcctatggtaactcctaacaggaatttaacagttctgctcacactctatatagatttcctctaatgctcccttgatgttctttccatgaaaagatcttttataaaatcatttaaaaccagttagacagtcaggaagaactcctggcatatagaggctcctgaaacatttctgcacactactttttccgtgtttacaatgaggccttctcttcccaatttaattcaatttaatttaatggcattgcctatcaaccctgaccctgctgccgaattatgttcattctttccagaaataggaagggaaatatattcctcctataaaatgtattattttaattttatttagtcctcctttataaaaaatgaattattttagttgtaaaagcaatagatgcattatacaaaataaaaattgaacaagaaaatatgtgtcctcttttcatctccaaccctttgcccaaaagtaataggttttgtcattttccatttttatttttttataacaccaccataactcatatactatttctgcttatcattgatttatcaaagttaggtaatatcttttgatgtcagcaaattatggaattaatatatgttaattaaataaatatacatagtagataaaaaaatagctggatgtggtggcatgtgcctgcagtcccagctactaagggggctgaggcaggaggatcatttgagcccagaagttcaaggttacagtgagccatgactgcaccactgcactccagcatgggtgacagagggagaccctatctctgtacacacacacacacacacacacacacacacacacacacacgcggtaacaaatactgaagggcttagaaaaaataaaaattctccttcttacactataggaaacatttataaactattttcattttcagtccttttggaggttgttacctcaacaactctagataataaagatacatctctattttgtatttatttttagagaatatatattgactaaaaaaatagaatcttactcatattgtctttctttttcttgactcctttttatgtttttattctttagttatcctattgttagctttataacttcagaatgaatatttaagacatcagtctaaggtttcaataaatttggatagtatctaatgactcctcactttgcaatatgatgatattgtatcctctacccttttctcctcccttagtccctgattcacatccagattttctattagctaaactttagctttttctttgtgaagccattaactgatcagttggatacatgagtctgaaggtaggagagacatttagaataaaaacaaaaatttgggggttgttcagcagatggatggtacttaaagcataagattatgagattgcctaggaagtgagtacaagtaggaaataaaaagaggaccaagggctgaaattgggcactgtgataccgaagttagtaaagaggcttaggaatagagaccagtgagggaggagaaaaaccaacagagtatagtgtcctggaagccttatgaagaaaggaaatcaaggcggagaggatagtcaacaaggttaaatagtgtgttagggccacaagataaggacaaacaacttatttagttttgccagatgaaagacattggtattccttacaacagcagtttccatggacttgaagggagagaggttaacaagggtggttttaagggcgaatggaagaggaaaaattggaaacatgatgtgggagagagaatagttggaatgatgtactggattaggggacatcatagagaatttagtgctcaagtagaaatgatggctttacaaaccaccacagcacacgtttacctatgtaacaaacctgcatatcctgcatatgtatcccgaaacttaaaaaataaaataataataataaaaagaaataatggctttaaatagaagttggtaggtagagaaagggaatgatgtgagtctgtggaaatttctttctgattgattcagagttctctgtgaagtaggatagaaggttaccaacttgtgactttgtgaaacaggtgagaggagaataggtaaaatatataaaaaaaaaaaaaaacctaaacttcttattttgaaaaaagtatagtgattggaataggtattttactacctgaaaatcagatccataagaatatttgcaaaaagaaaaggaaatcaaaatatatgtgagcaatcgtaaaccttgtaatacagattctgaggtttaattgatggacctatatttcaatcatatagtatttattcttataagtattttcttccttgctttcttatggacatatttgcaatttatatatcaattaatttgtgttctttcctctcctctttctccaccatttaatataaggtatattgggtgtggttatccttttcatacattctttaggttgtaggatgtcagaggaattgtgactgagctagatgttgggaactgtattagtctgttctcaccctgattatgaagacatgcctcagactgggtaatttataaaggaaagaggtttaatggactcagttctgcagggctggggaggattatatgcatgcatattctctcagaaagaaagaatatttttagtaaacatcaaaataattctattttttttttttaatacaaagctactatactgtcatcccttggtatactaggggattgtttcaaggacttctggcatataaccaaatccatgcatacttaagtcctgcagtcagccctgcagaacagatgtcttggaaaaataagctcttcatagacacagattttgcatacctccaatactgtattttcaatctgcatttggttgaaaaaaaggccacatataagtggactcaaacagttcaaatctgtgctgttcaagggtcaactgtactttaattggccttctaccattagaacttttttttaataaacttgtatttgtaatagcaggaattgaattgttttaacactgtatgatctgaactctgtcatctttctgatcatgtctcctactattccacccttggatcattctggtccagccaaactggcctttttactgttctatgaacatgccaggacctgcctgctgtaagagtttatactttctcttctctaaacttgcatatatacttatcttttatgcagtcatactgttaaaaattttactatcatatacaaagcatctatggtcccttcttttctgcattattttactccatagaatttattatcatcaagttgttatgtttcttatttatttctatgtagtctttctcctggcatatgaaagcagggattttagcctgattcattactgtaactccagcaccaaggggacttacccatagttgatatttaataaaattattaaattataattatggaattatacttataaaattagttataaaattatacattttatacaataatataattttaaaaattatgttctcaatcaatagttatctttctttttattatgattcccagaaagtttactgaacaattactaattcctttcttaacgtcacacaaagctcttcttatgccatactagtctaagattggattttgttttatttttgtaatagggaccacactctacatcgacttatgtgcttgcagaaggctcgtttttagtatcttctttataaattttattgtcagggggtttcctccattcaacatactcgcagattgcttatgaataattactactgggtattctcttttctttctatttttgatgcattgttgcttattgcctgacccctctgccctgagtgtactctaatctttgtgcagcagtcttcaatccttctctgtgactgacagagaaatattttagtcttcttttggtaggaagaaaacttctagttataatttgaatttttaatagtcaaaactgcaaatagacatgttcgtcctcatatttggatcaaaccaagggagcataaaacttcataaataaaaccactgaatattttcctagcttcagcaactgaggcatatcacagttcatccatcacttaggccacagtgctgcacaataatattcatttattggataaaattagtactagagtgctcctcatgtctgaagagctaattctaattttaaaatatttttttgggttttacgtttaagtctttactccatcttgaattgagttttgtgtatggtgtaaacaaggggtccagcttcaatcttctgcatatggctattctgttatcctagcaccatttattaaatagaaaggctataccatcctggacataggaacgggaaaacgttttatgacaaagacaccaaaagcaaatgcaacaaaagcaaaacctgtcaaatgggatctaattaaacttaagagcctgcgcacaacaaaagaatctatcaacagagtaaacagataacctgcagaatgggagaaagtacttgcaagctatgcatcttaaaaggtgtaatatccaggatctataagcaacttaaacaaattcacaagaggaaaacatacaatcccatcaaaaagtgggcaaaggacttgaacagacacttcttaaaagaagacatacatacggccgatacacatatgaaaaaaagctcaatatcactgatcaatagagaaatgtgaatcaaaactgcaatgagatagtatctcacaccagtcagaatggctactattaaaaagtcaaaaagtaaaagatgatggtgaggttgtggagaaaaggaaaaccttatacaccgttgatgggagtgtaaataagttcaacaattttgaaaagcagtatgatgattccttaaagagctaaaagcagaactaccattcaactcagaaatcccattactgggtatatatccagaggaatataaagcattctaatataaatacacatggacagaaatgttcattgcagcactgttcacgatagtaaagacatggaatcaacttacatggccatcaatgacagactggataaagaaaatatggtacatatataccttgcaatattataccaccaaaaaaaagcagcatcatatattttgtgtgaacatggatggagctggaagctattatccttagtaaactaattgcgggaacagaaaatcaaatacctcatgttcccacttataagtgggagctaaataataagaactaaagagcacaaagaaaacaacagattctgggatctacttgatgcgggagggtgggaggagggagaggcgcagaaaagataactattgggtactgagcttaatacctgggttatataataatatgtacaacaaacccctgtgacacctgtttatctatgtaacaaactttcacatgtacccccaaaactaaaataaagttaaaatttaaaataagttttgttatattatgattgttttcactattcttccaaaaatcttcaggactcctattcaaagagcactgctgagccatcatatattttcctattcaatttctcatcagccttactgattttttcctacttagcttctctctcctcagattttctatctcttctcctctttctcactcttagataatgatctttctcttttcactgagcaaaaagcaataaccagaaggcaataatactcctaccaaagctagggctgtgggaaacagtcttttcctgttgtcagcagttgcttaaaacaagagctagaaaactttgacccatgcatctaatatggcctgatgcctgttttttttttttttttttttttttgagacggagtcttgttctgtcgcccaggcgggagtgctgtggcgcaatctccgctcactgcaagctccgccttccgggttcacgccattctcctgcctcagcctcccgagtagctgggactataggcgcccgccactgcgcccggctaattttttgtatttttagtagagacggggtttcaccgtggtctcgatctcctgacctcgtgatccgcctgcctcggcctcccaaagtgctgggattacaggcgtgagccaccgcgcccggccgcctgtttttataaataaagttttatagagacacagccatgtttattcgtggtctatgcttgcaaagcctaaattactctgacaatttacagaaaatatttgtgaacttctgttcagaactaagataaaaaaacttactatgttttttaaagtttttgcagacaatgcctataccaccatcactcccattactttgcccttggtaggtaccacagctaaaaagtaactttcgtatttgcctatctccaaatctatcaactttcatctgtccatatttattctcacttctttccttttacagtggttggattggccctgttcttattgattatacacttaactgtgaggcagttagcactattgaagtttttctccaaccacatttaacttagtaggtctactcttgaagtatattgaaatttgaacttcaccagggctacgacttttacaggaaaaaacaatgaagcaacaccaaaaaaaaaaaaaaaaaaaaaaaaaaaaaaaaaaaaagggaagtgtgcagacaaataatcataatgatggatgtgaaataaaagaaatgagagaacattatgggaataatgaactagaggaaagagtagaattatgatatggaaattttaagggtagtacctttcttggaaatgacacagtcttgtatttgagcatgtaaatgaatgcctgcgatggagtaaaataaaatttccttggaaatgaggaggtcaagtaaaaagttcttgggtagaatgtctacatgaattttgaaatcaacagaaagaaaaatagtgaatagagacttgttaatgacaacatgaagaggtagctagtggtagaagcaaaggaatttctatccttccaagtctttttctctctccttccactcctaggacagcatgttgaattatattgtcagatacaaatgctggaggtggttgctacaggggttgcctttaggcaacttttctttatagtcatgctcacaaaagaccctaaggcagtagaatgcaaaatatacaaatgtaataatagagataattcaaaaataaataatatatataactattctattattaataaaacagccataaagaaagaggtactaattacatcagacaagttcagtgtaagaaagaacaacactatatattttaaggagagaggattttaataaagcatattaggtgctttcaaatttgtagacaggctggaagagcaagctggaagatggtcctccagggatgagtcacagaataccacatggggagctactgactctatcacaatcaagaaggtagacaattaagtgctgtctgaaatcactaagagcaaagacacaccactcactatagctaagatctagggaccaagaaaccaagaccaggaagctacttccatttaaagtgcttttctaacaccagtggagcagaacagttattgcagtaataatgctggcaaagagaggggtgaactcctatctctacagtcttacttgtcaacagaaaaaaatagccaaaagcgtcaggagattgttctcttatttattccaaatatctggaggctacatctaattggaataatctgattagcatataaaactatagttgcaagggaatctgataaatacagttttaagctttatgagtttcccatactgaaaaggtgagttcaaagtttgtgggaataactgtcaactgccgtttgatcataacactgcccatcgatttattttccctgcaaaaaaacaaaataattacctgtattaagaaaaaaaattagcaaaatgtttctttagttcttatttcctccctgtttttcttctgtgattttggaaataaacatgttcttagaagttatgttagacatttaaagtatctattataaaataaataccctacattatctaggggcattttgtattagtaagcattatagtcatatttcctaaggactctaaactttttcagtagtatataaaaatatttgaaaattataaaaaataaaaacaactccaaaaacaaaaaaaagaaacttagaattgacattagtaaatttttgcatgaatatccacacaaactcattttataacttcattaattgctgaatttaatattcagtaaaagtttattactatgaaattaatatgctgggtaactttatcaaccaagcatttctgagtatgcataataattttacagaaagcatagccaattataagtaaattgtacagtagtaaaagaccaaaacaatatacaaacccatttacttatttttttacatttgaaaaaatacttaaaatatattattttgcattatttttataatttggaacatatgatatatagtagaaactattttttctcttgtttgatatgatatggggtgcattcttcaaaaggaagaaaacctaggaactacacaagttttcagtgagccctcccaacatgatatatttttctctcaattacaacttactataactacctggactcttgagaaaacactcaacagtgttaagtacacactgtcacagttattcccactctcacttcctaagggtactatcaaattgtaccaatttacaattcaccagtttgtttcaggtctgttttgcagcagctgaccacgcttacctgtatcataactgtgcttcattttgcactaactacgtgcacacccccgtttgtcccctcaaacacatcatcttcagagttatatttgtaaatcagatatgtgaccaagtcatttccctgcttaagaaccttaaataggtttacagtgtgctcaagataaagctggagcttcttaatttgaccgccgaatcatcttctctagccagaccagtctgcacaggttacctgcaacacatcttgcccattgctgtctcttatctttgtttgtaatgctatttgcacttggaaagctgtctcatttcttgtttagctgacttttcttcattctctaaatcacccagatctgtgaggttttattttgtcacctacgcccaaagtcgtctcttcattttatttaataattaaaaataaataactgcctaaataagaaagaaaaatagaaaaaaaaatctctatattaaggacagagttgttttctccctttcagtactccatttgaaaccatgacttactgtcatacaatttataaataattacaatcatttaatctataaaataggtattttatattagtaaatgtgattactgaaagataaatactgtattttaaacacaaaaaaagtcttcctatgtttttcccaaggaaataaaagttaaaaatgagaaataatttcaattacttatttcaaatcagtactgttctaatatctatgcattaaactgttacatccagaaatggcatgggaattatgttttgagagtaaggcatcattctttaagatctgatgatctctgtaaacttctttctgatgtagaagttcttagatttagtttaggctctcaatgacattctttcaacagtaatccttcaatataacagagacagagcttgctgtggtatggacaaattgttgcagtacatttaatactctgaaatttccagaagtacatctgagacaatttttttaaatgttcattcctttttagttctgtctttttttatatgacaaccttttcataaaaattatatttagtatgctgcatataataacattgcctaacagaccatttcatagatttaaggttctcttcaggaaataattttacctggcggttatatcagatttgcttgcttgtacatctgtttatcttatcttgtttaatcatatgtttttaatgaaatatcctggcaccagtgagaggcaattgtcttacttggcatattccatgaggtatgcaaaattgaaccaggtgtttatcagaacgattttatttatatgatgcaagtatttaaaagaaaaagcacatggtaaaaactattttcccttttaaagaaacacattttaaaaatccagtttatatcttaaatgttaaatgaaatttcacattactagagaggcaattctgtcttctctaaaaatcagaaaaagagaaagctttgctatatattaaaaattataataatatctattttggtatttcccaaaggatttttttaagtttttgtatacatatacataatcacaagaatcacaaggaaatatccatcccgatggctgagatgttattaggcttttttccttgttgaagactgccttaatccatagcgttatttagaaattaaaaggaatgattcatcattaagactgatatgctcttgctattaattaaaacatatgagaggttggaaaatactcatcttctgatctcccactttgaaaatcattgctcatatgtcttctttttatttatttattttttttttttggtgagaatgtaagccttaattactgccatatcatttataatatgaggaaattattttaaactattttccactgcaagcttaattgcttttgtctcttaagatttagtttgctatttttaatatcatttttattttttctttcaactacatgtacaaataagcacacattcagtcacacacaaatacactcacatgtgtgtacacacagagtcacttaagaatatgtgctaagtatgtcttcatgctcccagacaccagctgcatgatttgtagagcccactgcaaaataaaaatactggaccctttatttaaaattactaagaatttcagggtcacagcagaaaagcactaaaccaaaaatgaggcctttctgagagtggaccctgtgtgactatacaggccacacatccattaagcaggccctgccctgctgttcccattctctataggaaaattgtgtcaatcatactcagtagtcagtcttcttcatttccttgcagtagaatcagttctcaaaaaagaggatatatggtaataaaataccagtgactgctattaatgttcctttatgatcaggtacagctatgggatattttttttcaatcatcgagacaggcagatgggtcatgtttctatttcatgaatttgggcagagcaaaatcacacaactgtctttatatgtgattcttaaataacttctctgacctattaaatctctggagtataacacaatcaagtgataggcaaaaataatgtatttttttaaaatacagtattcaaactgtacttttaacacattgtacagatcgcactctcatgagaaaaaaagagccttacagctttccacagtgtgtaaggaatgaactctaatggcttaaaaacagattttctaactagatagtttgtgtatttctatttgcatccagaatagcctatcaaagattttttctttctctgctgataatggaaaaggaggcattaaggagaaatgttatatcttaagactgtgataggataggcttatgacattataatcttctgcagaagtcatttcaatatgagaaattactaacatggtgttttataattaataaaaattactagcagtccagattctcctcaaaccacttctaccttagcgtttgtgtgtgtttgttgtgagagatgagtgcggagggggtggaggtggaaaagtaagtagtaacacactcttgtcttacaccctgagcatctcagtggcagaaatgtacataagctggaagacttttttcttcctatctcttaagaagagttattcctgtttatttctgtcaagcctattaattctattgctctttctttgcttgaagaccactcttcaacagttttcttctatttcacaatatacttaacattttccactggtttctctaattttaattcttattcaatccttaacccactacaatttaggatcaactttttgtgttatctatctatctatctatctatctatctatcttctctctatctatctatctatcatctatctatcatttatctatattgcctaaattgctcaaataaccttttgatggggggggcttttaaattattattgtggtaagaacagataacatgagatgtatcttgtcaacataatttttaactgcatgctaaggtctgaatgtttgtgtctatcccctcaaatttatatgttaaaatcctaacctctgaggtgatagtattaggaggtgggccctttgggcggttttccatggtggcttcactattcacatttctatcaaaatgtacaagggttccagtttcttcatgtcctgccagctcttgttatcttttactttctttgtttgttttcttttgtttttataattactataattgtcagattacctcactgtgattttggtttgcatttccctgatgattagtgatgctgagtatcttttcatatacccattggccactaatatgtcttctttggagaaatgtctagttaagtctcttaccatttgctctttacaaaattgctattgagttgtaggagtttcttatatatttggatattaacgctttatcagatatacagtttgtaaatgttttctactatctggtaggttgtcttttccttcttgatgacacatcatatttctgcctttctagacactctcttcatctcttttgctgactccttgccttctttctgtcctgttagagaagttcactacagttctgtccttttatcctctgacctcttgctgggaaaagttatacattgtaatggctttaactactgcctcataaatccatgtcagaaaagaataaggagaaaaacatttctcctttgactattctaaatctacttatctagctttatagtctgtgattttcccctccatacttcttatggccaaacatgcagaaatactcaacattcctaaacctgttgctcttacttttgctgagttaaatttatcaactatgttggaaggacctctgtgtgtgaagaacttatactactccccactctgcaaagacattcagtctagacctcctgttacgtgtggcgtgctgttcaccatgtctgtcaagcacttcaccaaacttttctttcttgggtaacccctaccttcctatccagtttaaacatggcctgctctactgatctcaaccagacttcctttgcggaagtatgaaaactcttcttttttgtaatttaacagagtgcataccttcaataaagtcacttttaaaatgttactaagtgtttttgtttaggtgtgtatcatcctcactacacatctcgtggaaattatattttactcaccttagaatcttcagtgtttcagctataaaaaagagtgaggaaggtcaatataaatgataaggagtaatttctgacatgtattatttaagtgaaaaaaacacaaaaaagatcaaagctttatattatgaataagaaattattttttattatttttaggtcttcatcaaaacatggccaagaggttgtaaggaaaactacttattagaaatggaaataaaatatgtagaaatagacttggcagtatatattgacggaaataaatattttaaaattttttttatatttttgtgtcataatgatgtgccatgaacaagttatgccaaaaagctctgagactagaattttttaaaattcaaaatatttgtatacagatattttggaaatgcccaacctgtaatctctgttaccaataaaaattccttccaaggaattctctgtgcccattgatatcagcattagcaagaatactgaatgagatttggattgcatttcctctaattatgctcctgtggtatcacatttccttataatatgtaattatgtgagagtttagtgttaatatgcataatatccagattacaggagagtttataaatgtagtacataatacaaaacttattttaaaattggattattaacatttaatattcaaacacttaaatgtatatttatattatgtaagaaaaaacaccatgcgatattatctatacaatgctatacaatacatataatattgttcatggactagggtttcctcaattttttctctgataattatgagtgtgctctaactgtaatggtgtacattgaatcttagagctagaacacaataattcatccttcctgtcttatatgtgagaaatttctactcaaagaagttaaaagactcttcctggaggtctgataggttttagtatagttagtctggaaatgccaaattgaatttgttctcattgtttcttcctgcacaaacaacgaattttacaggatgcatgaattaaagaagtaccagtaaaaactatttgtggaaataatggcaaactgaagagtgcagggtgctctaggtttatggccttaataaggaggtcagccactattcatccatgactgtaatgggatgaaggaaaagcagatttgaagtcaaatgcatttcttatggaagaataggaaactgcagaaaattatatatgaaagctcaagaaaacacaagatattaaggagagaattagaactgttgatttatttaaataaatatagaatttcaaagagtgggttttctatttcaaattctattattttttaacattcatggttacaaaatactttcttaattatgttaacctttcgcccttacactcagtgtttttatcatataatcatttttattttacttggatatatctagctaatttttataacctttatttcctgaacctttgcaagcttgcagtatagaactatttccagaaggatattcaattactatatattcagtaagtgaataatgaaatgatagaaagtcttaatacttcaagataaagggcactggaaaaaattccatttaaattcaatccacttaaaactgtccagaattctgcaataagtggtgaatgaaaataactacacaagacttttatcttaaaaataaataaaattcattaaaataaagttattgctttttattttagacagaatttaagttttaattgcaatggtaaaattgttcttaaaatacgcaaagaatgagttaagtgctgatttgtccttttgggcatttttttgacaaaattttattaggtgcattacaacatctttcctctcatgtttgacttgcatagcatgattatattgagaaccatttttttctgagaaatatttaaggatttccccttttcccaagggtctctcaaatctttgaaattaaaatatttctcttctgaagtacctagcatgacataattcttttgaaagatttataaaattgcatttgcaaaatatcgtgcactaaattggctcacatgtattggtctacttgcataataattattatataaatagttcattagtgaataatttcatatctgattttgttttgttatgtgaatgttattattgaacacttacataccaaggaccttcctgaataattcggtaaaacagctgcgtctttgacattccaccacttcgaaaggattatttaatcaatctttgagatgcagacttcaactttataaaatgaatggttaggcatttaaaaatttctttgattttctaattcaaaaaagccctcagaatgccatataagcatacttatggatccctgaaatatttcttccccccacctctctgcttatatctgcatcaatgacaccataatctataaaccaacgtcaggtcttatcactgtgtgcttacatgttctttactgatcaagactatttttcacctagctgtcaatcaaactatcatcagaatgtaatcacagttctaaaaataaatgagtttaggtaatgatttacattaataaataatctacttgggacactaagtgttttcatttgcaatcgtagaaatgtaagctggagtaatggattcataaactcactatttggaaagatcaaaaggggtttttcttcattgttacatttcggaattgtataaattctgaattgcaggtaaagcttcctttagaattgtaggcatcagtcctaagaaatcagggtcagctgttatgttgtccagatttgtttttagcacattcagccacttacgatctcatcacaaccactgttcttttttatcattgttaaggtgacaatatgatttattgttcaaaccaggacacttctgagaatgatatgggatgctattaatgactccaatcacacaatgggcataaactggaactgtccagggcaaaccaggacttatggtctctagtcacagtactttttctttaaaacttccataccaacaacctctatccttcaccttccaggaaaatctgcctttaggtactaatcactttaaaatgtcaaacacctgtaagtaatcaaaatatcacctctgtgaaagtcttagtgattttaacaaaaacttaaagccttaaagagatgaagctctagtttggattgttccaaacatcatccagagatggtgctgaaatggtgctaattaaatgcttgctactccagctgttagtaaatttagtatcctgacaaggtctcaaaagtgtaagtttctggagaaaatatattgtgttatatatgttgtattcttttatctataattgcccactctttaccttcaagtaaattgtgctaagtacagaaagccatctgatggcttatccaattagttatttgtaccttatctcaaattttatgtctctctcagatttctttctctctgaaggttgcctcaacttttctaaagtgagcacggagataaatattaacaatattaaagtactttacaagcattttaaagataaaaccaacaattaaaatagcaaagcagtacaattttacaaagctggctcagctatttctgtgaacctattagatgaaaatgttctaatttctgtcagggcagtatacgctgatatagatccagagattttctcccattgttccctaagaaaaatatattaatcgattgagtgattcattcattcgttcattcatttattcatcaggatttattacagtctagcactacaccagaaatacaaaatgaaaggagacatggtttctatctcacagcccagcaggaaagataaatacacaaacatggaattacaatattatagatttaactaaaactctatagaacagcaaagataacaccaaagaacattaaaaaggacttcttcatctgggaaagcttcaaagagttcatagattaggggaatcctgaagcatgagtgagcatttgccaagcagtgaaatggagaaatgttactgcagactatgagagttcacattaaagcatggaagcacagaagagaatgtggtatcctaaagattgtgagcagctgcatgcaaccagaacaggaacccattgtgttctgagaaagcctgtcaaggcaggaggtcagagcatgattaaacctagataacatgggaaggggattttagctgagttaccaggaaccaacaaaggtatttttgaagaacagtcataatcaaattttaacccagaaaactaactctactggcagtgtggaaagcatttgcagaaatacacgggggaaacttgagggcctaatgaaagtccatcaatgacaaggaagttggcatttaactaatcaaaaagcaacagtgaaagtatttattcattcagtctacatatattttatacttacgtgccaaatattgtgttagctagtgagcatccaaacatgaactaggctcctaaagtataatttaaacagaagaggacttggacacagctctctctatataaaactgaaaattgaaatatgatttctgttttctacctaacatgattcttgagatgtataattaaaaattttagattttgatgatgatgcatgaatgagaatttacattgaacttgtctatcttgggccacaaataattcccatctaaagaatcaaagatggattgataagtcaataaaaacagtaaaaaaaaagtgttatattgttctggggagatcttttcataaagtgagattctcacagtgatcaatatgagaatgacgttgcctgaaacatgtatttttctgacatgatattgacctgaaagaccaaggcctccctttgaaagggatagctgatctcaagtttcaagcactttttagcaagctgcagggatcagcaagtattatttgtcctctctttcacctggactgtaagtgtcttgtgaggaagaattgtgtctttatctttgtgtatttccagtctagaacacaatactggaacataaaattataagtttgtcaaataaaactaagataactgggtatctgagagatgaatacagaatactttcaattaacacttatgtggtaacctctgatctaaaatattttttatcattagtaagatcaggaactcccactgggatctgatacactcaagttgtttatttacagggtggttttgaggtatgaagtaacaaacttatacctaattttctgctctgctcacattgtgctctactgacttcagagttttcaatgtttgtatgttttgattctcaatagtcattaaataaccaacttcagctcatacttcgctatatacagaacaagccagattggtagagtaattgagatctttcaatatacattatttttattatttcatttaagaatttgtctcagagttggacacttttgtcccaatatccaaacaatcttttggatattgtttttaaaattaatctttaaattcatgttctctgctacaatcaaagggactttcaaaacaagagacaaatagagatagtccaatgagctcttcctactacgtctttctattgttacaaatgggggcacctttccctgtgcagccttttgcttgggaagctgtaaaaagtacagaaaaatgagtatgatagaaggaagtactttcttaaggatgttttttctcttatgaattgccattgcaaatatatcttcagaaatttcatatcacttgacacctattcttatatagcatttatcaaatgtaacttattcacatttacagttaataatttaaacataaaatatttaaagataaaaagcaaaaaatcagtggaatttcagttcatgcattattagaatttgaataataataattcctaaaaatgtattgagtacttcttacctgttaagcacccttcttattttcaatatttcctgacaaaaatctttacaaattcagccccgattagaagaactaatgttatatcatttctctgagacaaaagtctcacaaaaaattgatgtgtaaatattaatcttaattctgcagcagaaatttttctttttgatttttaggaaatatgacagctctcccaacacttaaaatttttttgtaaccttctgaattgactttttgccaatttactagtgtttaacaatgaccttaactcataaccactccattgttcttctttccttcatctgttaaagagaaatttaacatcctcctctctccctcttttctctctctctcccttcctctctccctttcttcttccttttttccttcctcctcttctttctctttcaaaactgttggcaccgatgtatatatatatttttaactttaaattataatgttaattcatttaatcctccctgccattctcaaatggccaacttcttttgtttaatgtttctttttaaggtctagcttttattgcatttgtcttactcttcaatataatgtgtttctaactccttccagggatttggtaatttggcagtcttccatctagcttccctaagcaatatcaaaagaaaacccttggaggataataatgattaaatgtccagactgcatacattttctcatgtccatagcactctggagaaattaattaagtctcacagcacctgtctgaggtattattattattatgtatgttttacatatgcaaacttcaacacagacattatgtgttgcccaaagtcaaagaaaagtgttatttttatactgagattagcatttaattattatggtttaaagtcagtcctcttcctttgctatatctctctcactggtctttttcttactagaactaacataattgcattatcatattgactaaaaggtcctttcaaaatacaatgtttaataaaagttgtaaatgcatgtattcttatggtttttattacatcaatatcagttactatctaacttacaaattacttacctttatatttatgtctgtagtttttcttatcaaagttgcttaacccatttttgcataattaagctttatacttattttcaattatgcaatctatgtttataaatactgagtttcctaattagcagttttattgacattacatagatgcacttttttcattaaagactttacttaatgttaatttaaaaaaaaaaactaacaagcacttatgtgaaaaagtggtacattcaaattctaatttatttagccaaaacaaaaatctaaacacacttttaagtagtaaaataaagtatgtgtcaatatgatgcttaattcgtctagcgtggtgattatgcctgttttttcattttacaattttgttgaataagggggaagccagtcatgattcttagaggaagagctattattattttattaggcataatattgtttgctatggctactctccaaatatttcataatagggaggtggaatcattcttattgaggactggttggtgaaaacaaaaggtctaacatattattaaatgaaagaggtcaacataaaaattattgtgtgttttaaaaatacattttaaaagacattctgctcttagatcaagttaagttgaaataaattgtgtttacttttcatattgcatttagtctgttgtaacatataagtttggtagttgtgattaaccacatattaggttacactggtaatttttaatatttcttttgattgccagattttatgcaattaagttttactgtcaagtgaagactgaattaaaataatttgtgggaataattactgtttgacatcaggaattctaaaataagtctattcggacaatatctattcttttcttttttctttttttttttttttttgagatggagtcttgctctgtcacccaggctggagtggagtggcatgatcttggctcactgcaacctctgcctcccaagtagctgggatcacaggcatgcaccaccatgcccagctaatattttgtatttttagtagagacgaggtttcgccacgttggccaggttggtgtcaaactcctgacctcaagtgatccttgcacctcggcctcccaaagttctgggattataggcatgagccaccacacccagccacgatatctatttttaattcatgtcttctcaaattaatataattaaacaattacagaatgaaaaggaaacaaaaccactatcagttagtgaacactaacccattttaacaaataagcattctcactcccttcccatcttagttaagagagacaacttaactgtttgtgggctatctctgtgttaagttagtttatgctgatagtttacttccttagcatcttgaaggcaagagaataatcatgaatcctctcttgtttctcttgcagtggtgtggtctctagagtatagctgagtatcaatgcaacctgaaaatacaaatgcatgagcaatatttacattgtttctgctattgtcatcactccacacacacacacatacatacacacacacacactcacacaatgccttttaaattaatcaacacgactagacctttcatgcgctggccctgaatcagaattatgatgttgctggcatagacaaggaaacattccaaatacatttttgcctgtctggaaaatcctattaatcactttatagaactgactcctactgttgatataatatatctttcaaaattgacagttttctttcaataatataccttgtagatttactttatattatatagctgcctttaatcctgataattgaattcagtgaacaaatactcattgagcatattactgcaaattgttcaccaaagaagtaaaaagggtatatttttctgaaacaaaaatctcctgggaaaatcacatatcaagctctgaaatacactgtggcaaatgcaataaggattggcatttgatattaccctacagtactataaacaaaaagcaggttggggatgcatatttagaagagttacaaaagaagattgtaatcagtaagaaaatacaaaaatgtaagtcaagaagaacatttaaaagttaatttatctaaaatccatgttcataaatggcattactcaacttgtaagtctttgatggtttactgctagcatgaaaatccatactgatggaagataaagcatcagttgtaggaaaccaagattttaattcacataatacagatgcagaattcaatatagttgcacagattctctatgctatttgatgtcattactatggtatgacctttctcattttttaaaaaatgactatcacttgtggacgtagtcatgacagaaattcagtatataaggagaatttgttgcacttactttccttttagtgtagatctatcctcttaaaatgaaattatcagcaacattgatgtggtagtcttagagaaaactattagatatctgaaatgtgtacttcatatgtcacaaaaacaataataataacaatgctactccaactagattaattcaaacaaaggactttttaaaattctctgaacagctaaataattaaagggtcagagaaaccttaatttggtgtttaaattacagactgggagttgtttgtttgctttcattctttgcatacatttccttagcatcatgacactcttaggtacgttctcccgtgtggtttcaagagcactgtgaacagtttcctgggatacagttgtctggatttatttccagctggaaatagtacacccacttcgtttatagctcaagagcaagccctaaattgatctaatttgcttgacttgtgtttcgtgcccatcacagaatcattgcatgacaaggaaaacaaaaaaaacaattgatctggcctcttaagcaggtacacagtcaggttgaaggggtgttggtggtgcagtcagctttggttgaataccgtgagcaagttgagaaaacggggttttcccatatcaacatcagggtatggttgcatgaaaaagagggaattaatgctaggaagattttttaagcccaaacaaatgaagtaaatattcaaaacttaatattgtcaaactactgcaagctatatagctaaatacatgttacaaacatagatgaagacagtgcatatgaaaactctaacatctatgtccttcacctactcacttccaactattttccatcatgctagcttgaccatgtatgaaataatgacaatctttatcatcatcagtaattctatttcttgtgacatttccactagcgacttctcagtcagtgaccttaattctttccttacagttttcttatggtagtatttcacaagatgtgtgctcaatttctttgagaaatgcaatctatatatcctttttaaaaataatatttatcacccttcccttctcttttaagtctagatccttgtttagtctttcattataattaatctcttcacaaacaaaaacaaaatggaaaatggctttctttactgtttcactatatctacaaatattccaaccacaattgaaagcaagtatcctcttttccactaaataattgtacttcagatttataactacaaagctcaaatgctaatttaatacttcaatagtatatttgtttctaagtacactagtttcttagtatttaccacaaacttgttggctgaaaacaaaagaaatttattctctcagagttctggaggcaaaaagtttgaaatctgacagggctgctctccctctaggggctttgtaaagggaataatcagttccttgcctcttccagtttatagtggttgccccagcatttctgtcctagtggccacatcactccactctctattttgattgtcttctcttctgtgtgtccatataagagagaggaaaaaataatcccttttaagcaggtacactgtcaggttgtgattattttttcctctctcttttgtggacacatgatgtcatttagggctcacacagataattcaggattatcttcacataccaaaatcgttaattacatctgcaaagatcatttttccgaaaagttaacatttgcaaattctagagattgacatagacatcttttgaggggccacagcaaaaatctttgtttcactttttaacgctattattttatactttcttttacaatttcaaattgcttatactccatcatcattgaccactcaaaatcagctgataatcgtgtttcacactgtattaggaaaataacaacaatcagtcaagaatatttcagcttttttcaaaactggtactatcactactcttctattgttcatccttcctgttaaatgaaagattggcccctcctccctcacccctgctctaagaacactcttgttcttttgctctggatctcatgccttttcaccttctcattcctgcactctcattcacttttggtgagagtgtactttgacaaaatcatctggagatacagttttgcaatatattaaaacaaacagaaaaagtacataacttttgattcaaaattttactttcaaaaacttgttccacagaaatattcagcttaacaaaaataaaaatgtcagtttttgaagcattatttgtactatgtaaaatatatatatgtgtgtttgtatatgtatgtgtatatatgtatatgtaactcttaaattccctcagtttgctgatgtctattatgtaatgcaattttaaaagttattttaatttttaaaaatgaataataatttgtacatatagatattgtatggtgtccataattgccgaaataatcaaacaaatatcagaagcagaactttacttatttgttttaaataggagaaatggcatgcaaatttattaatgtgcacgtggtgagaaccacagagtgattactccccattcctcaatggagttcagaaactcatattccttcttgaagttacagaaagaatgggggcttgtatcatggcaaaatacattatgggaggaggagaagaaggggcttggctagcaaaggtggtcttgttatgtagaactttacttgtgacacatttttgttcaaaacaacaataacagaatataggtatgaataaggctgaaagagtaaaactgttaacagtcttcgttctcaaaaagtagaaatataggaggaagttttggttttgtatatgtccattttgtttctaacaattaacctctattgatatttacatacatacgtgtatagatatataacttattttaattctttattgtttttagtaaaattataagcatataaattacatctaactcatattttttttgttcagtgttttggaactttatgttacctctgtttttattgttcaatttcctaagctattcatctaaataaatttacttgaaaaatttggttgtcataatcagtttactgtcttgagagcactttatctaatcttaatgaaggggagttagaaatctagctgacaaagctttaattcttcccaacaatctgcattttctatcacatgactacccctaattaactatagtgttaatgccttttgtcttttatgataaacaacaagaaaatgcctgttggaaaaggaaattagcattacaccagataatttcaaattgttgccaatgtaacacaagagtttacagtctggaaaatatgataagtcaaattttagacactaagatttaattatttgactttttcaaaattacgctatgttttttggttaatgaaattacttcacatagaatgaattcacattttaaacagtttaaaaatgccatttagaatccgacagtattttactgttccacttcattttgaataagatatgggtaaaatatacttattgtaaaaagtaacataaaatagatcaataatcaatcctagatcacagtaattgtacttgtaaaatcacagatagtatacaatgactttcatataaaaatggaaatattaagttttgattttattctttttaattagatatatatataggctgatggtcagtattttttaaaagccaatttgcaaactgagaaagaaaattatgccatttaaactgaagtcattaagaatcttgaagcagtgtgtaacaccctccaagaatagtccttggggtttaaatgctcactcaccctctttgttagtttaattcaacagaaaatatcttgttcacacactagacagagttggaaaggagccatagaagattatgtccactcaataaaatagaccctttatgtttatgttgctttgctcataatctcatatctatagcactacaaccaattaattgcagtatattcagtttgtggaaaatcagacgcagttcatgacttatctttttgatacatttttgttgagaactttataactcatcaaaacttcccttaacacaatatatgaaatgtttactgtatatgatacaaatcaggaaaattctataattattcaaaataattatacatttgtatagttccagaaaaataatagattttaacagcatatgagattttttaatatagtctgtattttttgttgttcagaaataaatacctgaagaatgaggctaaataaatttaagaagcatagtcatttttgtctttattttttagaattctttgcttggtcatgaactatattgagaaataaaatgagctttaatcagtcattttctcttgaatcatattcccattggttcttatatttactaatttgatgtaatatcattttgttgcttagtgttattgatcaagcattaaatctaatacattacatcaataatcaaattttccttttttccgtatctttttaaaaatttaatgacgcatctatagtatttggattatctttcattacgttgttgttataactttgcaaataaagttatgagaaaaggaagaatttcaaaataggaaaggctaaaatcctgttggttggatgagtaatgtctcttcttccaaaagacagcctaaatccaagctccatatgtaatttaacaaacactggtctgagtatactatgcacctaacactctgcttaatactaggtttagaaaaatatatgatcttctcttttatatatataccttctctaaccaccttcaactactttctttgctaatccatttcctgctcttcataaaattatctttactacttgccaagtacataataattggctaagtacttagaatgcattctaagcttaggaggaagcagaggtgatatgctaatgtatatcactggcctagcctacctaaacaacaagcaagtatatagttatttttcagcagaaagtagcagtctgcatgctcagagaaattgatatggttatgctttgtttttccacctaaatctcatcttcaattataatctccataatccctataatccccaagtatcaagtgagagaccaggtggaggtaattgaatcataggattggtttcccacatactgttctcctaatattgagtgagctctcaagagatctgatggtttataattttttggtagttcctcctgcgttcattctcctttctgccaccttgtaaagaaggtgccttgcttcccttttgccttccgccataattgtaagttttctgaggactccacagccatgctgaactgtgaatcaattaaacctctttcctttataaattacccagtctcaggcagttctttatagcagtatgaaaatggactaatacagcattcatacacaggttgcaatctcatgttttctcctctcatgtctatgtttcatttcaccaataaacagttaataagaaataaatactttatggattgaaattcaaattaattcaaacttcataacttccgtttgagtcacagttaattggaaaaaaatccttcggattttttctctttgttccaaattaggtaacaagttttgaggtactgtgcattgatattataagagcaaataaaagcagtttctagccaattctccctttcatatatacaaaagtaaaaaagccaagtatatttcagtttgtcttagaaagtcatttgtagatgttataccaccatgatttagagtttattaatttggattgaatcaacttccatttgaactactatgggacaatttaaaggaactaattaacattcacatttccctttaatatggattttattttagatgacattaactatatgccatatctactaccagatctacacaggtagtcaaaatctttgcctgtttttggtgactttcttcctgttaatataactgaagtcgcaatgcttctatctaaagctactcctttccactagcacactaaaccccactatttctaacctactctaagattttagtttagccagcctcccttcttttttctgtttagtcatgttttctatctttacgggactatgattataaaagcatggatttatttctccctttgttaaaaaaagttgttttgaccccactttccctgccagttattgccatatattttttgcttctctttgctgcaaacttgctcaaaagagttattcatctttgctaactttgattttcctctttccagaccctcccaaacccattgttccaaacagactttcactactatggtaacaaaacttctttggcaaagtcaaaaatgttctctacattgctaagtctaatagtggattctttgtatactttttacttgacagatcagcagtatttatcttagcactaaatgctcagttttcctcattacttttattcgagggtttcagttcctggtttttctcctgtcacattgttttctcctcttctgtctgatcacttaatgttaatgcaacttcatcatctttttgtctctcacattcactccttcagcaataacctctgggttgcatgattttaaatgccacatatgtatgcagtctcacattttacactgccagcccaaatatgctgctggacctctagacaatccactgctttcttgaaatctctacttggacacctaattccccaagttatgtatgcgaatacttaacttaattgattttttaccaaactgctttccctagtcttctccatctaagttaatagaaatttcatcattccccttgctcagacagacattattggggacataattgatttacccctttctctcatcatttcatgatttattagcaaattattttggcttcactttgaaaacatgtctggaattcaatcctttatcaccacctctactgctaatatcttggtcaacccactatcatcaggcaccaggattaaggcaataactatacctgatttctcgtttccaccatttttctttcattctcactcttcttcacttagacatattccttccttagggcctttcctcttatatgtccatggctaaccccttcaactttttcatgacttatctcaaatgccattttccaaggctgcctacttactcactataataaaaattggaacctattcacctctccacagttaccctattctgcttcatttttttcatccatagcacttattaccttctaatattatataattttattatgtctgtttaatattttctgtctctctacactgaaatatgaattccaaaaggacaggtattttttttttccaaggtggggagtgaacggatgatctctcatttactgctatgccccgagtgcctagaacaatacatggcttagagtgggtactcaatacatatttattaaataactgcattggtgtgcctagtatgtaccatgctgtgtgctgtgttgattaccttgcttaatcttttcatgaattcaatgaagtagctattttgtttcctcttgtagggatgataaaactaggtctccgtgatttctaatgtgcccaaagttatgctgtcagcatttaaagatgggatttaaacctaggtagcttgactccaaagcttctgctttgaatcctcattgtttcccatcttaacatgagctaattattgcttctgaaacacatgtaatgcagtgtattgaactctgaaaacaaaatttctgctgataatcatgaaaaataatagccccacttcttggcaacatagaaaagttactgttgttgacatttgattttgagaatttatcttacgctttaatgaaatatatcaactaagccatttgctgccttcaagagtgtgagatgtgacatgttaaatctaatatactcaccacaagaactggtttcaaatatagatggaaatgcttgtgagaaatgttctgaactattttgacccattggaggcacagtgacaggatagtttcttccttaggaaataggaatagcatgtgttctgtcattattggcaagaaaattcataagaaaatgagtagtcataattttaagttaggaaatctataatatcaacattggcttttctttctgtctgtgttaatatctactccaagctatgcaaatgattttgcatacttaggttaatgattattacattttaagattttcagatttttgaactgacaatttaacactacgttttatcaataccttaatgaacaggtttttttttttttgctacttgtcaacaaatgactaatgtgacctgcttgttactcacaaaaatatgtcatctaaagatttctaaagtgttaatttctgtttctttttgggcctattataaatttaggaaaatataatttcaaaaacccaacatattttgtgatttttgatcttcagttacaagtgagtcatcttaatactcccacttaaattgtgacacatcatatgtttcataattaccattattatttatacacatattattttctgtagctcgtgaattaattcctcattttactgagtcttttattccttgtgtctattttgaaaagtttaaaaccttcagaaacactgaaagaataagaaaaagtatacttgcatattcttcgcttagattcatcagtttttacgattttgccacattggcattctgtgtttcactctttctccctcctacactacacacacacacacacgctaacgcacacacaggctcgtgtgcatgcacacagaaacacatctttatttgcttattcgtttatttttgcataacaatttgaaagtagggtgcaaataccacgtgctttcacccgtaaatacataagcatcttctaatcgtaacaaccttcccctaagtagccacaatatcaatatcatgtttagaaaattaacattcaatcaccaatgttatctactgtacaatccattttcaatatacccagtttgcccaaaaaggtctggtatagcctttttttttaaaaaacctaagatctaattaatttgcactcattgcatttgtttgttatgtctctttggtatcttttcctctggaacagttcccttgctttttttttttttctcttttcactgaatttttagcagagttaacaccagctgccttctagattatcccaataatgatttgtactgatgatgtattattgtgtgagctatttaatataattccctacacagccttatgtatggatttttttttcatataatgggcttaaaaaaagtgaagttacgtccccaaattgtatacattttgaaagctgcagagtaatatttcaaacacaagaaggtcagatttcaaaatatgaactctaaccaatgcaagatccctgcatcttgaccaaatcatattcttgcatttgtagtgttatttattgtttaatactgagaaatgtacatgtgtgttttacctcacacatcaaatatattaatatcatcccttcaaaacttctgatgatatttgggaggctaatcgctggttgtcaaaatgtaggaaacattaaaacaaaaatagttctaaggcctcactcgatgtttcttttctctactatcaaatagtgccaaaagctgacaaaacaggaatgcatcaaggaacaatgcattagtaaaagtctagacgaggtatctttagtagatcaaaaatacagcttgtgaaattgttatcattgacaaatacttgtttttccttctctttcgttctgtcacccaggctggagtgcagcggcaggatctcggctcactgcaaactccgccttccgggttcaggtgattctcatgcctcagcctcctgagtagctgggattacaggcctcccaccaccatgccgagctaatttttgtatttttagtagagacagggtttcgctatgttggccaggctgatttgaaactcctgacctcaggtgatccacctgcctcggcctcccaaagtgctgggattgcaggaatgagccaccatgcccggccaatattttaacatttctaatgtgattgttactgaggtcaaataagtcacatagattcagtttttcatggtgatttttccaattgttcacatatcaaagctgtcagcatatatatgatgattaacaagtcaaggaaacattctgtaattgatacttgtgagatctactacaggtaaggcattgagctattgatctgagcaactctaatctagagttggcatttaaccatatatatggacactaacttcttgatagaccctgttctactgttaaagcactgtagggtcagaaatgaattcagacttgaactagattttgtagaaagtgaaacaatatatacagtgaaattgggagatgaggatacattccaaactgataatttcagaatactaaagtcatacaaatttctcttgaagattactctctccctctgctttcaaattatttaatcaaatatgtataaacagaaaatatataaatttatcttagaatattatctgtattccaagtatcatttatctgaaatctagactgtgaactctttaagaagcaacaacatcgtttatttatattgccagaatccggcactgtgcttggcacgttggaagttttagtgaatgattgttgagccaatcagtcacatcctggataggtactatgctgcggttcagagtgtcaccatctcagttcagagtttactcctagatctacatgcaaatgaatgtgattcctcgcatgtatgtagggtccgtataggcctaggacagtttaaaatattaagttttggaaaacgagcattttgtaggtgaactatgtgatacttggttttcactgtagaggattttaatatcttttgaggcataatttgggtagaatgcctacatatttgaatttgtcacatttgaatgtgacattcccctaacctgttgtgtcagtcaaggatcagttgaaagcaggggaaaaaaaaagaaaagaaaagaaaagaaaaaaatttctagcattttaagcagaaagggatttaaaccaaatgagttggttaacaaattgttgcaatggttagaagagcagatgctagatcaggtttctaggagagactataagaatagcaagaaataaactaccaaatgaatgtacctttgccacagttaggtcagtggaaatcaagaagttgagcttagcatcaataaagacttccattcaaaaatcagtgctcttgaagtcatgactggacaaagggatttgccttcagagaaacccgatgaccacgcttgtcttcatgaccaaaagcacaggaaaggtgagaaagataggttcttcgtctctctcactttttaaatcttacctaattgactacatctaatccacagttaggagtctagttgcaagggtgtttaagaaaaggattgctgtttctatgcttatttgttcctttaattttttagtgctgaaagatatttcaaataaagtttggaataactgttgaatattaattcttcctaactacttcaaatttacatataagactctttgccaatagctttttctgtattattattaattccttttactctttcagtcttccacctactgctatggactgaattgtgtcccccctaaaattcatatgttaaagccctaacccccaatatgatagtatttggagacggggcctttgaaaagtcaagctctcatgatgggatcagtgcccttctaagaagagacgtgaaatctccgtctgtctctctctttttcccatgtgaggatatatcaagaaggcagccaactgtgagctagaaaaagagctttcatcaaaaccaaagctgccagcaccccgatcttagacttctcagcctccagaattgtgagaaataaatgcctgttgtctaagccaagtcttaagtttaagccactgggtattttggtgtagcagcataagctgagcagtgtacctactctttctttccttgcctttttggggggcatattatgttgctgacctttataccttaaattctaatttatcttctggaaaatagtcataacttttacttagtcttctaatctgaccgaaaatagtcataacttttacttagtcttctaatctgacctctaattctcttgctgttacccatggcagcaaaatacagtatttatatatttctagatcatttacttatgttttgtctaatgaaatttttttacatgaagtttgatataacaaatgtggtttttgatttgatagttgatttgttcttatatcagaataatgtcttcaataaattcagagtgaatttatacagaaaaatgctttctcttcatttgacaggtgtacagttttaaatcttttacacagagctcaatactaatctccacctaataaatagatttaatttaagcttaagaagtttttattttaaattacctactatgtcccaggcactgtgttaggtaatggggctgagaagacaaaatagacaaggttcatacatctatacaccttcagataagtggggacaggtacatataaataggttattttaatacgtgctcagagcaaacagaaatgattttctaaaaataaggggtactgtaaaagcagtccaaggatagacaccttacataagtcctaaaagataaataggaatattcaaggtgaagtagttaaaagtctaaattacaaatatttaaaattaaattgttttgttttgtgatacttttctcttgcattattatgcatattactatcatcctttatgcatatatatatatatatatatacatatatatacacacacataggcattagaacaggaattgttcatataaaacactgaagagagaatgaaatagttcaagctttgcctatcaaagtgtgattttgagttgagttgagttgagttgagaagacaggcttgaaagccagcctttgtcagagaaaaatgaatttcatgaattcttcatttattatgaaacctctcaagaataaagtactcatattatagagtatccttcatagtatatagaagagacagcctttatacgtgtgcaatttagatcttcaggctcactacaaaacaggaggagaaaaatacaaaactagaggaaatgaaaaacctatagccagaaccaccatgagcctgaggattatgcaaagaaataatatggtggtacttacttcttttctctcactagagtctattttttattattttttattttactttaagttctgagatacatgtgcagaacatgcaggtttattacttaagtatacgtgacccatggtggcttcctgcacctatcaacccatcatctaggttttaagccctacatgcataaggtatttgtcctgatgctctcccattccttgccctccaccccctgacaggccctggtgtgtgttattcccctccctgtgtccatgtgttctcattgttcaactcctacttttcagtgagaacatgaggtgtttggttttctgttcctttgttagtttgctgaggatgatggtttccagcttcatccatgtgcctgcaaaggacatgatctcattcctttttatagctgcatagtattccatggtgtatatgtactacattttctttattcagtctatcatcaatgggcatttgggttggttccacgtctttgctattgtaaataatgctgcaataaacataggtgttcatgtgtctttatagtagaatgatttatattcctttgggtatatacccagtaatgggattgctgggtcaaatggtatttctggttctagatccttgaggaattgccacactgtcttccacaatgattgaattaatttacattcccaacaacagtgtaaaagcattcctatttctccacagcctcgccagcattgttgtttctttttaataatcgccattctgactggcaagagatagtatctcattgtgattttgatttgcatttctctaatgagcagtgatgttgagctttttgtcgtgtgtttgttggccacaaaaatgtcttcttttgagaagcatctgttcatgtccttcacccgccttttatggggttgttttttttttctgataaatttgtttaagtttcttgtagattctggatattagacctttgtcagatgaatagattgcaaaaaatttctcccattttttaggttgcctgttcactctgatgatagtttcttttgctgtgcagaagctctttagcttaattagatcccatttgtcaattttagcttctgttgcaattgcttttggtattttcatcatgaaatctttacccatgcccatatcctgaatggtattgcctaggttttcttctagggtttttatggttttacatttaagtctttaatccatcttaagttaatttttgtatgaggtgtaaggaaggggtccagcttcagttttctgcatatggctagccagttttcccagcaccatttattaaatagggaattctttacccattgcttgcttttgtcgtgtttgtagaagatcagatggttgtagatgtgtggtgttatttctgaagtctctgttctgttccattggtctatatttctgttttggtacctgtactatgctgttttggtaatcgtagccttgtagtatagtttgaagccaggtagcatgatacctcctgctttgttcttattgcttaggattgtcatggctatacgggctcttcattggttccacatgaaatttaaagtggttctttttgtcattatgtgaaaaatgtcaatggtagtttgatgggaataacattgaatttataaattactttgggcagcatggctattttcacactattgattcttcctatatatgaacatggaatgtttttccatttgtttgtgttttctcttatttccttgagcagtggtttgtagttctccttgaagaagtccttcacgtttctgttagctgtattcctaggtattttattctcttcgtagcaattgtgaatgggagtttattcatgttgtggctctctgcttatctatagttggcatatagaaatgcttgtgatttttgcacgttgattttgtatcctgagactttgctgaagtgcttatcagcttaaggagtttttgggctgagacaatggagttttgtaaatataaaatcatgtagtctgaaaacagaaacaatttgacttcctctcttcctatttgaataccctttatttctttctcttgcctgattgccctggacaaatcttccaatactatgctgaataagagtgggaagacagtgcatctttgttttgtgccagttttcaaagggaatgattccagcttttgcccactcagtgtgatattggctgtgggtttttcataaacagctcttattattttgagatattttgcatgaatatctagtttatcaaaaacgtttaacaattggggatgttgaattttagcaaaggccttttctgcatctattgaaataatcatgtggttttcgtcattggttatgtttatgtgatggattacatctgccggtttgtgtatgttgaaccagcgttgcattccagggatgaagccgacttcatcatggtggatacgctttttgatgtgcagctggattcagtttgtcagtattttattgaggtgtttcacttcgatgttcatcagggatattggactgaagttttctttttttgttgtgtctctgccaggttttggtatcaggatgatgctggcctcaaaaaatgcattagggaggagactctccttttcaattctttggaatagtctcagaaggaatggtaccagctcctctttgtacctctggcagcattttgctgtgaatttgtcttgtcctgagattttttttggttggtatgatgttaattactgcctagatttcagaacttgatgttggtttctcagggatttgacttctttctggtttagtttttggagggtgcatgagtccaggaatttatcaatatcttttagattttctagtttatttgcacagaggtgtttatagtattctctgatggtagtttgtatttatgtggggtcagtgtgtcatttttattgtgacattttttattgtgtctatttgattcttatctcttttctccttcattagtgtagctagtggtctatctattttgttaattttttcaaaaaccagctcattgattcattgctttttttgaagggttttttgtgcctctatctccttcaattctgccctgaataattattttttgtcttctgctggcttttggatttatttgctcttgtttctctagttcttttaattgtgatattagggtgttgatttaagatctttctagctttctgatgtgggcatttagtgttataaatttccatctaaacactgctttagctgtgtcccagagattctggtatgttgtctctttattctcattggtttcaaagaacttcttgatttctgccttaatttcattatttttaaccaggagtctttcaggagcaggttattcaatttccatgtagttgtgtggttttgagtgtttcataatcctgagttctaatttgattgcactgtggtctgagagactgttttttattatttcagctttttttgcatttgcggaggagctttacttctaattatgtggttgattttagaataagtgagatgtggcactgagaagaatgtatattccattgatttggggtggagagttctgtagatgttgattaggtccacctgatccagagctgctttcaagtcctgaatatccttgttaattttctgtgttgttgaactgtctaatattgacagtggggtgttaaatctctgactattattgtgtgggagtctaagtctctttgtaggtctctaagaacttgttttatgaatctgggagctcctgtattgggtacatatatatctagaatagttagctcttcatattgaattgatccctttaccattatgtaatgcctttctttgtcttttttgatctttgatggttaaaagtctgttttgtcagagagtaacattgcaacccctgcttttttttttttctgttcatttgcttggtaaatttttctccatccttttattttgagcctgtgtgtgcctgtgcacataagatgggtctcctgaatacagcacactgatgggtcttgactcttcatccaatctgccagtctgtgccttttaattgaggcatttagctcatttacatttaaggttaatattattatgtgggaatttgatcctgtcatcatgatgctgtctggttattttgcccactagttgatgcagtttcttcatagtgtctttgtatttatattttggcatgtttttccagtgtctggtactggtttttcttccactatttagtgcttccttcaggagctcttgcaaggcaggcctggtggtgacaaaatctctcagcctttgcttgtctgagatggaggttatttctccttcccttatgaagcttagtttggctggatatgaaattctgggttgaaaattcctttcttttaagaatgttgaatattggtccccactctcttctggcttgcagggtttctgctgagagatctcttgatagtttggtgggcttccacttgtaggtgacctggcctttttgtctggctgtccttaacattttttcctttatttcaaccttggagaatctgattgtgtatcttggggttgatcttctcatgtagtaccttagtggtgttttttgtatttcctgaatttgaatgttagcctctcttgctaggatggggaagttctcctggataatatcctgaagtgtgtttccaacttggttccattctccccatctctttcagactctctgatcaatagtaggttcggtctttttacatagtcccatatttctcggaggttttgtttgttcctatttatttatttatttatttatttatttattttctaatcttgtctgcctgccttatttcagcaagatggtcttcacgctctaatattctttcttccacttaatcaattcggctattgatatttgggctcacgagtgggatcttctgatctgtgggtttcacagttccatggaaaaagcacagtttcccagactaggtagcacactcactgcctcccttggctaaggggtgggatctcccctgccccatgtggctctcaggtgggctgctgcaccacactgctcttcctttctctctgttggtcatgccagccacctagtcagtcctgttgacaacctagatacctggatattggttgctggtgctggatttgcatactgttttggttctttttgatgggtgcctccaatcgctgcttcttctagtaagccatcttggccctgccccttagaatctatttttaaggacagactaataaccagcttccccaaatgttgagttgggtgtcctgaaggaagtctgcagcacctaagtaagttcagttttccattcaatatgtcatgagagaaacttcaggctctttttttttttttttatttttgattctacacagtcttggcatgtcaagggattgtggtaattcttacctgtcttaataattagatgcagaattccttgtaagacttatggactagcaaatattcaagattaaaagactacaaggcacaaatgtcttaatgcctcgatccttaagattccgaatataccccaaaagtcaaaaccagaataattacatttgacaactcatcagtccaaggaaaatattaatccagttactctacatcagcagtgacagtaaaatcagagaacttccatcctacagttgcggggcctcctgtcctgacaatctcctcactgtcccataaatccaaccctgtgtataaccattttaaaaaggaacaggagtaggtgagtaattaacatgaatcaaccacttacacggtaaaaagatctgtttaatagaaactaaattacctcaagattacttaaatttttgaatcagactacatttaccaaattgaagtaaaattttaattaccccttctcccaacttacaaggtgttttttattgttgtttgttggtttgatgtcaagttaacatttccttgaggatcctgctcttcatagtgggtcttcttaagctcacagtttcagctctgagaacatttgtggtggtagatgagagtggcacaacactggaggagaggtcaatagtatctgaggtctgtagtatcactgacttgcacacagagtgtcacagattttacagtgtttctcagttactcttgcatctcctatcaggccataagcatattggctccaagccaacaaaagtccacataccgccagtagcttaatagttaggcataatgtcctaagtaggactcttctggaacatcttgatatataattggtgtcgtgctcctgtagtaccagatactcaggaggctgaggcaggattatatttgagctcaagaattggaggcctcagtgagctgcagtgagccattatctggccactgcactccagcctgagtgacaaagcaagactgtgactctaaaaaaatacataaacacataataaatacataaataacaatgatattgatatacaaattgtatttttgtttagaaaggttctcagaaaatcaattgtagtgacaattcacaaatccagaatactatttttggaattagtcctgttataactaatcagtgtagactgtggtttttaatgaagcctagctttgagttccagtagttccacctctgatttcccttatgattcatgaaaataaaaaaagataaaatagcatattagatgccagttattttgctgggtgctaggcacacgaaaataagttagaaatttttacttcttaaggactcaacaacccattgaactagttcaactcttcctaccttttcctgtcatattattttttctcctcctacttctttacagccttgattttgtgtaaatcgcaatgcgcttgtttaatggtgcctctgtcttcattttgggccttctggcacattattatttttttcaaggaaaatctcttcatgaggtctgaaattaccctggtaaaatttttttcttcttgtgaaaatagagattataagtttcttaaaacctttcaccttttacttaattaagatgatctattgttaggctatcttcatttgtaagcacttatatcagttactatcattgcaataatgctgctaaaatatccactctactataaaataagaaatatttatttatttattgctctttctttctgtgaatcaacagcaattagttcaatgtagtgaactggcctgtggggctctgctttaccctgttggctggctgggctttggctccagaaagtggatctaattcaggtctgccccagggtctcttatccttggagcagcaaatggcaggagtaccagaaagggaagcagaaatatgcaatatctcttacgaagtacaaagcttttgtcaaaatctctcaacaaaagtcttatgggaacttatgcttatctagtatacatcatagcataaagacttctgctttacccaccctaaacaagaaattataattttttaaaatgtgtataaagtataaatactcatgaagtaagagattttttagactttgcctcccttcacacttgggccactacatctttctcagactttccttgtctttctcccacacccaattctttttactccaaaccttaatacaaaaacaaaaccaaatgttaataaatacaagctttttccactaagaaaaaaaagttgtaatttctatatgtgactggcgttgggttaatgtgattaaaaacataatcggccagtacagaaagcctctccacaaaagcagtatagaaagaaaattatttttattattggataagcatgaaatgagaacaagatgtgcatcttaggcaatctgctaaagagattgaaaagccagaaagacgtgttacccttttaaatagccaagcagatacaacctcattagacacatgttctcacaagaaacagtagtttgttctcaagtaaaagaacttgacaccactgtttgtcactcatagtttatcttaaattcacctataattggggtgaccatctgtgttggctttattcaaagaaaaaataaattggctttatctgaagaaaaaataaaccccatatctttatggcaggaggtagttctgcaacttggcatatgttggactcctaccttttcacagaaactgggagattgcagtgctgtcttcctagatggttatattttaaagaaatggcttacacgtccttaaggaagaatttttaaattttgagactattaaagggcttatttagcattttaaaaattacatatacttgcaaaagaaaaatctgacaattacagtttttctaaagtgagttatctgagataaagggaggtgaaaaggagtctcttctcttattttcaacaggagtcttctctcattaaaaccctaacactaaccctaaccctaaaaaattaagcctcttttcgttttgtgcttgcccttacactttcccttcactttctaatagacaggagtttattctttgtttatatttactttgcctaaaacagcagtcccattttaataatagatactagaacaggaaaacaaaattgttgattgagaggaaagttaaactaaatgacctttaaataagcttcagaaaggactagaattttataaaactcttttctttctcaattttagtatttttttctgtttctctgaattgtaatttcttaatcaatataatttaaattgaactaaatacctttcattaaaaaccaagtgtttattctgattgtttgttaatcacatctctattcttccagtaatctctattcaaaatgtagttaaccttccccaagcgtgtcctaaggaaacaagtcttaagagatactcagtgaacagatggccgcggggtcaaataagctttagaaaatatgtgtacacctatttttcaatataaaagtcgtactggttaatgggccattaaataattttggtttggggccaacatttactttttatgtaatggaatagaaaatttcagaaggcattacttataatacatttatggggatatgtattttactatgaaacgtattttgcagttatttatttttgtgtgtgtttgttggcatgtgtatatgagctcggattgttggaaataaatgaagaccatgcaaatgggaataaatcaaggctacttattcagagctttctgtagcaagggaggcagccaccatcacttgtctttggcagagacttaaacgcagtcaagagaatgggaaaactttattagttaataaagaaggaaggattcagttatgctttagctggaggtttttggtatggggaagctgaagataagctagctaccacgttagtgtgagcagcacatttggctttcttgattgatcctaagttggaagtggaaagaaacatgaaaaaagttttctgtcattgaccaagtccgaccttttttgctctcgattgttgcagaggttgtggtttagttccctggatttttttttgtaggttttttttgctctatcgtcctgtttggtgtggtggttttccaatatatattcagtccttcagattaaaaaaaaaaaaaaaaaagaagcattaccctaacaacccataaaacttgttactttgccatatatttttatattatttttaacctttaatcttccttctgcacttcccacttcaaacaagttgcaagttttatcctgtctgttaccatgttttggtctccactctaatatcctttattttgtgctcctttaattattccaaaatgaatcccaattcctttcttgcgtctgctcttctcatagatttaagattagttttagttttgtttcttatttattctaaaattgctaatatcttttccaatcttacacaattaactccattataaccagatgtaagacattctctaccatctgggtataatttacttttccacttatatcttgaaagctttttcctttcaaactttgatatgcctccttcttcttctgtactataattactaaattccatatacaaaagtccttttcattcattagggaccatatgaaatttaacttccttgaatcagtctcctataatcatccctacactcacctagtttcaacatgaaaataactttttctccctctgaatttctaaaacaccttgaataaataacaatcatttgtgtcacattgccttacatttaaattaattgtatatcatgtaactaataattttctttatatacagaatctttattttggtcaactttttaaattttacagcctatgtgcagactatgtctggcatgtactattgttaaataaataaggccaaacatctgacttttgaaatttatttttcagtctccaaacagtatatcccaaatacaacttaatattcttttaaaattatagagttctttctagaatttataagagttaaaatgcggataatagtaagaagttacctgttatttcaaattcaaactaaagattattgattcaggattctcttttgagaataaatttttcctggacacacagccccaggagcgtgaaagatagacaaacacaatagagaagtagttttcaaaacaaccctcaaaggttgaggaaagaaatcagctccaaagacctagtattatattgttgtttttatacccatcaccaattttccaaattgcctgtttaactgttgtatttatttccttgagaaaatacctagtcccattcatctaggaaccacccccctcccgccgcaccaccaccactaccacccccaataattagctcagcacagatgcagtctcaataatggtttattaggttgcaagaggttgtgctgatagccctttaattttataaaggactaacacagtatcaacatgattacttttaaagcaaaaggcatctgctgctcacttgtttcactgtcacttttcttaatgtagtctttcataataagtaagagtggtttatccttcttacttgctttatagatatacaaaattatatttccagataattataagttcatttaccatctagtagatacagtaagagcaataatgtttcaaagtttttgatggtgactattgggctgtatgcagttaaggttctttcaaaagaaaaatccatttactttgattgctattatagttcaaaaaatattgatctatccttgcttgcaaactcttttaaacaggtagctacaggatttagacaaaaatctatattccactttgttctttcattcaaggtacttcagagaaaatgtttaaaaaatagacaggttaagtaaggttgcaagtgaacaatgccatgttgaatctttttataaaaagaaatgtttcctgatacttccattttactgctctattattagattataaactcctaagaaagtagtgtcatgtctctttaattgactgtatatcaagtttagttcatttcacatgataatagtgtgacagttgctatgtatggagtatttggtgtgcacagccagaatggttttctctccttataataaaatcaaaggcccttaacattggacacaagggtagccccacatctctctagtctcgtgtcttacctaaccctccctgcatctgaactccagttctactgagctgttgaatttttccaaatgtgctcttttgttcacactatcattcccttggtcaaactactctccatacctaaaaagtcacgagctacctctacatcacccccaatacacacacatccatgcaaatctttcaaatcttagttcatctttctgttataatcttttttgtctttctacttcttggcagaattgtttattttttttctccatattcccaatacattttatgataaaattacattatttattagactttttatgtacttgtatgcttgtcttcttagtaggcaataataaattgtcttattcacttctgttgtcccaacatttaggacatagtacaatttcaagattttttttttgaatagtgatagatatttgaatgaatagatgaatgaatgaatgtgtgaacaagaaaggtcagagtatctgaaaaattgataatgaagctataattagctgactcactggatgatggaatctactgatttgagatttttacaatgaaagtgcccttgagcatatatctgagtttcctatcctcaagtagactgttacattgtgcatttgtcacagacacagtacctagtcccaaactgaggacaaatgtcaaggagttcctttgaagaactttaagtatataaacaatgggctaagtttttttaaaatgctacctcaaggcaagtcaaggaggattcccttatcacttcatgtttcatctttaatagtctaaactataatatacccagtaagtcagaatatataagaaatgcactaaacttttgaaatcatctcagagttttaaaacatttacattttttagcaaaggtgttgaccagagtatagtccattttttatcttgaaaaatgtgtgccagagaattttaaaatatattctgaatacacctatttggcagctcttatagactgtatcctttttaagggcagagattatggcttgcatcttttttgtgatgcaggggaggaaaaatttctcctctaccctttttagggtatctgactaggcctaagaaacttacatgatatctcatgtcagattaacgggagaaaaagcatgtaaattttataaaaattttaaatgtacatgagagtcctcaagaaatgaagatccaaagaagtgaccagagcagaaagcttatatactttttagacaaagaaatcctaaattcgtgaagaaatgagaagacaaggggtttgggctggggcattaacttgtggggaagtgagtaagatatactggagaacactagtcaaaggtagagattattttagcaagtttgttgtgcagattcatttcagtgttgatttccactctctagtgataaagatgttcttttcttcctaggatatctttctcatgggaaatttcatggcttgtttttaggtaaaagagaagaggtcagaaagttcgtatctgctgttctcaagtgccttcatctcaaaataaacaatattttggggtagcatgtcccgaactacttcagcagccatagttcctaccccagttctttgtacacagtatatgctctgtaaatattgaactgaagtgaattgatcatacattaaagttgatgagactagccttaacatttccttaactaaaccacttataatcatcaagaagtgtggattttttaaattcattcccactatatcccatttaattgttttggacatgaaataaatttataagctggggaactattatgttagagcattagctcttgattttgaaatagtcacattgtggagcgtttcaaagtgttatgaggtttcaggaaatatattactactaataaataatgtttgaagtacgtacatttgtaaattatatatttcattttaattaagctagagaacaattagtcttatccataaaaataagcttaatcccacacttgtgtatttcaatgtattctcttgagagagagagagaggatggagctacaattattaagcagagtcttgcataaaactctcggaaactcacaaccagaaaaaattttgataatcatcgggttgcagcaaaatgctacataatccaaattcataggtcccatacctatgaagactggcaaactccttgtctgtccacagacatttcgtgcaggtcttctagccatcctgtaaatttgcgatctaagagctgagttgacgatataaatggcttgtgataaatactcagtgcaatcataaaaacaacttcacgttaatgatatttcaagtaacatatttagagtcaaagaaaagcatagttttttatcacagttaaagagttctgaattctgttaaacatattaaaatattcttgttgggcttggtggttcatgcctgtaatcccagctactcagcagttgaggtggggggatcattgaggtcaggagttcgaaaccaagtctgagcaacatagtgagagcctgtttctaaaaaagagagagagagagaattaaatatgtattttttagagtgtctctatttgctgtatctcaaaagagtgcatgatttaactactagctgcagatgttctatattagctctgtgtaaaatggaaacccgtgtcccagggcatacttgctgccattctaaattttgcatatttttattaaattgttgtactcaatctgaggcattttaaatgtcagtgtttacatcatgattgtaaaacacttcacacatttatttattattgtaaatatgcctttcattactttctgtgggcagttatagatttcctcctcaaaacctctctaaatattgactatagtctcgtttgtctgagatgcttgaaggtgagacatggtttaactcacaaggtcttttctagctgcatgattctatatttcacaacctttgtaaacccgttgctgaggtaatgagattcccaaaaggcttcttaacattaagaatcagcaaaactgcaagttttacagatcactctcttttaacctacacagtttctctgtgaagtatttgaattatagtgtcaactgttgtcaagtcagagattgatcaatgagtagttctatgtcactttaaggccagatgttattatttggctggaaatctgattgaatttaaaattagggtttattactttagccatcaaggatcaaagttacttggtcactttaaaaagtgttgaaaaagccttgtttctacaaattttagccactgccatttaaacctatatttccaatattgctctgaactcactgcatgagagcattctgactgctctgcttttatttcctctgacctcccagtctaattcatttcagcacctcttcccctgcttctgatttctttgcctgcacagcagggaagaaaaaaagagcagaatcatgtgctactctctatgggtgctaacctctgaccctggggatggatcctcactttgtttcttccaaatttagttgtggatgatgcacagatatttagctgacagtggaggcaacatgtattaaagaaatcccaacctcattttatattctgaaagacaaaattattataacaaaatcaagtaccagtaggatgctagctaaattttttgtgtgtttaattgatatttcaatgataaattatattgtatcattaagaaaccctgcaggaaacaaatgacacattcatactgggtgtgtgggggtagagcttaaggaaactaacaaaggattgtaccatatctctagctattgacagcagggagccactagtagcttcaggaatgataaccacagcttggaggacagcggtatggagtgggctgccttacataagtgtggctttcactaacaggacacagccatcacatagcgatcaggcaaagaaggaactgaggggaaataccctacttcacgcccctcctgacctcctcaccctactctcctaccaaaatgctgctcactgcctgataactctctgttctcttacccacagaaagcctgagagcatagggtcctggctatcatgggaccatggggatcagtctttaccccccaccccggaagtaggaaagaagtgcaaaaagcgagcagagaaggggcagaatggctttagtgggtaaacagaagatatccagcactcatatctttcaattacaagacaactatacaatttaaatcattcaaaagacgtagctgaaatatggattatcctatgattttctctaactatgagattttgtgattgcttatattatgtattaagcggaccatatacttttgtatgttcttgattgccttccttccttctttatacattccacaactgtttcttgaatattaggctctgagagagggtatagtgcttaagaactcatatcctggaatgacactgactgtattcaaaagccagctctgccacttaaaatttgtgtgtcgttggacaaatcctttaacttttggggtcctcatagggctgtgtcaggattaaatgtaagagcctagaaccgtgtgatacataaatcatatgtaagtgtttagacacttgggatacaaagtaaaaaataaataaaaataaatataaactcatgggaaaaagacagatgagtaaatcaataattatagtaaaatacttggaccaatataggtatgtccaaggcctatagaagcccaaagaaaatagcaattaacagtgcttgcaagctcagggcactcattatggaggatgtatagtttgaccttaagaaataaatagcaatttcttcatgttttatacactcagagaatgccttcttttcaggcagagaagatgtcatgcctcagggcacagaggttgaaagggaacaacaagtgcttcaacatgtctaacacttaggttgcttatgggaaaatgatgggagacaggactggagaggtaggaaaggctgagatcatgaagggccctctatggtaaggaagtcgaagagatctaaatagttcccaagttaccttcagagtgtgcaggggtggaactttggtgggccaaaggagtagagacaaaaaaatttcttaaaattaatatgaccatcctttccctttcaacagtggactcaaggtatcctttcctttccctcatttttcccagtacctggcttacagtgtctcattccattctttctctcgattatcatgggacaatagaaaagagtgtgggcatgagtagaatctcagttgagctatttctacatatataactgtggtcagcttctcagaacttcagttttttcatcctttaatgggaaataatggtgactggctaatagcactgcaataaaaattacatgagttaaaatgattatagtattcagcaatccccttttcaaaaaaatcactaatgtcagctaatattcttatcttcctggaaattacatccatgtttccaccttaagatactctaatcccctaccttgtctaccaatttgtttgccagtcgtcactcacttgtattagctttaattctctagaaaacatagttgaagcaaagattatagactaatactttattgaggagcttgggaggtgtatttctaagacagcaagaaagagggggaaaagttatataaacagagaaattggagaatcaaatataaggtggtatgttactgagctggccacagcctcacaagaaacacagctgaatgtttaattatgtgagccatgtggaccagttgtgctttagaaccatctgttttgggagaggaagggttagaaatttatctactggtctccttcccatctcttctcttgctccttgatggtaaaatttcatctctcaggctttaaattctccacaatttgatgctgctatccagcccctgtaggaagattcctgtgttcctgtggagtcaaatctgggtactggagctgctatagtagtttatgttgcaattgacaagaaaacggcaactgttaccatggttgttctgtccgtaagcctgcatgagcctgagacaactggtaacattagaagaggagccaacagaaatggtcatgagtgtcacttctgtcatattctcttcattaaaatctaggcaacaatactggccaataataaaaaagaggggaatttgactctaccttttgtttttttgcttttgtttgtttgtttttgagatggagttctgcttttgttgcccaggctggagtgcagtggcacaatctctcctcattacaacctctgcctcctgggttcaagcgattttccagcctcaacctcccgagtagctgggattacaggcacctgccaccatgcccagctaatttttgtatttttagaagagacggggtttctccatgttggccaggctgctctcaaccttctgacctcaggtgatccgccttccttggcctcccaaagtgctgggattacagccatgagccaccatgcccagctgactctaccttttgatagaagcatcaaataatttgcagacatgttttaaaactactacggaatgatttgagaacaagttgcaaacataatagctcatcattcccaaatattcagtttgaattgcaccaaaacaaaaaactcctttatgtaaccacaaaacaaccatacaaatcagaaaatcaacataaataaaacacttccaaacaaattaaaacccttccaaatttcactaactacacacacgcacgcacacacacacacgtgtatgtttttttcttgtccaggattcaacccaagaacctgcattgcattgttgtcatgtctctttcatttccttcaatctggatgagttcctcaatgtttccctatctgtcatgaccttgatagctctaaagagtataagccttttattttgtgatatatccctcaatttgggtacatacaatattttcccatatccaggcataggccacacattcttgacagatgtatcacaaaaatgatgctcgcctctcaggacatcacaccaggaggcaaacaacgtcaatatacctgaatatacgtcctatgcgatcattagtcacctagtaaaattgatgtcttccaggatttttcatgagaacatcaccaatttcacctttgtgatttatatgtgtttcacagagaggtaatatcttattttttatcaaacatccagccaaaaatccacaaccactgtgatggttgccagatgttagttttctctttttttccccacttattctgtatttattaactgtccctctgtgttcggaattggttccttccggtgggttctaggtcttgccgacttcaagcatgaagccgtggaccctagcggtgaatgttacagatcttaaagatggtgtgtttggagtttgttccttcagatgttcagacgtgtccggagtttcttccttctggtgggttcgtggtcttgctgacttcaggagtgaagctgcagacttttgcagtgagtgttacagctcttaaaggtactgcggacccgaagagtgagcagcagcaagatttattatcaagggggaaagaacaaagcttccacagcatggaaggggacgcgagcgggttgctgctgctggcttgggtggccagcatttattcccttatttggccccacccacatcctgctgattggtccattttacagagtgctgatgggtccattttatagagtgctgattggtccgtttttacagagtgctgattggtgcatttacaaacctttagctagacaaggagcgctgattggtgcgtttttacagagtgctgattggtgcatttacaaacctttagcgagacacacagcaccgattggtgcatttacaatcctttagctagatagaaaagttctccaagtccccacctgacccagaagcccagccggcttcacctttcacctctttatggagaaaatgttttcccttctgtcccatttatttatttatgtcagtatggatgaatgcatttaaattttattcaatgtgttgtactctgccattatctttgtttgatggttaaattgcaccagaatagccaatggagcttcttcaagctggcctctatgtccttttgatatgtccccaccatcattctttaagtacaccctacttttattggcacaacaaggtattccagtttcatcttatctttttccttgtccatcccctaaaatcagctcccctggttccctttagtgaagaatggtatgtagaaaccaaatctgggtactcaatatacttgtttctatagagctttattgcttttaggactctcagtggatgcagctagaaaatatgtgcacatatatgtgtacatatgtgtgtatgcatgacatatgtatgtatatccacccatttatatctagttatattcatattttaaacttgagttcacacgattttttaacatttcagtttaaccccttagggttctttgtagtcttttctgtttctacatttgtaaatgctcttttttgttagtgagaagtctgtctgcccttatcttcaatatttctgattctcaaccttcttcacatatacttaacctcccaaccttaccggctgcctttttagcctcacttctacttctctggccctcatccataataccacgtacttgaccctaatatctcctcaacctctggtgccactgccactgccacctaactctacccattccactttgaaagaaaagggaagaaaaaggctttataccttttctgatactgccctctctattcaggatactttttctttcttttgtccttcttagtctactcggtgagataactctgaaaatagctttagggttacctcttctgtgcagtctttacctcttttccaacctccaaatccaaggagacttagctaatacctcctttgtgccttcagttaaggacaggggctacattttatttgtctttatatccttagtaccttatttttttttattatactttaagttctagggtacatgtgcacaacgtttgttacatatgtatacatgcgtcatgttggtgtgctgcacccattaacttgtcatttgcattaggtgtatcacctaatgctaaccctcccccctgcccccaccccacaacaggccccggtgtgtgatgttccccttcctgtgtccaagtgttctcattattcaattcccacctatgagtgagaacatgtggtgtttggttttttgtccttgtgatactttgctgagaatgatgcaaacatccacgtccctacaaagatccatgtccctacaaaggacatgaactcatccttttttatggctgcatagtattccatggtgtatatgtgccacattttcttaacccagtctatcattgatggacatttgggttggttccaagtctttgctattgtgaatagtgctgcaataaacatatggatgcatgtgtctttatagcagcatgatttataatcctttgggtatatacccagtaatgggatggctgggtcaaatggtatttctagttccagagccttgaggaattgccacactgtcttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcatttttttcatgtgtttgttggctgcataaatgtcttcttttgagaagtgtctgttcatatcctttgcccactttgtgatggggttgtttgtttttttcttgtaaatttgtttgagttctttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtattgcctaggttttcttcttgggtttttatgtttttaggtctaacatttaagtcttcaatccatcttgaattactttttgtataaggtgtaaggaagggatccagtttcagctttctatgtatggctagccagttttcccagcaccatttattaaatagggaatcctttccccattgcttgtttttctcaggtttgtcaaagatcagatggttgtagatgtgtggtattattcctgagggctctgttctgttccattggtctatgtgtctgttttggtaccagtaccatgctgttttggttactgtagccttgtagtatagtttgaagtcaggtagcatgatgcctccagctttgttcttttggcttaggattgtattggcaatgcagacccttttttggttccatatgaactttaaagtagttttttcaaattctgtgaaaaaggtcattggtagcttgatgaggatggcattgaatctataaattaccttgggcagtatagccattttcacgatactgattcttcatatccatgagcatggaatgttcttccatttgtgtcctcttttatttcgctgagcagtggtttgtagttctccttgaagaggtccttcacatcccttgtaggttggattcttaggtattttattctctttgaagcaattgtgaatgggagttcactcataatttggctctctgtctgttattggtgtataagaatgcttgtgatttttgcacattggttttgtgtcctgagactttgctgaatttgcttatcagcctaaggagattttgggctgagacgatggggttttctaaatatgcaatcatgtcatctgcaaacagggacaatttgacttccacttttcctaactgaataccctttatttctttctcctgcctgattgccctggccagaacttccaacactatgttgaataggaatggtgagagagggcatccctgtcttgtgcctgttttcaaagggaatacttccagtttttgcccattcagcatgacattggctgtgggtttttcatagatagctcttattatttttagatacgtcccatcaatacataatttattgagagtttttagcatgaagggctgttgaattttgtcaaaggccttttctgcatctattgagataatcatgtgatttttgtctttggttctctttatatgctggattgcatttattgatttgcatatgttgaaccagccttgcaaggatgttcaaaagtatctctaaaacatattgtttggttaaaaaggagaaagaaaataatattgacagtataataaaagttaaagtatgatatacataacacaatactgcatagtttttgtgaagataatttttaggtttctataacgttacatattagatatgtctgtgtggaattatacatcttgaaaaaagaactggaaagatacacattaaattggtgctagtggataacagaggagctaggaatgtgtcagtatttgagtgtcaggagagacttagcatttgctaagaccattggaaaagctcagtattagagtggaagtgacccgattttccaggttccgtctgtcacagcttcccttggctaggaaaggaaaatccctgaccccttgtgcttcctgagtgaggtgatgccttcccctgcttcggctcacactcggtgggctgcacacactgtccgacaagcctcagtgagatgaacctggtacctcagttggaaatgcagaaatcacccgtcttctgcttcgctcacactgggagctgtagactggagctgttcctatttggccatccttattttattttttataaatattagaaactaagtaaaggttttataaatgaataactagtgaatgaaaagttctccacaatagcatggtgattaagactttataaaaatctcaatttatgagatttaggtggagagacaaagcctaaccatatcactactgcataggaaaaaaacccaaaagcagtgttacatactaggtgcatgtttactttacttactgtgtattgtttccagtctatgttagagagtatttacagcttcattaaatttaaaatatgttcttaattttaaagagtgttgtattaatggagcaaagaaaaaaatagagtttcaaatagattaacactcactctcaacactaaacccaagataatagaaagcgtatttaaaaatataataatgactaagaatgaaaagagaacatttacaattgttttgaggctgtagggtattcctaagataaataagtgtaaataaacatataaataaatgtttgttatcattgttttttcttgctcaaacacaagttttgttctcccctaaactacttcctcctgtgccttttcatcataggcataacagccattatgattcactgtataaattttcaaatatgctgcattagaataaagttcactctgctactctctaaatacacttctcattaaatccaaggaaacagagttaaaagagcaataagaaaatattttaaaataattagagtagataccttcacaaaattaaggggggaaattgtatttatggaaaaaaagaagactatgaaacaataagaaataacaatcattaaagtcattaaatatttaggaaatgacaacataatttttcagtatttaaggtaatttgtaattaaataaaactaaacagtgaattagtaaactgaaatttataatatataaatatataaatgtgtgtgtatatgtgtattatatacatatggaattattgaattcttctagaatgcaaaatagagaatccctaaaaatgagaagttgaaagtttgcgcaacatgagggctaaattcctaattttcaacattcaatatgaacaagtttcagaaacatgaggacatataataaacaacattttaaaggaaataatggtaacaatttcctagaactgaaaaaaaagttacaaggtatttgacagaagtagtctattgagcacctagtagaaaaaatagatttaaaaatgagtatatttaaaaacagcaagtctgaaaaggaatcctagctcttaaaagaatggaggagaaggggcagattaattatgaaagaattaaaatcaatttgatatcatatttcttatcaggaatagtggatggataatagactagaggaaaacatctttaaatgctgagggcaaataattttgaattaaaattttataccttaccccctattattcaacagtgaaggcaaaataaagacattttcagatgaagaaggacctattctttcaataacagaaacaatttttcgaagaaggtataagagtaataaactgaacctagcaatagtgtcacccccaatcacctagcactttaacacaactacttcctgtttaatcttttccttttctgtactatatatcacattctaaaataagacattatttgtttattatttatagtttgcaaacatccaatggaatacatgcattcatggagcagaaatccttgtctgtttatttattggtgtatcttagatccctggaacagcatctgacacatgtaaatacagtagtccccccttgttcataaggatatgattcaatagccccaatgggtgctttaaaccacagatagtcctgaactttatacaggctatgttattttctctcgatagatagatagatagatagatagatagatagatagatagatagatagatagatagatataaagattaatttgtaaattagacacagaaagagattgataacaataactaaaaataaaatagaagaattataataatatactgtcataaaagttatgtgaatgtgctctctgtctctctcaaaataatttactgtactatacttacctatttttggaccacattatctcaggtaactgaaaccacagaaagcaaaatgcagataaagaggaattagtgtataagacaatcaactgtttgttgtataaactaactaactgaatgatgctttaaagtatgtgaaatgaatttgattcaactattaaaaaatgttgtcaaatccacatttggaactttaacaggcttcttcaagaagttgttggagccagtagacattgaaggcataaataatttcaacttgattaatataacaaattgaactgaatatatttcacttatttatccactgcaagacctcgatatacatatactgaataccaaagaaacaacattagaaagcagcaacaaaatgatagatcaacccataaattttaaaacactcagacattatttatgagttacaaagtaaaccaaaacataagctacaaacttttcacaagtgaacaataaaatctctccatatcaatttagagctaaatttattttattttttaataaataagaaaggctgaaaatatactaaaaaagttctaagatttcaactcaagaaaacagaaaaaagaatagcaatataatccaaaagaaaactgaagatggaatccaaaaatataaaaagaaaagatgtttaaattaaaataaaaacaatagaatttgccgggcgcagtggctcacacctgtaattccagcactttgggagaccaaggagggcgaatgatttgaggtcaggagttagagaccagcctggacaacacagtgaaaccccatctctactaaaaatacaaaaactacttgggcatggtggcacgagcacctatagtccgagctacccaggaggctgaggcaggagaatctcttgaacctgggaggcataggttacaatgagccgagatcacgccactgcacttcagcctgggtgacagagtaagagactctgtctcaaaacacaaacaaaaaaacaaacaaacaaaaaaacaatttatcaacagcaaacactggttctttaagccacctaataaatctgacaaccttttgtaaatatgaagaaagaaaaccagaaagtaaacactaatagcattagaagtcagaaataattatggcatatttataaaggagatattaaaaaatcttgtaacaattctgttacaactaaactaccagcaaaccttgaaaaatgtcacttctctaatgtttataagttgccaatattggcccaaaaccctctccaagaaacaagcaaaagaaaaaacaaacaacaacatgaaacacttaaataggaaaataacctttgaagaaaaaaaatggtactcagatggctaccaaactcatccatgcaagaatccaatttttttctggtacaaattaacctaaagactagtaaaatgtggaaaattactaacatcttcccttgatattaaaactagatatgaagagcagaagaaaaaagttatagaccaatgtccctgatagataaaaaaagtctaagaaaatataaaatcaaatccagttttttaaagaaacgtttaaatgcatgtatgatttctgctaaggatacaaggatgttcaatagtatctctaaaacatagtgtttggttaaaaaggagaaagaaaataatattgacagtataataaaagttaaagtatgatgtacatgaaacaatactgcatagtttttgtgaagataatttttaggtttctataatgttacatattagatatgtctgtgtggaattatacatcttgaaaaaagaactggaaagatacacattaaatcgatgctagtggataacggaggaactagcaatgtgtcgatatttgagtgtcaggagagactataactttatcttaaagttacatttttttaatttgtatttttttttactattgtttgtttgaagacaactgtattactaagattttatgtgacttttaaggcaaatcaaccaccacaataatttactgctaacattcatagttaaacagtgatgatcccagatatttgaagtttctttggatacatctcaaaggttgttttaatggtgttaaaatatttttttcaatctctttccactcatccaagaaacatttattaaggaacatagctgagtaatttggaattcaaaactgattgcttcctttgagaagattttttttttgttgggggggggggtctagttgggaaaataattcaaccaactagtaccagagtgtggaagagatcttaggtgagaggtattcattgatttctgtaggagtatagacacagagaatgttccctcgtgtcctggtcatgattcagggatttaccgtatcctgtagaaatgacaagaataagaaaagtctttgggatttgagggaaatatacatttatgtctatgtgtgtgtacatttatgtatatatgtagtacagagagaaaatatgagatcttatcataatttttctgttaagtacatggcctctggcacctcattagctctgataacctcagattcttcatatataaaaagaaagaaatatactaattattatctaaagatcattttatcatgcctgtaagaatggccaaaaaaaaaaagattggagaatatatttattttttgttctgaaatatctccacaacaaagagcatatatctacctaacttgtattatgggtatcatatgcctgcaacccttggaaggtgacttttatcttctatttttccagaaattgagaaagaaagttgtggtgatcctggtacacccttatatggaattagagaaggcgatggattttctaatcgtgatgttttaaggtttgaatgccagtttgggtttgaattaattggagagaaatccattgtttgtcaagagaataaccaatggtctgcaaacatacccatctgtatctgtgagtaccaaatgctttgcttccagatagcatatgttaccctgtccttgcatataattgcttttgtaattaattgcaaagagctgcaaccgtgtaattatttttgagtgagtagcactttgtgatgctatctttaacaagtgtgcttatgccaaattataaattttattacagatttaaataaagttaacatagttcacttggtaatggcaaaatatatattacgtgtgttcttacaacattttatttcatgacattttatactttctagagagcatacttcttatggaaattatacatctgaatgaattctaatagactcatttattttaataagatagtatatgtttatttgcaatcaaaaacattaaaatatttaaagcttatattgtatgtataatgcactaacttatttttgcttgtagatgttaacactaatgcatgaggtgccatttttttatattgcatacaatacaattcattaacattaatgatatacaatatgcttggattaaaataatgtattcaaatacattaagatattgcagtttaactacagcaaaagtataatttgtattgcctattcacgcacttggtgtgctcaattaaatgctgtcttcaatacattaaaatgaagtggatatttttagaatctggcagaaatttccctaataacaatatattgtgtttgctcttcaggaagtctagaagaggaaaagtgcatacgtccccttcacagtccccttttgttttagttcttatctttaaccaagattacttggtgaagttcttgtaagagaagaaaatatattaggaggatctgattcgatttaccaaagcttagtaatacttcaaaatacttttgttgacaatttttaattctaggtgttcttctaggaggacaacgttggcttaatactggagaatccattagtgtaatatatcacatcaaaaataaaaatattttaagagcattttaacagattccaaaaggcatttagtgaaaatactgaaaattttgctgactaaaaccaatttttaaaacattcttgaatactagaaaacattttttactattttaaaattaggtctgatatcctgatatatgataaaaatgtagcgattaataatgttttatataccagtaataactaacttggaaatacatttaaaagagaatacattcagaaaatacaattataaaatacaaataaataatcctcacatatttcaaataactcatacaaaaaattataaaacttacaagaaaataaaattttatgagaacgaaatacagatagaagccatgttcctgaatgataaatcactatttcaaatacatgagttatacagaaattgctttgcaattttagtcaaaattctaacatagtttttctgggaacttgacgtattgtattgacatatagctaagtaataaaacaggcaggagtagatacaagaattttgtaaaagcaaagtgcttctgtggatgcttaagtatcatcttaagttatgagtgtggtactaacaaattgtgaagggaagttacataaaaactgcatcttatataattaagaatttaaagtatgatataagcatctatctatctgataagggccattaaagtgtgtctttggttagctcttgctccaagtggggatcatttagatcaggagatggcaaacagattgtgggccaaatccatcctcctttccatgtatttttaagcaaagttttattggaacataaccaaacactttcatttactgattgtgcatggctgccttccagctacaattgcagaattaaatagttgcaaaggagatcgtatggtttgcaaagccaaagcatttattacctactccttttcagaaaaagatttccgacccttaatttagatcaggagttataggatcaaattattccaggatgcaggcaggaaacagtgtgaagagggattaggagtaagtatgtgtgcacccattttggaagtggtaggaaactggggtgccttaacttttcaagataagctagaataaaagatgttttccccttaaatatgaaatatgatgatttttcaatgtgatttcaaatttttatgggggcagaagaaaaaaaaatcaagccaaacacatctgcaatctgaattcaatccaatgactgtcagtttgcaagcttcagttcaactcataaaattatgcagaaaataaatagattcaaagtacaaaatatttttgaatgataaaatgataaaagttataaagagagatatatctgttggtagatgcagctatacctatggttttatatttgtgtagataaatagatattggtataatgtctgaatgttaataaaacatatgatgctaaaagattgtaagaaatgcgaacaattattttaatattcaaattaaaacaaataatttatgccaaaatactaaaattacaaaataatgagaaagttttatgcatattataaactaagagatcataaacttaaatgatcagtttatgagcagataattttttaaaagaaaatgaaaatgtctaacaaaagtaagaaatcttcaacttctctagtagtcaaagaaatgcgagttaagacaatgagttatcatttttcttatcaatggaggagaaggaaaataatcacaatattttatactgttacgggtgttgtattctctgatatttctgttatttttcaataacgtcaaaataactttaaatcagaaatttagcaaaatgttttgaggcttaaattcatatcctttgtcatactaagtgctttttttgaaaatgtataccaaggaaataatgaacaaaaaagctttcttcaagaatagagtcagtgttatttatattgcaaaaattttaaaatacaattttaaatgtcaaacactagaagaacagttcaattaatgtttatatgtccatataaattaatggaggagagttttaactaataagtataaattttgcttaaaaactcgacttgaaaaactcacatattaaatataaggaaaacataatttagtacaaaatgtagggaattcaattttttaaaaaatatgtaataaaaggccgggcacggtagctcacgcctgtaatcccattacttacggaggccgaggcaggtggatcacttgaggtcaggcgttcgagatcagcttgaccaatatggcgaaaccccatctctactaaaaatacaaaaattagctgggcgtggtgggcgtgcctgtattcccagctactccggaagctgaggtgggagaatctcttgaacccggaaggtggaggttgcagtgagcctagatggtgccactgcactccagcctgggcaacaaaatgagactccgtctcagaaaaaaaaaaaaaaaatgtaatgaaaactttggaagataatatatcaatacttaaactttgatttcctttgagtagtatgtcattttcttttctgtttctttatttttcctctgctttctaaatgttctatgtgaactttcaaatcacatgtttttaaaagttaaaaaaactggaggagaaagacttcattttagtgtgatggcaagagctctcatttagctgttcttcaggttttagccactaatggctgttaaagaagttagtttatctccttatttgtgtagtaaactatcagagcatccattgccaccatagaaatggaactcacacattgataaccatccccttgagtgttttctgagctaccggattcttgttctgttaatatccacataatattttttgtcttcaatcatttcaagaaccttattgctttctatgggaacttctgtatattttttcactttttaaacactgaaatgaacactttatacagtctaacataaacaagatatatgtcaaaaaattgctattattccaattatatttttgtgcattatttaagggtagagccttaagtttatccaaagtactagttgcctttttcaatatgtaaaaatggtaaccgttttgttctgttttataatttacataatttaatattatcttatactgctaattgattatcataattgtagaatatgacaaaataagatgaaatattatttttgaatatttattgtatttcataatcttcctgtttcaccagttccctgcctgtctaactttactgcaccaatgggaacagttctttctcctgattacccagaagggtatggaaataatttaaattgcatctggacgataatctctgatccagggagccggatacatctttctttcaatgactttgacctggaatcccagtttgatttccttgctgttaaagatggtgactctccagaatccccaattcttggaacctttactggggctgaggtgccttcccatcttactagtaatagtcacatactgcgattggaatttcaggctgaccactcaatgtcaggacgtggctttaacatcacttacaacagtaagtttctgtttctgtttttttcccatataatatatttctataaatttgagttgaaaagtgatcatgtatattggttcccttgtttcctagttaagaaaatttgtaaaagctgtaaatctcattgtgccaaggatggtcatttcttccttcatttccaatcacattttactctctattatattaatacatttccttttttgtgagaggcccaatatcaaggaaatatgtttcaaatattgttattatgtaagccaatatatttataattgttatatcagccaacatatttatatcttagcataaacccaaacctattattgatcacatactttgttatttgtatgcaacataaaagagaaatagagtttcccttaaagatattcatgcaccaatagatattaaacaactaatcatggcatagaattaaaattccaaagaaaaaatcacatggctacagtagcatcatagaaaaggaaataattaactttggatcttagccttgttttaggttttataactgagccacagtactcacattagtgaaaccacaatggattgctataaagaataaattaggtgatgcatgtgaataatttagcacagagtacatattacttagtaaaagcttaataaacattagccattattgtttagttggtttttgaacaattatcttgacatcttatgttgttgtgtgagatgttaaatattatttatctgcaaaaatgtttataatcatagaaaaaagatgaatcacataaaaaagaaaaaaaccttagtggattaataacacttagatactaatgcttctgtttgcaaatatacctgaagccatagaatactagtaatttttattgcttttccttgaagcttttacactgtgtcagatattgaccaattggatgagttaatatttaagtgtcacataataaaaggatttagtttccagctcttcctgttgctttataaaaagaatttcacacttcactcccaccctcacctattcaatgttaagctttggcagacaaagtgtagttgttgtattttcaaagtgatactagtggtgaatagtgtcgctgtaaattgtaaacatgtaattgcatattattaaagttaaattagcggtgacatgtgtcatagaaacttatataaaatgactgctttgagaatttttaaaaaatacttcatgtacatgtctaaagatagacatgtatatgcatctatctatctataatttttattttgtcttaaatgcataatatttttaactttaatgttgatagtttttcagggtattatggaaataggtctcccttttcctggttctgttctatagtaaataatttaattgataatgtgcaaattattttatttaatgcttactaatgagattcattttttctgaaaaaatatctaccaggtactctatattagagttacactgcttaatcaaaattgagtttttaaaattacaaaataaaataataattagaaatatgtatacatataaaacatattttatgtattctaaaacgtaccttaatattcttttgcactgtttcatttaaaataaggagaacagatagtaaaattatacaatttataaccagcatcaaagtgatgattagtgagaaaatttaaaatcactgcatgtactaatgcagtatgaatataataataagttataagcatctcataaaatatattttacacatgtagaccttgcctctttaaatattcttccatttatattgtaatacattaaaattttataatacacaattggtcactcagatgaatacagagaaaaatttggattgttcatgtaatctataatctatgaaaaattcaaataaacccatttttattatactcctgctatttgctgtaacttggctaaatataaactgtgagacaaacaaggtagaataagatagtggccctgagctcaagaactcctgttctcctgagatacatgagacaaataagccaagatacaataggttgttgagaagaaattaaaatccggtccaggggatacatttcaatcctatgaagccctatttctatgacattaggcaagttacttaacttttcctgagtctaacattactcttttgaatagatggcaatactttcctcatcagctattctaaatattaaatgagataataacatatcacagtgcttggaacatggtaattgcgaaagaattaactctcttcctttttcccagatggcagaaaataaatgtcatggaaaattatttaaaaagttgtaacagtttcatactagattgagacatttcactttaattctcaagatgagactcactctctctatttccagttggaaatagagaaaaataaataaaagtttccaaaggaatacatactaatgcttctgtcaattgctttgcattttaattaattgaaattctgaccagcttatactggaaatattttcataatcttagctagtctcatggtctccagaaataagcagaaataattctgttttgaaattttataattttagagtgtaattcacattttaaaacattcacatttattgcacatcacaggcaaacaggtaaggtcagaggagaacctccaaatttaaagtaaataaataaaaacttgtgtagaaataaacacaaccttttaaaatatctctttctctctctctcttttccaaaatatagaaggatctctctctggctaatgttgtttgtttgtgtatttttctttgcatattattctaaagcatttggacataatgaatgccctgatcctggaataccaatcaatgcacggcggtttggggacaactttcaattaggaagttcaatttcagttatttgtgaagaaggatttattaaaacccagggaacagaaacaattacatgtattcttatggatggaaaagtaatgtggagtggactgattccaaaatgtggaggtaagtgtagtagtgagtgagaaatagaacctcatcatcattatgtacaagaaaccacaacaagaaacacattatcctaccaggactgtcataatcattatcttaaaacatttcttgatattctatattaaacatatcttgttaaggaaattacacttttaatttttcatgttaaaacaaatttttagaaaccttttagaagcttccttttaaaaaaagctcttattaaaagataaagattaatgaatggtaaatattggtcacatgtgtaaactctctatagtatacttcctagttatagtttaatacactttatagtttccattcattttttctcggtatgttatctattcatggtacacactaattttcaaaaatgtgttaataatgatcaattataataaatacatttaagctaaaacacccatttatttaaaatatatgatttctgaaggcatcatttgctaatttttttcagtttttatttttccaattaaatatagtcaacaaggttcaaggcatatatatgtgtgtgtgtgatatatatgtatgatctttggaattattattatttttaaaccgattctcactctgttgcccagactggaatgcaatggtgcaatctcaactcactgcaacctctgcctcccaggttccagcaattctcctgcctcagcctccctagtagctgggattacaggtgcatgcctccgtgcccagctaattttttgtatttttagtagagacacggtttttccatgttggccaggctggtctcaaactcttgatatcaagtgatctgtctgcctcggcctcccaaagtgctgggattacaggcatgagccactgctcttggcctatttttgtatatatacactcatatgaaatctcagattatgttggtaagaaggaaggatgatcataattaaaagtaaaacatcaattacatagtatatcaatttagaatctactgaaatgagggacctttatttagatttgccacagaaggaattaacattctaaattttaatttctccttccactatagtatctaataatacatatctattttattataaagatataaatgggctgggcacggtggctcacgcctgtaaccccagcactttaggaggccaaggcgggcggatcacgagatcaggagattgagaccattctggccaacatgatgaaaccccgtctctactaaaataaataataatattaataagaaaaaaaactagccgggtgtggtggcacatgcctgtagtcccagctactcaggaggctgaggcaggggaatcgcttgaacctgggaggcagaggttgcagtgagctgagatcgcgccactgcactccagcctggtgatagagcaagactctgtcttaaaaaaaaaaaaaagaaaaaggaaaaaagtatacaaatgaacttttactaagaaatagatgaactataactgtctaacacctttagtagattgtcatataataattgattattttaaaagcagtttctttttcttattttccaagtttttcctcttacctgtctccaaactgactagctgataaattgagaagatttaatatgtaattttccaaagtacaacaaatttaattgaagcattacctatatattgatgactttcattggattgaacattttcataatgtctcatgatgaagtaatcccagaccgtgtaattatgttttcctagtggccccttcaattaatgctttccttctttttactactaactgctttctcattagtaatatcaggtgggcagaactagatgactttagtgttctttttcaaacttcaaatagtatgggttcagcaggggctactctgtcaataattatgactatgatggtattttaaaaacatagtggagttacacaataatggactaaagtaaaaagggaaaatggataatatggatagtaatacttagtttttccaccattctttttgccggagcccattcattcttttaacatagtttttgatccggctttggggaaccagtaagaaaaatctacattagcatttttgtttgtttgtttgtttgtttgttttgagatggagttttgcttttgtcacccaggctggagagcagtggcaccatttctgctgactgcaacctccgccgcccgggttcaagagattcttgtgcctcagcctcctgagtagctgggactataggtgcacatcaccacacccatctaattttttttgtattcttagtagaaactgggtttcaccatgttggccaggctggtcttgaactcctgacctcaggtcatccgcctgcctcggcctcccaaagtgctgggattacaggcacgagccaccacgccctacggccacacattagtatttgaagcaacagtaggaaatgagagaaaagtgtgtttcaggcaaaaggaatagagccagttcagtgtgactgcaggggaggacacagtgagttggatctgatgaatgactagagaagtccagagcattagaccctttttaaataatgctaagtagctccaaagttaccctgtggctaaacaggagccattgcagctgggaaatgacattatctgagcctcaccctcccctgcactgaaatttgttttaaatctcagtcgacacatacagagaccacttctaggtaagtttgaattttgttggatcctcgtttgcctaacttgggcattggttttggggttgcttggtgcctagcttcatggtggaggtaaaagtaattagtaatgtcaatcagtaatttaatgaatcactacttatgtagagcaatttcagggagattttctactatctgtgaaaaacaaatggtatttaacttttaaaattaagtaagataaaatattcagaactctaacttgacaaaggccaataagccctccacacatccctaagagaacccttatgaagtttctgatggacaagaattgtttttctctatgtgtgagtgaaatgacacacagttggcacacctgcctgtttgtggacccaatagcaaggtggaaacatcactaaggatgaggttggagccaaggaaggcagaactggagtgggccagaagcaatcttagggtggcccttgccaggttactactctatcccaaaccacctctgagccagtttccacccaacaaagcagactgctgtcaactctataactaactcaggtaggtttgatttcttagcctctaattaaggtttatattgatttcctttcattttgcctgaattctacttaggtactaacaattaaagcctgagactaactgatgcctcagcttatttttatttttcctaatttaaaaaaaaaaaaaaaaaaacctgccccatccccccaccattcctgaaacttccagagccactcccacttacatagagaactatggttgggaggctactcctcctgtctccttttttctgtagacagtctatatttttacagataaaatttttcttattatttattattgttcatctttggggcactatcgcagcctccaacatttacaaatgttaacaaacgttaacatccttaagattttcactgaaacttttaaattatcttcatattaaacatttcaaatagaataactttttaaaggtacatgttggtattttctggttaatacaactaaatttctacttctattttattttcttcaaaatcaaattcattgttaaaagttatatatatatatggattgttgtgtattaaaattagaaggtagaacattttgttttaatcagaacttacagaacaatggaaatcagtataaaatgtttttgtttgaaaactcagaacctcaatccacttaaagattaccttaaatgatcttagcatcattacttggctttctttcttaattatagccataattaacttatttttctcagctctgatttgctttaccagattcttgagatcagtttgtaaaggagagtgtctgtgattatttggtaaattagctataggtaattctgccatcatcttgttgcaggtacttttgattatccaatcttttaatacttcttcctagtggatgtcttgcttttaacttgttctgtgagtttaacacacaggcagaaaatgtctttccaaaatttttactcaactcaacttcatctagatatttatgtcctctaggttggtgaagccaactgccactagactggatggtagttttggtgaatctgagtctacagatagcacctaatgcccaatgccacagatcaggaatcataatctcaaatgcttaacaggagcaaggaagtaacagaaatgaattagatgggctaaaggaagcaggctaccctcccaatggacaggtgtattttcccactttttatacagacataattatagataaatatgtgcttaaaaacagtataaataatacaaaaaattatattattgacaactgagagcaatgtttccattagcttatacaataccttcatggacattagaaaagagccacaatcaatccattgtgctaggccagtgaagcagttcagaaatcatatattggacagcaacctctattccttctaagaaagcacaccaatgtctcaagaaattgggtatcctttagggccttaagaatcattttgcaaagtagttatttcaggagaaagtttcttgagttactattttttgttgtgaagttgtgtaacactgtttaagtccaatcctctagcacctagagtctagctggaacatcatatcttgaattgtgcattctcccccaaatgatcatttcaaattcaaagtactctctgcaatatccttttggctttgcattgatattctgctcatgtcttatcctatttttaccatgagacagtacaattttgctaataatttagctcctaatgtggctcagttatctagtatgatttcatttcagtcagactcaggaactagaccaaagttatttaagaagcattgataaataacagagatttttactttgatttttttttttgagttaggatgcaagtgttttatacaatgaagtaaacagaaggcttctcaaatacctttctaggccatcttttcccccttctcacccaccattcaagatagcttgtaaaaatcatcaccaccatcatcattatcatttatttccctgtcttcccccatgcttacacacacacagtcctcccatcactaagctcttcttctctccctttctattttcctttccagggcccatgtctttgttcacatgaattcagtccctctgtcacacacataatcctcaagttaccagaaaatccactccactgtactctgcacccaggaaagattcattaattccattctgatggttttcgattgacattctgtctccttggaagcttggtgaataaattcttcaccttgttataataaattatgtactgattttgaaaacaacgagaagagagacagcaagtttttgacatatattctcagctactctctgagttacatttctactttataatgcccgcttctgaatttgccagtaataagccagccaatgaatcccaaaagaacttgaaagggataccaggccatgagatgtagtataaaacaagaaagttatctttctaagtgtcaagcagtgaggactaagtcatctagagttttctgttttaaaaagcaagacagttggacataaattaattctcctctgttgcagccacagaaggaaacagttcctgaatataaagatttattattcattggtgaatgcctttaaaataaaatgctactgaactatactcatgtagattgaaagttgaaaaggattttattgcagaccaaaaatgaaagatgcattaatgtattcattattttgttatagaatctgaaattcataccatttttgttttaaaatcaaattttcctcaataatttaaagttatacaattatttaactgttaatggaaaaataagttagacaagtctaaaaattatatatgttattaaattttattttattaaatatgctactcaggctcattttagtctcctttcctggtttctcctcctctctgtgatctgtttaagtgcatgtcccagagctacattttggatatgttctgctctctattgcattcatttcattggtgatttttcaatcagtctctaactgtaaacaatatctacatgccgctgtctctcaaatttacatctctagcctggttctctgccctgaaatgtagacttatatgttcaacttcctactccacatctgcacttaagtgtttaataggcatctcaaacttaccctgtctgaaactgatatgtctccccacgtcactctaaacctgctgttgtcactcactttctccattattaatagcaactctattatttcagtcattcaggccaaaattcttcggtctttatcaaatctttcctgactcctttctttctgtcataaccatagataatgcatcagaaaaactggctagctcttcctttgaaatcattcaaaacccaaatatttcttactacctccactgctgacatcttggtcccagcaacctttgtctctggctttaattaatccgtagccccctaactgctctcactgcttctgtctctgcttttattcagttctattctcaacacagctgccaaagtgatataccattcttctctaaagagacttggtccctgtgatttttttcccctaagcagtaccttgtcatttccttccagatcccatgcagatactgaaatttgtagttcaaattagaaatagcttgttgttcagtccacctgtgcccaaccattagtttcctcataattatttctcctctgagtctcagaaggctctgatgtatatatgctttctgcttctcttgtcctttttacctcactctgactcacatgtcccctacactgtagtcagcagtgccccctttgatctaaagcaatctccgtgacaaaaatggaaatgaatattggccttctggattacatgatcatgttcttgaatatgattagatgtaatacattcatgggtctgctttatagataaaggagattacatttagtgaaatacattggaagagtctgatgaatgctattgcctcaaagctgatgatttaactaagagctgggttaagactggcaaagttgcctttttcttgtggatactcgaaatgattttgaacattgttatatttgcagccctcctgacaaggaaaaccataggaataaatgtgtgactaacaaaatggagaactaaattttcctgctgctttagctttggcaacttagatctccagttaagaagaaaaaattatctatattcctcttcttgaaaatttaaggacaagacacccctccagagcttaagtgggttctagctgattcttttatctcaatcataacctctgccatcccacttccaatgtgctaagcagcaaaagctagggagatctatatgtctttatctatctaatccgtatatctgtctttctctatcattcatctatctataactgtttgaattataagttgtttggtttttcattcttcttagaggagggaaagtgctagtctccttatcttcaagccaaattgagggaaagggctgcataagaatccctcttagagaatggagatgtttgtgtgaaagagaattcccaggtggatatttgcttatacaatgagcttgctgatctaccttctatgcctattgaacaaaagaaaagaaattggtgaaaagctggcaggttggagagagggagagctgtttagttcaaacagtttgattagtcagtgatgtaagtttcctgtgcatcaaatgaataccaaagaaattactcaggcttggccacaggaaaagacaatccaacagagttatagggtgtgccgtcagggatgggagcagacaggcaactacaaaaggttgagcttctcttttatcagggaattgtgcggtgagaagccattctcctcactcttggcctttgcaaacaactcatttgttctcatgggagaatcaacatgttccatacctgacaaaagagaggcaccagtgaccagacaaaggtttgcaaggaaagcaataacttccaggaaaggactatgacctttcacctcatcccagccctaactcaccacaggaaacaggatctaaaggtaaaaggaagaggacaagatataaaataagtgataataccttctctactccaagtgctgaagtaagtagaggaatgaatctgaaagtgctggcattcctttagcatgctcttccctatcctccaagtctctctggctgctactcaaggcaccttgggtgagtgaatggagagaatgagataacagttttaaattgaactggatcaagtttttaaatactagaagtgataagaaaactagaggctctgcttaacatgctctttgaggagagaaagagacttggcagtgtgtgttttaaggcagtaattagaaaaaaaaaaagtcttctgtttttgcttcaccaactttagaatgttctataaaatgcttactcaagcaagaactcccttgccctcagcacagaactccctgcatagctgtggcttatgctccttcctactccctaatgggatatctaagagaattctttgagtgaataggatgggactgaagtcccgggagaactgtttgaagacaagcctggacttgcatgcctgatgaactttccctttgagggtaagaggttctctcttgaatctcaattagtctcagaggaaaggaagccattctcattcacagccattacattctttttagagagagttcttttgaggaagcaattagagtaacaatttgatacacagatcagaattgatttgtggttcttataaacagatatgtattcacacatttatatatatttatatctaacaatgaacccctcctttagttaagtatttaggtgttattaaattctacgtctcctgaagcactaatatagaataatgtaatttaatagccatctgcagggctttgcttctaatctttgtggagctgggtacagggagggatagaagtagttatggaaatggactctattttggctccttaattaccatgtttctgtctttctcttcttatcctagatacatacctgacttgttcattgtaattttttttttttgaaccatgatgcagtgtgctgaggtttgagagacctggtgattacttaccacacctataaccataaagcaagtttttttttttaaggaacaaaatggaactgtcattgtctgattgtccttgaattggcatctagattttatcaagaacaactccacagaaggactgtttatcagaccaaatgctacaatgttcacctctttaattcacctatggcaaaatccctgtgatcaaaacctagcttagcccatggtccccaacttccttctgagcacctaagtaccacttctcagatggaagagcatctcctgctgtggagtaccagcactccttagcatttttattcaggagaattttatctgaatgcagtctgaagcacttctgattctttcatcgaggtcttaaaacacagtgggttctttgaatgtatcctttcttcttaaagtaagacaaaattgagccagcactcaaactcacattatttataacagacgttcttcaggccttagaaaaataaaactagataaatgaactatattgaatttacatatctcattgttgttttcattgctacaaaaagaagaattaaaggcaacgacctgtgtttcactaaaatatccaaataacttcctcatcccagaaaactgagagattaaccaatggagtcttggagctgcagaacacccacatcccttaaatttcctgtgtggtccacatacctaaccaataaaaggacctgagggatcaggtgggggtcttgtcaaccatgcagatttttgggtcccatcttacaactattagaagtacaatacaggaatctgcattttaacaagctcagtagatggccactaacgtttgaaagtctttgaaagcaataataactgcaggtaaccagaggcccccatgaactgctcctccttaggcctccactaataataagttgtaacaacaagaaccacttgactttcccccacacagattagtgttttttacttcctacctctgcctattctgtcccacttctgttaagcctgttttgcttgtattcattttttaatctaaactcttctttgacaacatctcctacccagactctttcctaatgcccctgggacagtacctgtccctgccctatatttcaaggctacttacccagctcaagcatgtacttatcatgtttcatgttaactgtatcaatcttccttgtagaaaatgtgtatctcttgaaggcagatataatatcacatagaattttttttcaatttcagcagctagcacagtatcttagacatagtagcagaaactaaatgtttatttaattaattaaaaaatgaataatagtagtggagaggcacttaaaatggggttagagcctcaaaattatactaaaaacctttggactaaatattctaccccctgacttttcatctatttctgtcttcactaaaccaatggtaaagagagtataaaatgtttaaataaacatttcttttggaaaaataataaatctactgtggaagtaattcttaactaggaatttaacaatttgaatttgagtctcagctctgccgctacctagtccatgtttctgatcaagtcatgatcataagtcaaaactccatcataagttgaggatcatctgtgtgtcaaagaaaaatttctctgtcagagttaaacaggcaagcaagactatttgagactattgcaaaggagaagaaaaattgaactcaactcctttgaaagagggagaaggtttttaagcattggggtgagctagtagaaaagtactggagcatgttagggggtaggttggccaatgtgattagatcatttatgtttgataattggagcttactgaagttaggttcccactctcccacagagagagtggaaaataagggtgcttcaaagggatggctcccaggtcattgaaaaagacattcctgggtcataaaactagtaagaggctgggagaaaatgtacatttcaaaggtacagaggaaaaaaaacaaacaagttttctaaactaaatgctctaggaaagggaggtgggaaggagggtcttgaatcaggaagaagcctgtctaaatttagttaaactaaagtttatctcagtcaactgagatataaactattctatttttccactaaaacctaggaatttattacttttacttgctaaaattatcccagttcacacacttaggtgagaggaagacccaaacaaataattcatctcagcccttttctcagtgttgtagtgatatactggctattggacaatacctacttaattttattaaattaaaatacttttttcaaagggttgcatattcaatcatctttcattttttcctctaaatattcacctttaccttcaacctccatggaaacttgaacatcaaccaattttgaaaatcactcctaagatagccaagagctccagattctattttctcttgtttcttgtgatatttcacagacccttccattttagcactgaatctcattaactttccacatgaaactcctccctgttccgtgtttcccattttggtgaatggaatcaccatccaccctattgcacatgccaagggctcaaggaccagtttagactccttcctctgactcactctttgcacgtcaataaatgcttttgattctccttcctaaataccttgtatattctgcctatctctgctacagccttatttcataatctgataatgcctttcctagatagttgcaacaatcttctaactgatctcactaaatccaggtgtactgctgcaatccattttacatgaaagtttcacttaaatgaaaatcttatcctttgtctatatacgtgtgtgtgtatatatacatatcctttgtcaacaatttttcaattgccgtggttcactttccatagtggagcaaaccaggtccttttctaattttctctcatcacttctttattccccagaaaaggtaattgcattactttatgctaactcaatcctctatgcatttgcatgtgatgttgctttcatttacaatatcctccctcagtttttctgttggtgcttcttgatttcttcttcttgatttcatcttcattcttgatttcatcctgtttaatcttcaaattaaacagaatctcttctatgaaacatttattcatttccttttctgggccccttgtactgtggacatacctttgttatagaacttgacatttttacgttttgttaatgtttctgtcttttgcaccatgggcactgggaggaaaggaaaaagactatcttaatgtcagttggaaagaatttttctagagtcaaactgcctttgttcaaatccttgacagttcagatgcaaattatttaaattccttacacatcagttttcttatctataatagtgtacttatctggctagattattttgagcattatataaaataatctgagggtgcctgacacagagaaagcattccataaatgttcattagtagaagtagtacaaatgccacacaggcacacacctgtcagacaatggtacgtcgaagaactgaaatataaatgaataaaagatgaatgaatgaatgggactttgaaaatgcttctttatggccttggtcccctttttgctttctgtatattccaaatttttcttgttcagccaagagtagttattgttttttagagaaatcctttttgaagtgtagtatcttcacacctggagatacacaagctcatttttggttaaaaaaatgtataagaatttcttaaatttcagtaggtacataattaactacataggcaatatatggatatggcaacattgttaagtttggataactttttgttttttttagttgtattttactcatattgcagttagatttctttacagataaaatatttgcaattaataatatttttaggccgtgcacagtggctcatgcctgtaatcccagcactctgggaggccaagacaggtggatcacctgagatcagaagttcaagaccagcctggccatggcgaaaccctgtctctactaaaaatacaaaaaattagccgggtgtggtggtgtgtgcctgtaatcccagctactcgggaggctgaggcaggagaatcgtttgaacccaggaggcagaggttgcagtgagatgagattgtgcaattgcactccagcctgggcaacaagagcaaagctccatctcaaaaaaaaaagaataaatacataataataataataatatttttaggtttctgttccaaaactctaggcagctttttttttcttcagctgttttgttttgttttgttttgttttgtttttctacatttagcctctcctttctcctgcatgttatctattccatgctcttccactgttgctacaccatggcttctccttactgacattttcctctcatgtgcccgagagtcactttaatgatgagacttttgctgaccgacccatataagcatgtctctcccctcttggtggtagaccttctagaaagttggttcctatacttttggaagaataattttgggaaattccaatcctttaagtgagaaagtagctacttcagaaaatgtcataagtaggagaagaaccacaagcagggtcactataccagagagtcattttaggaaacaaacagcaatcaatcacatctttaggctacttcttcactttaaagaccccttctaactctgcctccctcacattttgcactgagtggctagtcggaatgcttctcagtactttactttttaattctttatggcccatttctcaattgttaattttatgactaattacctcgtctaatgatgattaggttgaatgaatgagtgaatacttttctggaacaatatgagttgctgacataataaagatttatgtcagaaatactctgtattttggggctttctgtcactaaaatacttagctctgtcttgtaaaatatggtaatttaagtgactattatgcacataatttcatttttgaaatacataaccctacaggaaacctaattatgagtcatcataactaggaagagtaaataatcctcataaaaatggcctcctttaaaactagctttttaggaaacaaaattaaattctattaaggaagaaaacttagtttttatgagagttctctgtcatacaaataacatcttttggcaatttcacatagaaaatgttttactaaaaacagaaattttacagtaatgtttaattcctaggccaatttataaatatttgctatttcatttgggttccatcaagttatttaaagaataaaaaggagtaaaatagtgtctagagcaattgttttcagaaattctgtaaggcaaaacagaaagaaataagctaggaaaaatataaacacatgggtaagagtttaaatgggaagatttaaagaaaatgatgtgaaaagtcactggaaataatgatgtattaaaaagttgatctagtgtacatttagactttttttctttcctgataattttcaacatcttaaacactctttcctccattttctcttctgtgtatacttcctgaaagtagagcaggctaatgtagctgggctgcagagtggaggggagttctgagacaaggctagagaataagcaacagctagatcccacagagccttatcaggaaacacagaaagttgtcactgaagggcatggtaagctttgtgaattaaaaagaaaaaaaaatcactgtatccgtagcatggagaatagtgtaaatgcagagaccagttcaggggttatttctatacttcaaggatgagatgatgttattttaaactaagatgaaatccatagagctagagaaataagagtgagcttgaggatgggttggatatgggagtaaatggtaaaaataatatacgtatgaaaactgaatacttctagcttctagtttatgcaactggacagatggcggtttcatttaccaatacaggaaataatggaagagggtcagtactaaggctttgttttgcaaaagttgacttcaaagtgattttaagacctttcaacctactgaactttggcaagttgctctctctaaaacttggtttacacatctccaaaatgaggcgtttacactaaatgacctaatcagtacttactggaactacaatgctatcattgtggtttcaattgtgtgtgagcttagggaaatcagaggatacaatatttgaaatgataaacagaatatttaaatttgatattaaaaagaaaagagatcaaaatacaaatctaagaaaggggctagatgtctaggaaatggtatgatgaaactataatttggaggagcttattctgacagctggactaaagtaagaaagaaaatagcagatgagaaataaggtaaaaagctgaatcaatgaagtgactctggaaaatggaagcacaaactgttagtgtataagatgaattagtagaatttgataacataagtaagaaaatcaaagagaaagaaaccaaagctaacaacttaggttttctttcaagctttgaatacaaagatgacgatggagagacaagaatatatgtaaggggtattattcagagacttaaggaggagcagtttattacctgacatgctaaatgtagctatttcatattttgaaaagtaaattacctttttagaaaaataatcatttaacagaagtaattgactagatgtaccattgctttcaaaaatagtattaactatttaataaggatatgcagagacttgtttttgaaattgtttgtattaagaataatatctgcgatttatcttgaatgttttattcttacttgtctgatttaatttttcagccccatgtggtggccatttttcagctcccagtggagtgattctctcaccaggatggccaggatactacaaagactctttgaattgtgagtgggtgattgaagctgaacctggacactctatcaaaattacatttgaaaggtctcacaaatatttttcctacttttaaagaaaatattatctaaaagattagttgacattctcttttgcatttaccaaatgaatgtttaattttattgtaatagtcaattgctgtgctttgaatgcttccatctgtttgcccccttttaacctttcagcgtgtttccaagttaattttctatttgtgtaatgctgtatcagtactattgaaatatgcaagatcgacctttttgctttatgtactactaagatgtgaacatgtgacctttaacttaatgagtttagttgttctatactttgaagggcctgtgaattctgctctgctaggtttcaagaggcgaaggtgctgtaaacacattcaaatcaacactagtgcagtctaagacacttaggcacactatccatatgctttcacctataagtccttgtgaaaatgactgtcatgtagtatgtagtaatggtggaacagctgaccttttatttcccctagaaaaattagtattactgatcaaataaactatattgtaaaaggctataatattgtatattttaaatcttaaaagaatgaaacttctcttacgttattgaatcacaacttacaaatcaaaatagatttatctatataatctctcagttatatcattgacttctctcatctcccaacccctttcttcaaaaaacaaacagatgaacaaaaaaacttatttaagcattagatccacatgaaaaacatataagtacagcagaatatatttattattgactgaagattgaattttacaaacctaacatgattctttcctaactcaaaaggtctttcattgaatttgtctatccatgctagtgttaacatttgcatgggagagaacagattccactttgaacagaggtagagtattaaacatttcacatggcttcattctactgttaaaacaaaaacgttagacaacttaaatttaaccatgtttatttgagcaaagaaccattcatgaatcaggtagcaccttgaatcagtaaatatgaagagcttcgtatggcaaatgggcagaaagtatttatagacaaaaaaaggaagtgacataaagaaacagcttgattagttacaacttcgcatttgacttatatagatatgatctgatcagtcggtggcctgttactgactgaagcttggtttctgtaattggatgacactcagctatttattacaagattatactcttagttaggttgccatttcttatgcgggaattcaaagtatacaggaggttttaagctaaacttaatttaacactatcttgttataatctacatggtttactagggctatattagttttctatattagttagggctgccataaccaagtgtcacagactgcatgagataaaaaacaaaaactaattttctcacatttctggaggctagaagttcaagatcaaggtgtccacaagacagtttattctggattctccctttgccttgtagatggctgtcttctccatttatcttcacgtgattttctgtgtgtgtgtgtttatgtcctggacaccagttacattggattagggcccatctatatgatctcactttaccttaattacccttttaaagtctctttctccaaatactgtcacattctgagtactactagggattaagatttcaacatagaaatttgggggaacacaatttagcccacaacaataattgacacatttttaaaaattttcatttacattcatttggcattttgttgttgttgttgctattctgttaaaaccgtatcccctatttattggtttacatggcttatgttgccatagcaattttagaaagcttgaaaaacatcttagttattcatcattaaatctttttccaatatagtttttccatgaatgttgaactaaaattaaccaaccttactttagcacacagaattatgtttggtttggaatacatgataaagcatgatatgtattgatttggaacaataggacaaagatttcatccatatttttcagtttttaaatttagtattttacatttgaaaaacaagcatatttgtcaatctatcagaattaatctcatatatatttatataatatgtcaagtacataattttcgtatttcttgttttggactaaacattattttgtatcaggaggtgcaacggtagttgaaaatatgttattttcatattttatttgtatcagttcatagcatctatcacccagatgactctcaccagtcattatccttcaatattcaagtaaaaagacttcaccgccatcccacatacaagggaaacctactctctccttcaattttcaaagaatgcctgggggtgcttttgttcacttctggacttaaattctgtctccagaatcaacctacataatagacactgaggctgctgcactctctcaacattactctattcatttgcatcactttctttcattctcatgaaaaccataatgcaggtgacaatgaaagaggattattgcacaatccagagtcatttaagattgaataagcctacactgttctaaattttcttgataaccctcatcacaggaataattgcttgtatctctccaatcccctctcttatcccaaactgttcttcattttttttttattatactttaagttttagggtacatgtgcacaatgtgcagatttgttacatatgtatacatgtgccacgttggtatgctgcacccattaacttgtcatttaacattaagtatatctcctaatgctatccctcccccctccccccaccccacaacaggccccggtgtgtgatgttccccttcctgtgtccatgtgttctcagcgttcaattcccacctataagtgaggacatgtggtgtttggttttttgtcctcgcgatagtttgctgagaatggtggtttccagcttcatccatgtccctacaaaggacatgaactcatcattttttatggctgcatagtattccatggtgtatatgtgctacatattcttaatccagtctatcattgttggacatttggcttggttccaagtctttggtattgtgaatagtgctgcagtaaacatacatgtgcgtgtgtctttatagcagcatgatttataatcctttgggtatatacccagtaatgggatggctgggtcaaatggtatttctagttctagatccctgaggagtcgccaccaacagtgtaaaagtgttcctatttctccacatcctctccagcacctgttgtttcctgactttttaatgatcgccattctaactggtgtgagatggtatctcgttgtggttttgatttgcatttatctgatggccagtgatgatgagcatttttttcatgtgtcttttggctgcataaatgtcttcttttgagaagtgtctgttcatatccttttcccactttgtgatggagttgttagtttttttcttgtaaatttgtttgagttcattgtagattctggatattaaccctttgtcagatgagtagattgcaaaaattttctcccattctgtaggttgcctgttcactctgattgtagtttcttttgctgtgcagaagctctttagtttaattagatcccatttgtcagttttggcttttgttgccattgcttttggtgttttagacatgaagtccctgcacatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgtggcattatttctgagggctctgttctgttccgttggtctatatctttgttttggtaccagtaccatgctgttttggttactgtagccttgtagtatagttcgaagtcaggtagcgtgatgcctccagctttgttcttttggcttaggattgacttggaaatgtgggctcttttttggttccatatgaactttaaagtagtttttttccaattctgtgaagaaagtcatcggtagcttgatggggatggcattgaatctataaattaccttgggcagtgtggccattttcacaatattgattcttcctacccatgagcatggaatgttcttccatttgtttgttcttcatttttaatctcttctgcatctagaatcttcagtcctcatttccccattccctgtgctcctggtatatagcagggtaagtctcaaaatacctattactttattatgcagagtgatttaattatttgtttttctgggtgatgttggggagtaggaatggatcttgcctttcttttgaaacatactattattattattattttttatcaaacagcagtgttttcttatgaagacctcaccccttccccaccttctagctgactgaaactggaatgttattttaaaataacattttcttttattctcttattcagttttaaaatactatataagccaaaaataatatgactagaaaattagtttaagctttatgaacacaaagtgcattattatgttgaaaagcatctgctgatttgctaatgagagtcattaatcatcattaaataaataaacacctagtatctttcagctcaaagtaggctactaagagtggctcacttgatgaacagtttgattgccaaacaatgcctgcaattcagagggcatccgtactctgacatttgattttggacttttgtttgaaggcactattttctctgtccaaaattcttagcatgcatctgctgtccttccaacaggccaatataggcctctttgctgcttgcctatcttgtttagatacctttagaattctccaaatgaattcacttgtactgtatagcctatatttgaaattagactgtttcaaacctgactttctggtgaaatctttccagccattttaataaaatgtaacactagttaaataggcataaacttaaattaatttctatagcgttacttagcacgttttactctgccactttcttattcttttatctattgattaagacacaaatcttttaaattaggctagaagtaagaaagtctaattgaaaagtgattttcaatgtaggatttatgcacaggaacaataatcagtcttgtgcgtagatcagaataggccttgggtgaggaatgtttcctacagtttaaagattttggcttctccccatggacatcaccaagctggacttgtcaaccgtgcctcatttcttaatcctgaaattacccactcaaatcaattataatctcatggcttcttccacttccctaaaaccaatcattaaaaaatcattctttgttaattggcccaaacactggaataatcaggagttacaatgctttaagaatttattaatggtattttcagtattttagaataaacagagcacatttatatcacatatttcctttgaatctaccttatataaataaaataaattaagtcccaaattcttccaaatgttgtaaactgaaataaacgctccttttagggcttgagccttctatttgcctttcctttacttccaccccaaatcctataagattattgaattggagctaagaaaaaaaaatccttaaatatcttcttccatttgttcttctctaaagaccttttaagggtatgaggtattggttgagggctgtctatattccatatgctttgccagaaaattggttcttttaataatctacatcttacacagatatcacatggttagcagtaactcagtagcaaagggatgaacaaggtatttcaattttaaaaataagtgaattttatccattagggcagcaacataaaataatcactttgaaatcagacataaatatgcctatcacttccttgatcagtggccttataatgtcttggtgctttatttttttctaaagattgttttaagaaatcgaatattatttctaaagtatctaacacataatggattcttgaaaatatctaattctcttttgatttccagccaaactcttgtaaggacactagttgccaactctttaataattcctcttattctgagaatattcttgaagaagctggttccaagaaatgatttattacagagtcatgtcacttactttccactactcgtgagtcatttaaatttgttgaaaacaaaatttgtaaaaatcagataatatatttaacatggtggcatagctattttgtagtttttttctatattctcaaatggagaaaatgattagaattaacctacagaaagtaatattatttaccaatatattattcattcattttctctttgagattgtctcaacagcttgtcaataaaactacaagaaatatgatttcttgtaaaatacaaaacaaaatagcaataacaccaacaaacatgtttttaaaaccatttacctcttcttaacatatccaaacatttaacaattcttactctcagatctgcaaaggaatttttgtttttgtttattcccacactttctaaattttctcaatatccagcagctcctgagtctaagaggtattcattttactatccatcattcaaagtgtatttttcggttccttttcctatcctcagctccctgaatgcatgctatcactatcagtctttcagagaatatttttttaagttaatgaggactatctcaatttggttaggaagggtttggattacatcaagaatgttttttaaagacaacaaaaattgaataagattagatccaatttcattcataataacatttagtgctaccataatatttgtttagcatatacaataaatttaatttcataaacaaacatgagactgaggcaattcatgagaaatttatacaactattttaaaatagaaaatgaaagaaattcaatttattgtgtaaccctatcccattttgcttgttattagaatgtatttttatagttcctcagggcaaatctgcaatgattttctttttaaagattcactggtactgaacaatgttctttatatcaccagttaatgttgctattctattaagaattaagtctctttatgtttcaatttgaagtaatccctgactcttccgtgcattttaatttggctgctgtcagctgactagctatcaaagtcaaactccaatttcaatattcacagtagactgactacaaagcaaccaaataatagattgacaatttcttttttttttcttttgagacaaagtctcactctgtcacccaggctggagtgcagtggtgcgatctcggcccactgcaacctccgcctcccaggttcaagtgattctcgtgcctcagcctcccgagtagctaggattacagacgccaaccacgccttgctaattttggtatttttagtagagacagggttttgccatgttggccaggctggtctcaaacttctgacttcaggtgactcacccacctcagcctcccaaagtgctggaattataggcaaaagccactgtgcctggcctagattgacaatttctaagtatatgatcatttatttaaagaacttagtgttcctttatctttccttctctacaccatattattgaaacatttatgaaacacatacagtatattccaggtcacaaaattagaagtaaaatacacttcaaaaattcacatatactgtttactgattaataggaggcagttgtgcttcctgaacagtattaaattatatacttaattttgactaacgtgtcatatgctatgttcataataatatcagagactgatacgatataatgaaatagagtttctaaccttttttgaatccattcaattagttctgggcatttgtttgaccacatatgagttttattcattttggttttgaggaataaagtggtttaatctcataacacatactgcaaaagactggcaagtatgatagtaaaagtgattctctgaaaattagtgggcatttcaaactaaaaattattttttaaagtgtactggagataaaactggagaaataaagtactgaaactttattggaaagtgcatttaacatgagtaaaaatacatggttaatactaaagcatccaattatgttggatacttttttgtaaaactagtaactaccctagagaaaagaaagacatttttaactgtaaaatacattcattttttctttgatccaataaatatttattgagtgtctactatatgcaaagcattgacaaaaacacactgcttaacctcatggagtttatagacttttaaggaagacagttgtctaaaaagtaaacactactgtgattagtatcacaaaagccacagtaaattgtggcagtagaataggaaataaaataatctacaatgtgaggacagaagaggtcttgctgttcgcatatttaagctgaaactgaaagatgtgtaggaaaaccttggttaaagcaaggaaaagaattttcgaggcttcaagatcatcataggcaagggaaaaatattttagtactccatgagttcacataaacatttttccacagtttagatcttggatctagattcaggatatagtataaccctgaagtgcaagggaagaatacaaaatgctatttttttaaaatagatgttatacatgttaaaagtagccctgtgtcgattgacgtttataaaataaattaatatgttttaaagaattgaaaacagcagaacaaccaaaaatctaataagatcagacatcatagaatagaggttagagtcagggagacttggttttgatgcctacttttgtaatttaagataatgtaatactatttaagttttgaaggtggctgggtgcagtggctcacgcctgtaatcccagtactttgggaggccaagacaggtggatcacttgaggtcaggacttagagaccagcctggccaagatggtgaaaccctgtgtctactgaaaatacaaaaatccgccaggcgtggtggcacacgcctgtaattccagctactcagaaggctgaggcacaagaattgctttagtccaggaggcagacgctgcagtgacccaagatggcaccactgcactctagcctggttgatggaattagattttgcctcaaaaaaaaaaaaaaaaaaagtaaaaagaaaaaaaagtttttaaggctgtggttttcttacttggaaagtgggtttaataatatgagctacaccatagggttaatgggaggattacaaaaactaatgtcaatgaagtctttaatagagctgctgatactttaataaacatcaaatgtatcatcattagttactacctacttagaactgttgttttcaaatacaaactttatcacatgtttaaaggcagaaatagatttgtccaaaaattttgtataaatgttatgtatcaataaaaaacacttgaataaaaaataattataaaagcagatgtcaaatttgaaatgtgtgtgttattaagatgataatctaattatctgattgaaaataaatgtaaaccacatatttttccataaaaataaggaagacaaccaaagataattccaaaaatatgtttggttcatgaacagtccagttataagataatttataatatttgaaagaatcttaggaacaatacataactttttaataataatttttcataggaataagagcttatacctttggcattcacaaatgatggtgtcttaaatgatatcttagatattagataagctaaagaaaattataatataaaatggaaaaattttaaataggaatttaaatagcagtccaaagcattatttccatatatagtgttaattctaaatatattttcacatgtgtcttttaatcttagatttcagactgaactgaattatgatgttctggaagttcatgatgggccaaatcttctgtcacccttgcttggatcttacaatggcacccaagtgccccagtttctatttagtagcagtaattttatataccttctatttacaacagacaacagtcgttccaataatggtttcaagattcattatgaaagtaagtaatgataaaactttttgatttcctcattctgtttgccctactttttgtattattatagttttactaatggaactattagctctatttattttaaatcaaagctttccttcatctataagaatgttaatgctttataaggtgtgtgttttagtaaattctgcaatagattttccagcaatatctatctaatatcattatgaaacaaaatactaaagaaatatcagaagcatcaaatcattatttgaaaatgaggttttgtaccaattatttgtgtatagttctgaaaaacagataatagacagtaattgccagtctaagatatatataaacaataacatttttagcatttacttcacaaattcagttattcttttatagtttcctcacactaattgcacatattttccatttaaaatatttaattttattattttgcataaaatgttgaaaataatattaaaattaaaaggcaaactgtatatacatatattcaaatatgattaatataagtcgagaaaactatattaatacaagctataattcagagtgttggaatcattataacccctattaaatctcatggttttgtttaaaaagtctaaaatattttgatttttgaaacattttgatgctgatatgaacacagaaatgggctttttttccatttataaacatcttgcacatgtgtggctatattgcataagatttatgtgtgtgcaaacatataaatttacatatgtgtacattttcatcatgaatgcatagccatatacttttacgtgaaatgcacttttgataaattaatctaacaacacacttaagagggttattaaaatatgtctttatttcaaatgcagatattatattatttattttaatattcaagttaattatgaccctttccccctcaagaagagatttctgcatttgaaatatatagttttatatttgctgttgggcatctatcttcaatagatatagtcaatggactcatgggtttttaaaataattgtcaatatagatccattagtttttttaaatcatcttatctacagtattgtttgactatattaacttcccattattttgagctttgtggcatgaaagcatattttgtaaaaatcatggtaaaatgcaataagagaatgcacacatacttgggggttcaaatgaactaaagtgccttaactgatattttgagtctaacatgtatttactaaacctgagtcaaattagtcatttagaaaaatctacttcaaaactaattctcactagtaattaattgatatcaatatgcaggcagcttttcttttagtccattgctgtatcctttacccagtaaatcgtattcaatcccattccacccaaggtatgtggtctttaccaaaaacaggactattttaaagattaaatgaaacaaaacatgcaaaatgtgtcagcataactggtaacatgcagtatgttctcaataaatgatagcctttacatttctcctacaaaaactagtcagataaggaataaaaataagaagtcctgctcaaatgcataccttcagtcagcaagtttgtcacttacaggtccttagtggcatagtccaagttattttcgagggctagtgccttaaaaggcaaagtggaagctgagagctgacaaacattgaggttgattagagacacacttgttattaatttggtcaaatctaacaagatgaaataactttgtatttaaatttgtctttaagaaatcaccttctctcattttattctattagtcttgtggtatatttactcctgtgaaataatctccaacatcataaatcctttcttatcaagaaaccaacaaaagccttttcattcatctctttcttactgtttcccaagctgaaggtaactaaactatctttttcaaatgaaccattcacaaacctcaaaatcagtagattgctaatgagaacattaacaatatatttggcatttggtgtatttctatttttttaatcaaattcattgaaagtgaaagtaatttgtcttccccaggcaaccaaaatcctataggaaggaatgcttgcaatgccaccattgtttgtactccaggtttctgttatattttttaccccattctttttttttaccccattctatctgccccccaaaacatggggattacaaaaactatcaataagataaggttggctgggtgcggtggctcacgcctgtaatcccaacactttgggaggccaaggcaggcagatcacgaggtcaggagttcaagaccagcctgaccaacatggtgaaaccccatctctactaaaaatacaaaaattagccaggcatggtggtgtgtgcttgtaatccaagctactcaggaggctgaggcaggagaatcacttgaacctgggaggtggaggttgcagtgagccgagatcacaccattgtactccagcctgggtgacagagtgagactccatctcaaaaaaaaaaaaaaaaagataagattatttagaggtttcaaaacacattaaaattataacaacatagagtagactttaggaatataatttatttttatttctatagtttttccccaggaaaaaatcacgtctgtttattatgttgtattgcttgaaatatgactataattaagtcttggatatctaaatattatacaaattttaaaattgaaaatggatacagaacaaacgtatagacatatattcatctccaaatatgtatttttcatatgaacgtatagatgtattttccaattaggaaaatgttagacatctaaaagaatgcacaatttatgatcaatagatatttgaggggaggagtagtagaaacagaaacataaaatgttcaaacgttgtattacataaataagaaaaatgtccattttgaatttctactttttaaaaaaacaagctctataaagcaataaggaaaaagataacatgttaatgtcatttgatataatgcagacatgaacttctgaaaattatgtacattgccaacatttaagaattttctaaaactagctgggcacgatgactaaagcctgtaatcccagcactttggaggctgaggcgggagtgtcacttgaggtcattagtttgagaccagcctggccaacgtggtgaaaccacgtctctactaaaaatacaaaatttagccaggagtggtggtgcatgcctataattcccactacttgggaggctgaggcaggagaattgattgcttgaacccaggaagcgaagtggaggctgcagtgagccaagattagccactgcattccagcctgtaggatgggtgagactctgtctaaaaaaaaaatcttctaaagctacttaccaattatgttttagtattcagtaatgactatcagttaataaataatactgatatcagttcctcatgatgtttctcattttctcaattttgcaacatttccattgccttgcattatgccttgagttatttgcttgtcaatcaattatgaactatttctttagacttattttgtgactcctagatcaatgcaccacagtggaagacataaaagaaatacatcatcttactttatcagttgaaaagccaagaaaggcaaatgaattattaaccccatatattcattgacctttactataggtcaatgaacaaaagcattacaatcacttttgaataattaaattttactgtaatttacattgtatatgaccactgcaacccccatttctctgattttagacgattttactacaatgttagaggttcatgtaaaggaaagttatatatcacctggaacattgggggaaattgaaacctgaaggaagggggtctaaacttttctgttaaaggttgagaagattgtgtacattaagaggacaactgaaggtattcctatgagacaaagcctaaaactaatgaggagacttatctgattgatataaaaaatgaccattgggagataatgacaatttagaatagtaaagtctaatttgggaatcttaattttcagggtgacgactttgaacatggtgccattagccatagggtattaaagcaatgaaaaaacatgttttggctatacgtatgtccaacattttatatagaataaattggagatgaaagatactgaaaaacatgctaaatgttattgtttgtttcataaacttgaggtgatgagggccttggatagggtaagagaaataatacatgacatgatgcttttcaatgagaatggatttcagacatattttgtggaggaaaagagtgaggaatcaaagatgaatgagagtttaaaagcactgggtgctggccaggtgcagtgactcacgcctgtaatcccagcactttggaagactgatgcaggaagatcacaaggtcaggagttcaagaccagcctggccagcatggtaaaacccgtctctactaacaatacaaaaaattagccgggaatggtggcatgtgcctgtagtcccagctactcgggaggctgaggcaggagaattgcttgaacccggcaggtgaaggtcacagtgagccgagatcacgccattgtactccagcctgggcgacaaagcgagactccgtcaaaaaaaaaaaaaaaatgcactgggtgcttagaaaaataatggtcacacttagaagaggaacttagcagataaaagtagatgtgttgaagataaaattgtctctattgtattttagtttctcattaaaataacaccatttagatgaaacgaatatgcttgataaatacacttaaaatgtacaatttccgtctttaaaattaaacttctattttgtaccattttgtttagcttcatttttgaattgggtagctaatacaaataaatattttctcatataaatatgatttaatataattatacagtcttaaaaatgttaacgactaattttggaatatagaaatagtagttattcattgtttaaatatcctatataggaagaaaaaaataattacttgttatagtttgtaccagtggttctcaactgagggcattgttgcaccccaagaaatgtgtagcagtatttggagatatttgttattgtcatgattggagaaatgctactggcatcgaacaggtgggggccaggaatgtttctaaaagtactccaatgcacaggacacccacaacacagaagtatccagtccaaaatgtcaacagtgccgaggttgagaagccatatcttattaaaggaaaaacattgtcatggtatgatctcagctagggattgtaaattgcaaggaagatatcaggagacactgaagtgtactagagactattgataacaacaacagttaaccaccagaagaaatgtgctaattggttatacttagaacggttctggtgttcatactttcataccttgcaaaatgcctctactcttctttttcctttagtaattaaatgagaaaattttgtataatatttagaatggtgcttggaatataataagttcaagaaatgttgactattgctatgattattgtgatatatgtgtatatatacacaaaatttataacaatacaaagttttacagatagttatacattttcatcaagttcttatgtaattaaatgacctgaatttgatccttactggtaggaaatgagaaaacaaatttattaaataaattgctgattttaaaaatgaagtacgagtacctttatttgtaaaaatcattgcttgtaattgtttgaagaactaggaattattttcagcaactccaaatcccaccaagcttactctttattttcttccctttgttttccaggtgttacagtgaacacgtattcttgtttggaccctggcatacctgtacatggccgtcgctatggtcatgatttctccattggctctactgtttcatttagttgtgattcaggatacaggttgagtcatgaagagccccttctatgcgaaaaaaaccactggtggagtcatccacttccaacctgtgatggtaataactcatttgacatgcaaaatatgctgatttataaacagaaaaatcaatgtagttttttatatggggtttaacataattataaatattttaggttttttaaaagttcttttgatttctggcaaatttatgttatcaaaccattcatgaaataaagactattgctaatcagccaaacttactccatgcctaaagatactatctgtgtatctaccctgtttatatatgcatatatatttaaaactcacctgtgtaactattttaagaacatgctgtggaccttttcaaaacagccttgaaaatgccaaatttgtatgagaagaaagtcctgaaaaaaatgcagcatttgtttcctgccttgaatggcaacatgtcccagttcaaatagaaggccagcctgtctacaaaaattctaaccagctacacagcactatggtagtttactccgactaccctgttgtgtcaagttcctagttataataaatagcatactagtgttccttactgcttctttgtttctatgagaataagtcagaagtgcttcatttttcaggaaacacatatgaaatccagtggaggaaactgcttctcctaagattgggaagtgcttgcatgcttgcttgtcaaaaagcacactcaatgtaaatccatatattatttaactatgggttttaatttctatttacagtactattttcaaattctacacttactatttcttgaagtggaagataccatttgtcattttatgattaaattttcaagtactgtcagtgccatcattttttaaacagttttaagctaatttgtttttatatgaagatttaaacaactcatcaaaacatcttcctttaatttgtgattgtaagtgacagaaacccaactctaactggtatttaaaaataaaagcagaagctgttgttcaactgttcaactagtagaaaaggcaaggtgggataactctcattgctaataagaagcataaattcaaaactttttaagaacttctccatcttacacttagacttttctttgtgtattcacataattctcttacgctgcagacaggctttttccgtatgaggaattgacagtagtgtatacactctcaggcagatggaagttgatagccctgtatcttcagtttcagagaggaaggagagctcttccctgtcactctaattagaaaaatcccagggaaggtattcaattcatccatatctaaactagtaactctagtgaaggagaagggcccattatgattgactttgtcttggtcatgtgctcatctatccctgtggttgagacagaccatggtggtttaaaagtcctatgtttgccagaccctaataaagctacaaggttggcctgaatgaggagcattcaccacgaaagaaaggtatggaggcaatattataagaaccaggaagataaaaagtaatggcaagcgcatcaacacgcttaacttttattaataataaaagcaaatatatccagttttcccaggagcagcacaggccctcatcatttttccatccaaccccatgtttctcactaaggttatttcacgttatattccatatccaaaattcttaatggctttttattgcttagaaatgaaagctcaaatgactaatcatggaattcaatgtccttaaccttgagaaatccatccttttcagtgatgtttctgtcctgcattcttacaatgcatctttattttaaaagatcaaatcatgttacttttaacctctattataacctggcctcctcttttgtatttctatttcatgttgagtgcaactggacaaggactgaattatgtttatttaaaaaatgtctaagctgtgtataaagcaggtacttaataataatttttttctgttgactcgaactgaactcaactattgtatcacctagtgaacagatttgatcagacctttcctttaacagaaacttttgccccagcggtaactagtccagatctcctgaggtaacaagggagaaacagacaaacagaatttcttgccctgctccaagaatgtaaacttgattgacctaggttgcctaatgcttgtgtacagtgtgcttcactctaacatacatcagcttttgtgatgtctttatatcccatgattagctgatttacaaagcaaaccagacaatgtagtatggtggtaataatagtgatgactaatatttattgagtttttaccatatgctgatactgctacaggtgccttatgtattttaagtcattttctcttccaagtaactctatagataagtgctattatgatcaccacttgcagctgacaatataaaacaaatgcaacttaaaacattggcaatgtaaaataatctcatttagaaaaatgaaaaatgtcattaggttgatgaaaatgatgaggctgatgatgatgatggagaattatttcagtcacatacaaagctactggcaaatgagaattcggaagagatagatcaattaaagaacatagacaaggatactgacacaataggtgttaggtgcattaaaaaagtgatttgaaggcctggtgcggtggcttacgcctgtaatcccagcactttgggaggcagaggcgggaggatcatgagatcaggagatcgagaccatcctggctaacacagtgaaacctgtctctaccaaaaatacaaaaaaattagccgggcgtggtggcgagcgccaatagtcccagctactgcggtggaggggctgaggcaggagaatggcgtgaacccggggggcggagctttcagggagccgagatagcgccactgcactccagccctgggggacaaggcgagattccatctcaaaaaaaaaaaaaaaagtgatttgaaaatgacaggattaaatgaatctctgagaaaataaaggatgcccttgaattttttttatatattcatcatttgtgagggaagtgctacaaaatcaaacatgagtaaagaacatcatagcttgctaaaatagtactcttaatgtggaaaaaacatccacacaattcaagaatctgcctgagatcatagaccctggaactagactgtttgagttatttctatacttgcttgctttctcatctgtaaaccgaataattacagcatttttctcaaaaggttgttgtgggggctgagttaacataaataaaatctgcagaatagtgccagctacgttttaagttcaaaacagtttgctcttgtttctgataagaattagtaaatcattgtaattttatcctgttttattagatataaaataaaatttatgtcttcatgtttttagtttcatcttataaaaaaagcttaaattacattctttcttcactatttactatgaaattccatctttaagtccattctcttcagtgtcttcatccaatgataattattttcaaataacagaaatcttcactttgttataaaaatatattctatactttcccatctgattctagtcaaagtaatagtacgaatgtttgttatattagttgttgaccattcctcctaaatgtttaaatgtgtttatgtgttacatagatttatgcatttacctgcagaatgtccctttaagtttccccttctacatatgtatataggtacagcttacagacaaaaaaattcccaagaaacttctcaagaagtaggatacttgacaaagtgtctttatttgaaagaatactgatatacagaaaaactttctctcaacttcttgtaaatacacacacacaaacacgcagatatacacacacacaaacacacagatatacaaacacacataaatgtgcatgctcaggagcacatgtctggtgtcctttctgaaagtttgcatctctcttttttgttacctttttgtgtattttaaattaatttaactcccttaattttcatgcttgtgttcagtgagaaattttattctagctgcatgacatatagtcctttgaagtagagactgtaggttttaactcagtagacatttcattcatcatacaaattcatatcatgttatagtgttaggtatttttggaagagacaaaaccaaaactcacttttctagtgtgctaagaaagtgggcaaggatcaaattagacaagggtacatgtggcattcatgattcttactgcccttggctgtgtctaagagttggcctttccaagtgaaagtgaataaggagtcaacaaattctctgctcacactagaataaaaatgcttactaagcaatatttttttgcttcctccagctttcaattttgatagaattgcctggcataccataagcactgatagctgttgaatatatagaagaccttgtaaactatgatttgttctcaaagaaatgaatatcaaatcaaatattaattttttgacctcagatagttagcttatttttactatcttagaataattacttacaaaactcgtttttgttcataatatttcctagaaaaataaagaaacccagaagcagccttaaaaacttttacaactcacttcatagttttgaaaggaatcctataaagaatgacacatatccctttaggaatctatatcaaacagttttatacagttaattcattttcttagtgcttaataagagcaactgttaaacaattaattactcatgtttaatttaccaccaatttatgcaaatactgcttataattagaaatgtattagcacatacttcaaattcaaacttggaaagttgagccatgttctcttggggactgcactaattctcagatgctactgagtacacttttcttctctagtgctgcatgcacacctgttattactaggaggtagcataagcaaagataatgcgactgctcaattcaagagaggagatagagatttgttcaccctctgtctctctcactgctgatcacatggatctgtttctttgtatttcagcattatgtggaggagatgttagagggcctagtggaacaatcttatcacctggttacccggaattttatccaaattctctgaattgtacatggactgttgatgtaacccatggaaaaggtaatttgcctcatgaaataataattggactatcttctgaattttcattgagtctattcttatttcactttcctttacatgttattttgcatgagcaaaaacagatcagtactacaatatgctaaaacacatttcaatttaaataattgccacaaaaattatatttactcttctatagtattatattgtgctcatgtttttaccaggctgttgctatgagagatttgtttacttttgatataataaactaatgtcatttgaaatttttgtaacaggaaaacctcaaacaagagggctttagtttctggcatagtgttaagaaatggatttcaggagttcaaaggggaatatgagatgctctgatatgctaagccaatttttaaagcaactagtatgtgtttatatatacttgtttataattgtttgtaacaattatattctctatataaatttatagccattctataaatatctgtgtctcagattctttagtacagagctatagatatgtctcacatagagtgtaaaattgcactctgcataaggtagatgttaataaatgtccttttacaaataaacaaataagtaaaaggctctgtagtattaaacatggttcattcatgagattcaaccactcataaaacttttacaacctacttcactgttttgaaaggaatctgtaaagaatgacatgtatccctataggaatctataacaaacaattttgcatgattaataattcgttttcttactgcttaataagagggactgctaaacaattactcatgtttaatttaccatccatttttgcaaatattgcttataattagaagtgtataagtatgtatttcaaatttatcaagatacagtgtaatttatcaaggtaacaacttatgaatggtaaaatgaccattctaatatatgaaaacaaaaaatatattaaagttatttacttgaaaatctccatgggttgatcttctaaaagagctagtttattcattttaaaatctgattttgaaaagtacttttttttagctctgttgatgtattatattattgaattttactattaaaatatatttattgattttaatatagaaaatctaaaaaaagaaaaagtcaaaacaaaatacttttagcaatgagaagatgttattaccattaaaactaaaagcttgtgtttaatacatttaaatttgcgttttcagaaataaagtttgcctttgattaaattacatatatattttatcaggaggtgagaattatgtcaggactagtttggttaaatttctacaatgaattaaatattactgagaaaaagcgttgttaaaatgagtattctggtactgaatagcaggaatgaggtagaagactttgtaaactgtgatttttgtcaatctttattaatagaagactctttgctggaagttaaccaaagtgtcccattatcccagtgtgcaatagattaatagagtttaaaataagctccctgatattatagaagggagtggagggctacatactgcttgctatgtaaatagaggtttaattaacacttaaagttttgcatcttcacaggttgcaaatgttaattaaatctgtatttacatggcaagagatgcggacgtagatgcctttcttttaagagccaactaagtttgtctgaagtacaactcttccaaagtgtagcaaatttacatgaaggaaaatttcaaagttgggagaaatattcaaggtaatatagtctaacctcttactcagaaaactagcttctccgtatggtgtttcagaaacatgatgaactggcctgttatgggtatttctgttgataaggactgtactccttgggacaaattcctcattttttccatatttgattgtttaaaaattattctgcagccgttatccctgttctgctctctggagctataccaaaaaaggcagcctaatccttgctccaaccaaaagctcctcaaacacatcaactcaccattctgagactaccatgtttttcatgtcctctatccctagatcatgattccaagtcttttcttcccagactaaacactcctagtttctttaattcatcataagataatattttcatgttcatcaccactctaatcaacttcctctggatgcattccagcttatctctttaaaatgtggttttctaaaactgaacacatcatggcacagtgtaacactaaaattattttcattgaagaagacagtatttgtgttaattaacttttttgctgccatgttataatactaattgataagaagtttgtagtaatctaaatcatctttttagattactgggacttaaaatacagataaattcaattcttaaaattctataattatgcaattgcttttttctatcttcagtgcaagcttttatatgtatccctgttatgctttatcatattgattttgattcagagttcctatgagatcattttgaagtgatttacatttcatttacatttacattgtgtagtcagatgttcttatataactatgatcattagtattttaagggtttataagaatcttaacaaggataaatctaaatatctaaatatttaagaaataataaaatgtatatgtaccatctgtaatctcttcaccattaaacattaagtcaaggtgtttgaacacatacaattgttcagtagtttcaaactcagttaacgacagtgtcattcagcctacattgctccttatttacaaggacaccatgagagattttccttaaacacgttgtagaagtcaggatgctaattataaatagttacgggaaacctagagaaaaaaatgtacatcaggaaaaacccttagacttttagaagttggactgtccttaaataaagcatagtccacacctattactttacatattagaaaaaaaaagtcaaatggcaccctttaggtaatagctggtggcatgactataactaaaacctagatattaacgctattttgactttaagtacaagtcatacagatatatatatatataaacataaattacctttattgggcatcttgaattagcattcttactagaagtaattacgatattgaaaccactgactttttctccctgccttattagaattggttgtcttttcctgtctaatccccttctttccaaaatgtctatactaggtcctcaccatcacaaacttctcacttttgaaagtcattgcctttttgatttaggaggtcattgctttggggttttttgtttgtttgtttgttttttatgtttttcctgagatgggttctcaccctgtcacccaggctgatcctggctcactgcatcctcagtcttcctgggctcaggtgaccctcccacctcagcctcctgagtaggtgggactacaggtgtatgccaccacactcagctaagttttgtatttttttgtagagttgggattccaccatgtttcccaagctgatctcaaacttctggattcaagcaatccacccgtctaggcctcccaaagtgctgggattacaggtgtgagccaccagacctggattgtcattacatttgaaggtcatttttatacccctctacggacccctttgacaaattagttacctctatttctatgctcctatattgagttgtattaaccagtttggcagaatgattaaaattttggttcatgtacctttttcctcaaataggccatgagttacttacagtcttctaaatatttatattctataatgactagaatatagtagtttctcaggatcattttcttatttggattaattgacctttggcacaactttgaaggtcttaagttgttttgcagtagtgaaagaaagcaaatattaccatttaatccatgacttgatgaacagcagcttctttttacaaagcggctggccagggctaaataacaggaaaaacattagctctcattttgggaaattgatcaatagcaataacgctttctgtgccagtcactgtgcgaagtcatttacctgttaccttatttaaattgcaaaacaactctattagaaccccattttaaatatggagaaagtagggctcagaaaggtaaataatacttaacagtggctttgttggcaccgataattaattaatgaaattctaaaataattcattctatgtatttcagaacaagcacatttttcttaaaaaataaaaataatatagtatacatgatgatttatttctcttttattcaatctactctcctattgtctaactatttttttcttagctttatagcagaaataagactgacttatctgaactttctacccttacattattttgcaggagctaatctggacagcaaagcatcttctctttactatgtcaaaatcccattttcctttcatctgtctagtatcaatactgattttatactatagaagatttgaaaaactgacttaatttttagaccccctctaaaagggctcttgtattgctgccaattatagagaggagaaaaaaaaaacaccaaaacttgcattttgaaaaataatttgaaaatagtaccttatatatttcaaatatttctcaaatatgaaatctctgattcattatgcagtgataaccttgttgtgttaatgtttgtgttttcaatcatttgttttggtctcattttctgtccccttttttttaaaacaatggagactcttaagaatttccaacatttggaactaaaatgtaaatgaataaaaaatgttacttgtcatactctgatattttggaattttcttagcaaatactttggtaattttttaggtgaggtacaaaaaaataaagcacctcaagggaaggatccctgtggtagccattttttatttcagatggctccttacacacagtgtgttgtgtgtatttgagtgtgtgtgtttgtgtgaagtcattagtcttttacatgtgttcttgacagtgtaattaaatactaacgtgataccacaaggagtccactatatactcactggaatggaacaaattaaaaagccccagattttcaagtattggagaagatacggagcaaccatgttgtctatggagatgtaaatcagcatggccactttgtaaaacagtatttgttaaagcagaacacatattattactcccatcattcagtaattccattcctagatacatacccaacagaaaaaagcacatatgttcacaaaagataaatgttcatggctgtaccatttacatttgtggtaaaacgcaaacgacttaagtgaccatcaacagttgaacaggtaaatagatgtggtatattcacaaggtggaatgccatactatacatcaccaaaaatgaaccacccccaactatgcacaatgatattgagaaatttcacatacctaatgctgagtaaaagaagtcagatccaaaagagtatatatgattccaatctataaactacaaaatatatatacaaagcagcaacattagtttgtgctattagaagttaagtgagtggttacttctggaaaactgaaatgacagaaaagttttataaagaaggcgctgggtgttggtattattgtggctattgatttggatactatttacaaaggtgtccgatttgtgaaaactattgacctgaacacttatatatacattttttgcatattatatgcacaggttgaaatgtgtgacaaataaataaatggagaataattacattcatctaacagatagcattccctatgcctgttttatatttctcttctaaaataaacaagcatatttggaagttaagtgctataatattaagcattgcttttatgttggtcgaagggattggagaagaaaatggaggcatgtgcagtatttgccaggaaattgcacctctattataaacaaaagatatgtatttctcttgaaattttcagaaaaccaggtaattttttttcaggcactgatttttaaattgtattttcaagcagtttccaagacatgactcattatatctcttataatgaacctgaaggaaaaacacacacaaaaagaataatataacatatatttggaatattttatagcaatgcctctcattttcagaaaatttaattataagtaaagtcctggctaatagttagtttgacagtaactctctgtgttttactgatctacctgtaaattcagtgtttctatttttcttaataggtgtgcagttcaacttccacacttttcatttggaagaccatcatgactacttactgatcacagagaatggcagttttacccaaccactggcacgcctgactggttcagatcttcctccaacaatcaatgctggtctctatggaaatttcagggctcaattgcgtttcatttcagatttttcaatatcatatgaaggatttaacataacattctctggtgagaaaataaaaaacaaaagggctcattcagtaacttttaaaaaagcaatttttcaagatatgagcataactgatgataaaacagtgaaaaatagctggagagaagaaaaattttaaaaagaagaaagcaaagtagtatgtgtcaagttttaaggaaagcttggaatacactgaagattatctctagtaataaataagggaaaaagcaaaaattaatttgctataaatctaccggaagtacaataattacatttctttaatttacaatcctgaaaaattctaacaaaggtcaaaactagctaaaatgcctagtaaacacaaaataaaaattaaaatatatattttaaagtttcagttaaactcaaaaatgaaatgagaattaatccagtgatttccttgttttatgtgtctaggaaaacacatagaaggcatagtcaacaggccagaattaatgatcttaattaattaataataaattatatattttaattatatatataattaataaatagtaatttattattctggaattagataatctataatctataatcaaattaacatagttactcctttcttctagtataacctcacttatagacaatagtattacttagattacagggggaaaaaattgtatgagaccaaagaaaataaaatgtattcccaccacttagagttgtactttccatttgaatgaacacaactagctatttcttaatacagacacaaattaataagtaaatcttatgccaacttgctaacattaaaatgatacaagcactaaccttgttcttaaacaactattttagtatttgggtggaaatgtttggatgctaaaatcattaaagtattttatcatgaatagtaaatgaacataacctagaatgttaaaaaaagtccaagtaatttttttaaagcataaaatattagctaatcaacatgaagcaatgcctcttgttctttgttgtaattacacagtaactgctctgggaatatttttagataagctacttcttcttaggactgtatataaattataatgtttaatcaactctacttttcataccctgaagactgtttacttgttcattttcataatgttcatttattgcctggggaaaacttcctgtaaaaatccataatacaatagttttcaatgtgtggtcacttcagtctcacataaacccttgcatctcaaatcatgtgtttttcagaatatgcattaattgaacttgtatacaagaagcagaagggcctttatcatttaaatgtaaaatattaagcaaaagcatttcaaaagtgcaaatgatttcatttcaaatgttattttgtgtttgaaaatatgcagttcttatgccgtaagtcgaaaatatatgaaataaaaatgtttctaatgcagaaaaaacaataagataaatagctattttttaatttattattcagaaggtgatattttctcatctatattgaataccacaaatacaaatatttatcaagttattagctatttcacagaaaaagaaacgtatgtgtgccatttgtacgttctgatagctattcatatagtcccttctaaatatatgactaggttctaaaaacaataggaatatacctttaaaagtaaccactatcattttctttgtcctttcctcccccgcggggaaatttttctctctaatttacagaatataaccttgaaccttgtgaagatcctggcattcctcaatatggtagtcgaatcgggttcaactttgggattggtgacactctgaccttctcatgctcttcgggttatcgactggaaggaacatcagagatcatctgtcttggtggtggccgacgagtgtggagtgcacctctgccaaggtgtgtgggtacgtggtcagctgctttcatttgcttgtatgtgtagtcactgtccatggagttgcatggttacacccttcgttctttataatctgttgaatttctgcatttatttcacattaattatttcaactttttttctatttggcaatctggtgtaactgaattaacttctctactgctccattcaagaaaccatgcttataaatttgttttcagatagggataagaaacaaattagatagatagatagatagatagatagatagatagatagatagatagaaatatgatagacacatagatatatggagaaagatagatgatatagatagacagatagacagatagaaatagaatcatattttgagagctcacagaaaatagaattcttgtattctattgatagtatattctgaccaaggttttgacaatattttataacttaaaattaacatgcataaaagatgattacaagagaaagtgccaaatgaagaataggtaactaatttaagggctcttaatgaacttattggctcaatatttgatagataaattaagagagctattcattcatgttgtgaaataaaaaataactataattaaagtgttggaagcgtgaagtcaccatctcaatctttggaagtaaatattttgactgataaaaagaaaaaaatgttcggtagaaaaaaggcttttcattaagacttaaatcattccctctttaaattagaaaatattaaggccaaaaacttcttgctgtttagtgattatcagtacatcttatgatagaataagattcaaatggccattttataattattttataaagctattgaaaattatcacaagcacttaatttgattaattataaatctaattgtgggtcacaaatctatgtaacttataatatgctacaaaatcaggaaaattggtagagatttgaaatgtggtttaagcccctgctctttactatggatacaaaatgccctgcaggttgaaatgagattgaagaagttatatcctttttgccttattcaatatattgtccaatatatagaatgtgggaattcctgtggaaccacaaatcaagccaaaaaatatgatcatccaagttagtgtgggtctgaagtcttttattgtaatgagattgttttcaagatacctagcagatgaaatttctctttaaaaatcacagatttttatagaaatggcacaagcaaccatagaggcttgaagttgggaggtgataagtaatcatactctcagggcatcttttccaggagctatgcagggtgcatttttttttttaaggacattttgttgttactactgctactgcttactgccacatttgaaattcctgtactttacttcattatgccaattttcatttttgtgactgttttcgaaggtacttaatgaaacctttggaatagtccaagtgagggctacagagtgcctgaccatttgatatttggccaattcacttttctcaacttcatttttctcatcagcaaaatgtttgcaactgtagcacctaactcattgttatgagttagttatgaggattaaaagaaattagtcatataaatcagacacctggcacaatcccttgaatataggaagcattccgaatttagattttattttaactaattgttttgagtataatctgctgtctctccagcctgtcaacttagtttataaaatcaattacagtgggaaataattccattttataaaacgctaacattataaggacctgctaggttcttttatgtaaagtcatctcatttaatccttactaaaatcctgatattattatctcttccatttttcattagaagaagcctgaggcttagagatgctaaataacttgcccaagatcatcaagtttgtaagaggtagcactatgatttttttgtagtgatctgtttcattccaaagcccaattttttcctcactagtgtctagggaaacgtgattctagaaggaatctatcatagagaactaacattttctctcagagtaaccgaatacatgccaggccgttacataggttgaaaaaaaaagtgtttacatgtacatttaaaaaatttagtttatatttatgatatattttaataaatggatctatgaaaacctgacattgcaaaaatctaccattgagttaattttgttttattaaggtgtttctttgagactggtttattcgtacccaaatctttaatgggaaggatgaaagaaaattaccctgtggacaaatttagaaagcaaagttattgccatgggaattcccccctacccattttcaaattagctgtgcttgcttttaagcttattaaaatttacaattaattcaattgaccttaataaattccacggtaggcatacatttaagttacaggatggggagaaatattcctttaaaaagaaatgttttttaaaatgttactcctccaatttttttgaacttttttctttactgctttgcttatgcttcaaaacaaatttgttccttcttgaatttctgattctaaacacacgtatgtgtatatttcttattttgtttttttttccatattttagtctttattcacataaaatgcatgttatttgtagccattcatctgagcagatgtccacttttaggaatgttagtttatttggacagcttttatttcttcttaacctctttgtactttttatttcatataccctaacaccaattctctatttcatacttgtttaaaaaatcattatttagtcttcagcattgccaactgcatagaaagcctaggttaacaatagccaaattttaagtaggttgtatttcaaaagtttgctgctgtttcagttatttggaatctaaacattcttttcctggcacaagggtacaaatgatggatacactcccagaacaagccccagatgaggttttaaattttatacaaagtatgaaactaatattaacgtttactaaagcgatttgtgtgtatataggttatataaggcatctgattctggatagtaagggaactgataaagctagttttggaaacttactttacattttatttatatagattttgattcaatatttagtgtacaggttgattggtatcttcatttcttttggtagaatttggcaaaatttatcttattctggatgttgaatgaggaataaataaaatttttctttaaacaatttcctacacaagctctgcatttaagtttaaagtttaacaaaatattaaaatgtaataataccataatatggccatttacatctatgaaaaattctgtcgtgtaatatctcattccaaagactcccaaatattgtgaaagtaagtttaatacaactatcttatcagtaaagatatgatgtctataaaaatactcaaggttgaacacaaacccaggagcagatttatgattatcacaatgttccgagtctaagtcctgtgtatggtccacagtagtagcacaccattgtctctgactggagactttgataaagttgggaggaaatctggcctgcattatagttgatacatggcttcagagaacttcgtatgcttgtcctctatttaactagaggaaaacttcttcaaccataatccatttatctgatgttgcttaaatgcagaaaaatttgtagaagcaggagaataatcttgacagaaattaagagtataacaggaaaagttttattacactattagtagataagcactcaatacacaaaatctcgtttactagttagtaatcaagatgaaagttttactatctgaaatagatatttatgtatctgtaattatacttcacattttgggaaaaactttaaaaacagaaaaaatgatattttagttaagatgttttgtatttgaatgattttcctggagagccatgtttctcaggaatgaatatctgatcacttgtttaagtggcaaccaaatacccaacagcaaaaaaataaagtaaaataaaacaaatataaataaataaaaaaattaaaaactaccggtaagttgataagttgattaaaataagaaacactttccttttttgtttaagatataagtacatgatttctttttctaaagtttacattacaaaaacactgtcatttacgttgctatctttttaaatcaggaaaaacttgcatgtcttcactcagcatccaaatataccaggaaccaagccaggccatgttgcaaataaacaacgagctaatgaaagaacatgttgttttggaaagtagattagcaagttaaatattagtaatgatttgtctttaggcaggagtccacatattttaagaagcccacacattttgaagtgatttcaaagacattaattcattcatcctcataatcccccatttaatacatcttcttctgtttctaatttcgtgtgtcattgatttttttatttgaccttggacaagtaacaacatcttgccttaatcatgagtcaaatgataaaaatgataactctatattacacatctacatattattctcacttttctgacctttcagatgatatatgatgatagttatttatttcttagtttaaaaatgaagagagcaaactgaatgtgcagcatatatgcgaactgtctgtactatcattgtaacttctctgttaacctaaaactattccaaaatgaaaatgtattaaaaattcaaaatatgaaagaataaagtgcatttgaagaggcaatttctcttgaaacaaattctatttactttatcttaacctccaagctctctatactaaaattatatctatcagatgcccacatatgtatatcaaatatgactgatctatccagttagtcagcattgcagatatatggcctggtagaaagaaaattaaaaatcaagagacttagattgatcgtagagtttaccattaattagctggttaatttaggcaaatgccttaattttctatatttttcttttctggaaaggatgatgccagtatgagttctatttaacccaatttttttttaagatgaaagaaaagtgctctagtgagtaatataaagaaatatatatttacttctctcttgtatgattaggactgaatgcattgatttcttggcttaacaatataaaagcttctagaatattaacttatatttgttcaatgctatctacattttttaaagagtttattgctcacaaccttatgaagtaagcagaggaggtgttattcctttttagcagtttagaaaatgcatgctcagaaatgttacaattaataaataaaagaaatgtacgagaaacaaagatttgtaattcttagatgagtgttgtggcatttcaagcaacattcatttattaccttatttattgatgcacaattttcaagttagaagactatcgtttttttatacaatagaccaggggtgggcaaactttttctgtaaagtgctccacagtaaatatttagggctttgaggccacatggtttgagttacaattactgaactctgctattgtattgtgaaagcaacaatagaaaatacataaatgaattgatgtggctgtgttccaacaaaactttatttacaaaaacaataatctggatatggctgtggagccatagtttgctggcccttgcaacagacttatcaagcttaatcaacttaaatatcccttttgtatttgggcatttcttagtcattgatcctttagggaaagaagaaaggatcctttacctattctctaatttttcatcctgggctccatttattaaactcataatgtatttattattaagaggaaatatttctcatgtttttcaaaagagactattaggagtgtgtgtgtgtgtgtgtgtgtgtgtgtgtgtgtgtgtgtgtgaatactgatgtagtttgttggtaacataattctcaaccatctcaaaatctatccgtatactcaaatctcttctgagtacactggacctctccatatggatgtcctcccacaagcacattgactttacactgctaagacagaactcattatctcctcagccaaatcagcctttctttctgcactctttatttcagttatggaatcattcttattcaatcatccaagctagaaattgtattatctttcactccttcctccctctctttttatccatatcagagcagtccttatgacttaccacctaaaaatattgctcaaatttaccactattttcattctcacttcctttgtcctagcccagctctcattggtcctcaaaaagattaacatagtagcataagaataataatacacggcaggcattgtgttgaaccctgtgtaaatatttcacttcacataccctttatacaaaccatttaagaagatattatcattccattttataatgtgactaggtgattaactacagaacttgataaaaagcttaaaacctactctttctgactgtcatgttcatattttagcagttatatatataatctcattgtgttacctcttttttcctagctggacttcctgtttccagctttctctcatctaatttatcttcaatattataactaattatattagatttttattgatgagtaatagattaccacaaatttagagactttatacaatacagttactttctcatggtttctgtgggttgagagtctgggcatggtttagaccctcttctcagggtccacagactacaattaatgtgttaaccagggctgagttctcacctgaggttcagggtcctcttccaaggtcacatggttatattggaagcaatcagtttcttgtgttgtggaactgaaagcttcaattctttgctcaattccatccacagttccttaccatgtggtctacaatacagctgcttacttcatcaagccagcaaggggtgtctctctggtgaatctgcgaggaagatgaagttttatagaaggtaacataatacagggagtgatgaggagaaagccatagatcctgcctatactcaagggaaggagattggcttaaggcataattgctaaaaaaacaggtatcatggggttcaacttaaagtctgtccaccataccagttatcctttgaaagaccagatcatctgtctattccctgcgtaaaacactaagtttgacattgcccactggataaagtcacaatttcttaagtcctttcatgagttggctttagcgtcttctactgacatttctttacatggctatatgcatcctggaatatagccacaagatgttacatgccacttgaaaacatgccaaccattttctatactttatgattttaaggctatattgaggtctagtgcatgcaaatgaccaaattctcacttgtgtttacataagcaaacaaatgatttttttaatctgtaagaatatgggtttaaaagtacagtaagaacagcctgagcaaaataatgagaccccttctctataaaaaattatctaggcattgtggtgtatgacggttgtctcagccactggggaggctgaggcaagaggattgcctgagcccaggagttcaagggggcagtgagctgtgatggtgccaccacactccagcctgggcaacagagcaagatgctgtctctaaaaaaataaataataataaaatcgcagtgagaaaacacagaaatcattgtttagttgctgaagcagcctttgctttttaatctgttgagctccattcccattaccctgtcatcgttcaagacagtattatctatcattatctaccttattactgtaatagtttaaacagcactctaatcttcattcttgtgcctttttccttaaaccaaactatggagtcagaaagaacctcctgtgatgcaaatttgattatgttactctcttacttaaaatctttcattgttttccactgcccttaagataaattctgaatattattctcttaaccccaatctccactccataatttggcctaatcccttcatcctttaaagtcacctcatttaatcattctggtaagctccccttgacctcccaagagtacgttagatgtctttcctatgagttgcatgagcttttccatatctcccctttctagatttcatcatgctatattgaattgcctttttatctacaacagtgtttagcatatagaaagctttaagtaaatttgttgagttgataaagaaatgaatatataatatcgacaaaactcctttacttccacattttcaacttactaactttcatttacatgaacaaagctgtgctccagaggaaaatagagtcaattctgtctaactccaataaaggactataattgccatttcaacctcagctgtcacactgttgtttagtctataatgcatttgctgtgggttatttacacacaatctctcaagtctaataagtaaaccaaccaaccaaccaaccaaccaaccaaccaaccaagtaattaagatgcctgaaaagactactaagaagaagcttatgattatgattgatagaaacaaaaagataaatttataaaaattgaatatggtgagaaaatgatgaattctgtacctgtatatggaataattctttccctaatatgcagtaaaattcagagcttaacagggaaaatagctgactcaaaaactttttcaatgagttaaaaaagtaaggtaaaaaaggtgtgtgatagaaatagtatccacaagattgcgagggaccaatacacatgtcctatttaatgaaattagattgtggactgtgaacttcaattcttattcacttgggatttgtagacaaacaaatttacagacatccttttagaacgcagccagtcagctcattaggagataaatatctgaatttattttattatactgtagctggcacatgaataaggatgattttacttgatacctgtaagtcctttgaaggtggaggctggatcttagttttctttatactttctgtgtgtctgccacaaactttggcaagtaacaggtgctcattctgaacagaagacagtataaagttaattcaccatgtgatcatcaggaaccaacttaacagagtagaccctgacctatctatatggtgattcacccatagggagggtttcattgattctcatgttattaaaatctcaaatctctttggataaaaatttttgagttttatgaggacttaaaatagaagactcctaaaaatacctcattctccatatatgtccttatgctctgactataaatcttgttacaagccaaaatttgactgctaattggtaagttcaaagataggtttggggattgcagagaggacacagactttttaaaagagagtttgaattacagaagagaggcaaagagtggagtgttgtgtggaatctctgttgcagagggtcatgtcctagaagcaattgcaagagtgagactctcacacgagaaagaattacgaaagtgccagaaaaacttgctctttgtctaaactctgggtgacctcttcctagttttggaatttgcccaagttcagaaatacctagagcatactttttctttggctatgtctaagaaatttaacctagacatattggaaaatatgctggaaaaaaagaaaaactataatagacctcaaagtagtgctttaaagcaaaaataaatgttataatattaacctagaaagtatgatattcatcaactttgccatcagacaaactaattttggtttttagcttaatatatctttacttaattaggttacttgtccctagtatatattaatgccagataaggaatattttacctgaggtaataataaaagctaatatttgctgtgtgtttactgtatgctaggtttggtcttatgagctatgaataagggccctgagacacagggaggttaagcaattttcactaggaaaatatattaacggtatttttattcaaagcaagttagattgggagcaattttttgctataagtcgtaagaattaaaacattaaataagtcagtgtagttcaatattctgtatgtatccccaaactggttcttgcttacaacagtgacatatgtggttctcaggaaatactatcatttggcagtgtagataactggagaagataattaaatgataacgctgcttataactgaattagatcttgatgtcatatctcaggagagggtaggatttaattgaaattggaatagactgacagtacctaaaattattttgaagctgggaacaaaggtcattatcatattaggtaaatagattttaaaatttgttctaattccattttttaaaaataaaatccatgtgtctttttgttctgtatatgtgtgtatatagattatttctacttttagccttataatattaaaaataatagaaaatatatatgccattaatacagaggctgatttctaataattggttttattgtttgtcatctggtaatgcacttagctaagataggttcaaatgtacctagggctttgaaaacagacaaaaggacattggaacaaactaggactataaattagtaacagtgcattatactgagggaccaactggccttgagtttggtggcatcaacaggggtgggcttcggttgaatacgagagagtaggactgccattattctgcctagtaaatgcattcagtccctaacgaaaatattatcggtatgagataaaatgaatttcattttttcattatcatttctggttttttttgatattttgtctttacctcaaacttacccttctcaaatccagctccttcactgcgggataaagtagctgaagtcattctttgtttattataccaagacagttgccatggaaataataaaatgttataaaataggcatcataaattaaatccaaagtcaagaaggaacatatgggtcaggtagagactgtgtgcttatttaaataaacaatatctttggtaatcatcaaaaatgtcaaggtaagttgcagagaaaacatagagacaaatgaacttagagctttaggaagttgtttgcagaatgtaaatattgcacttcaagcaggtgtttttcaaaaggagttaggggattatttacctcccccaaactacttttctggctataaaccatttttctacatctgtgtattgtacccaagtactctctttgtagcactctttgaatcccagctcaattattggtatgctcaatgtgtaagtaacatttctcttcatgtgttttaatcagtcgacaaacagtgtatttcaaaggtgatggatagcttttatttcatgcattttactatatctttttgaatttgaactagttgatgttttgttatatctgctacagaatgttgcaggtataaaatattaaccttttcatatcatataaaacttgaatctcaattgaatctgatcactattttctaaaagaaattctgagccttttttgtcctcaaaaatgtttgattttcatttttccagacattgctttgtttttctgataatataatatgatttctcacttgttcaatcatgatgtttgagatgacttgatgtaatgtgcttgtgtaaaatactgaactaaggcttgccttgtacctataaaaggtaaagtaggttataccagttttcaatttagaaaatttttaattacactccactgactagggtctaatctgggcatgccaccttatcccaaatttcctatgactttggaaaaaaatattaacatgtcattacagatttgtttctcaggtaaaatttcaaggatatcatcactgactttactatgttttcttttctttttttttcctctcgaatcccctcccctgcaacatactcatttgattgcattgtatttattgatcttacaatgcctttctcctaaaagcaaaaacaaacaaataaatatacaaataaatacctaaaaagaaacaagcaggaataaagattacatgtaaattgcttaaatttaatgggcatctcatttgtgagtctggcttgtcaaaaccaagtgccctagatatggaaatcatatctcatatctttagagaattttcaggcttttagtagtctgccaaaagctataagggagaaagaagtgaaataacactattgagtgttcagcatgtacatagtgataccttgctagtacttttattcatttatataaaagtatctcacctggtactttatggtatttctctcacttacttgcaataatcttagtaggtagtcactaatctttctagtttccatattggaaaagcagtgatcagagagatgaagtgattcatgataagtgtcaaagctagatgtaaagaatagatttgtctgtcttccagatctcatggctaaggttctttacttcatactttgtttatttgaattgtccagaattgtaataatgacttgaagtcaagcagcatgaacattttgagcagcatacaccttcagtggacattatatagttttattttcttcaggagaaaaaaagaagactaaaatagactaaaaataaagttctagaatttgccaaagaagtttttcttgaatttgtttactgaatttcaggatatcgatttctataatatttaagtcattgccaaatttggaaagcttttaagaaacctttctttctagttataagcattctacataaaatgtaaataaaaataaaagattaaattgtagtgaatatcataatatgttgttacaacattaaaattattcttttctttgtgcatgggtgataatgtagcattaaaaattttcaaaaaacttttaatatctattacttacactttttaaaggagtatgtcccctcctctgccatgaataagtgttgttcatattaacagatcaggattctctcattaagctctcttaacatctagatttgggatactctaaactcagccttttgaaatttagccttcattcatttattcactcatctattcattaatttaccaaactgagtttaagtaacaaactgtcatgctgtgctaggtgatggtgatatagaaaagatgaactagacattagcaatttctttaagacaaatgatggatttgatatatttatctatcccactattcaacaaaaattaaatcaatataattcaacaaatatttaattagcactgagttgagtagcaaagataaaaatgaataaaatagggaggggggagggatagcactgggagatatacctaatgctagatgacgagttagtgggtgcagcacaccagcatggcacatgtatacatatgtaactaacctgcacaatgtgcacatgtaccctaaaacttaaagtataataaaaaaaatgaataaaatattctcatcaatgaagttctactatattgtaagggaaaataaatatctaagactaagtatgacactatgatgtgagaattaggaataaaatgcataatgtagcaaagaggtattttttttgtgtggaaggatagggaacagcttctcaaaaatgacatatttgtgaaaatgtgcttgattctgccaaatagaaaagatgagaaagtcccgctaggcaaagtgaataacattagtaaaacaggtaaaactgatgtgtctacaaatctgttttgggcttaagtggcttttttgcagctctttttcgaatccccaattcaactgtaggtatagtcaatgtggagcaaacacttctttcttttttgctttttaatcagtccttgaaggacacagtttctacaatgatgaataggtcttatttcatgcatttttctatgttgttctgaagcctcagtatatgttttattagaattgatatagtaatgaacagcagccctgtaatagtccatatggactcagatagaaaaactccccaggttcaaatcttgttcataacttagaaactgtggcaagttgaaaaacatagttaacccctctgactcccatttgtaaaatggagatataatgaaaatttattaagtatgttgatttcttatgatgattaggcactatgctaagtgatttgcatgtatcaacccattcagtattctcaacaagtctgtgatgcaaaaaactatcatcatcatctccagtatacaaatgagaccaatgagatacacagaagttgcttaaatagctacgtgtgccagataacgcaatactcattgcgttacttttacatcgttatagagtccctattaattcagcatgaatgaacttaaattcattcttttgcatacggaccaaattagaaggcctaatctgtcttcaagaaatgtgacgttgaaaacacaacattcatcattgttcggtctaagaagataaggactggacaaattaaaaggcaaacaggacttagatgttggagaacattgtacattgtttaaaaagtgatggacatccattacggtgttttaagcaaagaaataacatgtttaagtttacatcttacaacatctttcagtcacttatatttatgaataacaaatttaggcttccctagctttagtttgctttactgaagctagggaaacctgttaggaaggggttctaataccccatacataacatcatggggcagaacagtaaagttggacaggagaggacatttttgagaattgaagaatattggtgctaaagatcttcagaatgtttgattacatactccttaatttgtttaagttatatgcagaaacgggtattccctaataagatcccaattcctggaataaattaagacatcttcaattcagacgcaaatatttggtttcccaatcggaattcacacagctcctgttttatgtgttcttccactgcttttatatgctagctagacctcagacctttctaagagccaatctccttttgagtgtaccacagagagagaatgagaaatactcactactcctatggcatggttgttaggctccagacagaggcatattccagttgaatacacagtctggagatcataagagagtccatatttgagaaaaagttacaggatattagcatatagatatttttgaaagccaagaaattggataagatgagcaagagagtaagtttagactgagaagaagccaagccctggggctcagcaatgttgagaaatctgggagatataaaagagccagcaaaggagactgagaagagggagtctgtaaaatatgagaaaaacaagtaaaaaaatggtgtcctagaggctaaataggaatgatttcaaggagtaagggataatcccttccacaaatgctgctaaaatgttgaaaatgcaaatatacatggccacaaggaaaccattggtgaccttgataaaggcagcttcagtgtcagagtggagattgagaaaatgggaggagaattgcagacagtgaatctagacaactcttttgaggaattttgctgagaagaaggaaatgaagtgaaatgaaatgctagctggaggggaaagttgaattaatagagattttacctttaactttttattataaaagttgtcaaatatgcagcaagattgccagaggatgtctgtatacgtactatctgggtttaacaattattgatattttgccatatatatttttatttttatattaattaattaatttattttttgagacagagtttcgctcttattgcccaggctggagtgcaatggcatgatctcagctcaccgcaacctccacctcccaggttcaagcgattctcctgcctcagtctcccgagtacctggagttacaggcatgtgccaccacacccagctaattttgtatttttagtagaggcagggtttctccatgttggtcaggctgatcttgaactctaacctcaggtgatccgcccacctcggcctaccaaagtgctgggattacaggcatgagcgactgcacctggcctgccatatatgtttttatgttacattttctgtaacatttgaaagtacatttcagatgttaaccaaagaccaatgagatatgaggaggcgaaaagagaattttattttctaaaagcaatcctcaaattggagaaatgcagcctttggtgcaaaattaaggtgtgatcccgggaaggattaaggagtaggaaattatagaggcaaaaaacacaagatgcagtaggaggcggggatcaaatgcagggtctggactggatggcttttaagcaagacatcacgtatctctttttattggctggcctcgggaagtctgttggtggtcagttgattaatttccatctgcaatctatcttggccctgaaaacaggaactggtttagcttatttgtagaaaggagggtactgtgacactttcagaaaatcgctttgagaatacaaagtacatgactgctctctcaccaagccatggcctactggttctgttttaacttcgagtgcctcaattagccatggggaactcattttgtctgtcagctgggacatactttaacacagacatcagatatttcactctaaaatattttaatatgtctattttcaaaataaggccattctcctacatcattgtagtaccgttactacatttggaataatttaacatacggttcctactgaaatttccaaaaatttcccccaaatgtctttcaaagctactttgtttttcccaaagtaggaactaaatcaagatccaagtgtactctttttattctaattctttagtatttttttcctatgacctgacatgttgaggatattgggccagttgtcatatagaatattccacattctggatttttctgattgctttcttgttgtaacattgaacattttgagtcactatacccccactcccaaccccactccacttccatccctggttatttattatgtaatcagcaagttaagtctaaagccttgattagattctgattgaactttttttgttgtttgtttttaccgtagtccttcatgggtgatgctttaacatcattttagatctcatgggtattatataatatcttaatgtctcactattatggatactggatactgtttgatcacatgatcgaaagtgatttttttttttaagataggagaaagatacaacatgtttgtatgataatgaaaatgatccagtgagcaagagaaattgattatttaagagaatacccagttagtagagtgatgcctttgggtgggcaagagcaatgtgcaaactgagtagctggccttaggaacacaaatggatcagcccaaataatggatcacatcagaagaaaatcagagaaggtggccacagatgcaaatctgtgggacaatatggtacaagttcttttttgattactttccttttctctgtgaagtaggaagcaggatcatgagctgagagaaaggatagagaaggaaacattgaatcttagagaagagaaaatgtatgaaatagtagttaaaaagcaggagagtgaatggaataggatatattgaaagcaccaaaaatgggacagaagtttcattttgaaagggtgataataaacctggagcttaaatcctgtcaaggtatgaggcagctactagatgactgcaacaggagaggtacagtatgataatatgtaatctgagccaaaaataaaggaagaaatatagtttacctaacagcagtgattagcaataagcaattctaccccaactccatcccagtagaaaatggagtatgggagggagaatagccactaattaagaaaacttcagagaaagcaggaaaagtaatattatcagctgttgagcacttaataacacaccaagcactgatttaaaattttacatatatgtcatcctcataacagtcctaggtagacactattcaaatgtcctttgtatagtttcagaagccgaggcacaggtagtttaagtaaaatgtcatgcaatttataagtggtggaatcagaaatcataactcatatgaataattttaataaaaagatgatctggaccaaaataaagatgtaaatcataaaattatttgaagtgaattaagcccaaaaagaaacagttataggagttaacttaatcatgaatatattttataatatattcaggcataaatagagtggtttcagtattagccctcctctctatgatactgataaagcctatagccagaaataacttcagttaatgcctttgttctggcctagattttcaactttctttatggttggtccttactcctcattgccaatccacattgtctgtgtctatactccatgatggtctgattgaacagttgcttttggagacagagctaggctttgtggtacttaaagctcaaatgatttgggggcactatctaagaagaattttttaaaaatgcgaaattagaaacagttccttggaaggaacccaggcatccaaggcatacaatgaagataaacttcatttgtaagtctggtttaggatgtttcctcctacaaaaaagttgtgccttcttttcttgcaaaggaacagtacagtccttaaaatataagccttctgtcttgactatggcttaataaccatatttatattctttttcttttatttctatttctgttcctaattattatttctcaatttgagataacttaagagcttcaagaattggaagtcttctgtttaattcctttacaaagtgaaagacttctactctcaaaaaccattctttgattgaagaatgaatcacactaaatcttactgtataccatgattttatgtaggaaaaagtatcttttaggtgattttattttaacctggagatctctttttcatcttaatccagagaattttctttagtagccttaaactctctcttgtattctggtggatatcaggtttcattactttttctggcaggagtttcttctgcttctatgtaaatacatgaatgcaaagaggtacataaaggagttgccctgtccaatcctactggcagctacacatatgagaattgaaggaaagaaaatgttaaggttttctttgtatgtaaattgaagtgaagacttggaaatggcttgttaaaaacatatacattgagaagtatcttggataatttctgttctgtgcattatgtattattctgaaagcttggaatagaaagtaattatcaatgtacattaagatagatagtaaaaatcataatcattgaaatcaactgggcaatgactggtaacatactagaacttgactcataacagacaaaagatagttaacctgtatgtccactggccatggaatttctttcttaaaataatctgaaatttttagttttagactttcaagaatcattgtggaataaacaacagaagaaaggagactttttattcaatgagataattacagatttgaaactgccatgtactttactaatgtgcttgaatatttttagctattgtggtttgttttctcctaggtgtatttacacataatctaccccaaattacaaagattttacttgtgttttaaacattaattcatgcacttatctggtccattttaataatggcctgggccagaagtatgcatgttttacaccacagattgccaatattttgcccaaataagaaaaaagttataaatcaatattcttttctctttgtgttgagacatggaagatcaggtttgcatttaatattaatctattgcttacctaactatacataatctatattattttattgtgaagattttgcacatgcattactctgaaatttgtcaaggaagataagcctatagagaaacagctccactatccaatgagtgtcctgatgaccttgaacatttccacgtaggtcacataagtgaggctcatcttcagtctgacacaattcttgagagaatgttctggggttccttatgtaataaggagagacaagcagcctaatgtggaattgccaccaggccttttccaattcatctccctagtttcagttgaacacaggactttacacattttccctcttaaaggtacattttcaggcttctatataagcctttaaaaatgcttggctgtaattcagaattatttcctcaatgacagagtgacctttccttcccttcaatatacatgctttcagctgccaatgagattgggcaggactactgctttatgtacctctttgtatgccatctgccatctggcctgtttggtgtcatcccaggggacaaagaattcagggaactgacattacgctgatcttgtgtttcctgtctgtgtaataaactgtctgaatccatgtgttgtcaccttaccagccaaatccatgaaagagtggtgagtcattccatttgctgcacttgtgacccttgtggttggattagacattggattgattgttggtgagggactacttgactacttgacaatgccataattcattaatataatgttctgaattcaagcattcaataaatgcccatagcttatttatctcacatggtaggagtgctgtgcagttcgaagatcacaatatatgtaactttcaagctatatatgtagatgtcattaaatatatatttctttatctttaaaataaaaataccactaaaaatgcttatgtcatacatgaagataaactgagataataatagatataatttttgagtacttaccagttatacgactctgttccaaatccattatgcatgctaacttatttaatctacacagcaaccacaaatttggcactgtaattatactgatttcacagatgaaggcacttgagattatgtaacttgcccaaagtcacataggtaaagcctagatgaggactcaggtattctgactcgagtcacttttaattactgtattaagttgtgcctgtagttaatgaaagtgaagttcccaaacattaccatttcgatggtggcacaaagaagcttcatggccactgttcatggaagtatctgcttctacaaattaaataacaaagaaagggattttcttttctcaattccagagataagttgttggagcctttcggtgaaaacatgaccaacacttattttacatcaatatttccttgtgcagatggaatttctgtaatagaatatactattttcaccgttcctttgttacattttggctatagcagctccagtgtcccaaagggcaacagacatatgcccacaaaactgctccagaataccagaactcttttttcgtatggtttatagtatataggttacaattttgtctttctttaagagccatgtttggtgacagcctattatagaattgcatctagtagttatattattggttaaatttcatgatgtaggcgtattctatatgttgtccaacatgactgtaaaaatcatttatttgaacttttttgctttgggccaaagtagatttctgcatgcttctaggtaccaattactgtgctatcttaactatctggaaagataaaaaaaactctcaattaaaatttgcaggttcagtaatatcatgactactctatggacatttaaaaaggcattttggaaaatgtgtttaggttctataactaggtttactcttggggacaagagcccatatttgttcaacttttgtcaaatgctatactgtcatggttcaaagctcctaaattagtctcatccactatgcattcggacagttcaagttcatgcattttatggtagaatttgatatgctacattttgcatgatctaagtggaaggagagggagattttattactttccaagtttagctcaaaatttgttcacgaaatacagacttaaaaattgtcattggttctatattcttttcaaactaggtacaaactttaaactgtatattctataagaccagttgttattttctagccctagaagatatgagtacagtttttttttcttgttatgtctacagttgtctcaatatctaatggataagtttaggaaactaactcaacaactccaatttttatgctagaccataaaaacaactgtagagtagttcaaaaacttaaacacggtatctgaaattgaattaccagccagagtaaaaggtagcatttatgtactaaactactttttaagaggtttttgaaatattcaaattccaatcctgataacggatccctgagaggagaatagaacatgggatttaaactaaaaaataaaattcaatatctaactttgtatagttcttggtttaaaatactttattttaaaaggaaatggttacttgtaagtctaaaaaaagaaattctaaaaataaaaagctctagatggaacagatacacagaacctctctaatagaagtattcacttcatcctgaagtggtttgttactgtatatatatttgtgttttggggaaacggccctgggagtgggggacattgaaagttgaatgagtaaggaggagaaaaagatggggtgagggcagagagataacagtataccgggtggggttctgtgggtcattacaaaggctttggttttactcagaataagatggaaagccattaaaggattctgagcaaaggcttgtcaaagggacaaacatatagtgatcctagaatatatgtcataaaaggctcattcaggctctaagttgcaaatagactctggggagcaaaagtggaaatggagtggtgagtttgctaccatggcaattagggcactccagctgcagggttccccttgccatttcccccaataggccaagcacatcctcctgccctgtatttgctattccctctgcctgcaatgctttttcccaaatatcttcatagttgcccatttgcttccttcagttctctgctaaaaagtgacttttaatgaatatcccctcaatacttcctatcctccttttctaatttgcttattctccttagcacatacaaccatctgacttattgtttaatctaccaatgtttttaaataaaaacaaaattctacgacaaagttttgctttgttgcacaggttggtctcaaactctaggcctcaagcaatcctccgaccttggactcccaaagtgctgggattacagtcatgagccaccatgcctggcctaatctgttaatttttctatatttggttattgtcttatctgctcaggagaatagatacatcatgaaaaaggcagttattatttatctttcttgctcttttttttatggctggatctctagcacagagcatagtgtttggtacatagtagatgctcaacaaatatttgtgagatgaatgtaagaatgtcacctacaatcactccatagtatttctcttgcaaagtgtagtgtgccaaaggctggagggtatttccagttaaaatgaaggtataaggccatgtggcatttcaaaataaacatggtttacaaccaatttggttcacatctttgaaattatgtgattattatttttattgagttatttacataaattgaaactgtttatgtaaagtaagaattaatattttaaggtatttcaaatgtgcatgatttaaattaatataaaataaaactccatatatgtaatctaccacaagaggatttctcctttccatttatgctttatagagcactttttctccaaagaagtttaagcaagcaaaccaaaaaaatgaaaacaaaaacctctattgtaataataacagtaggggagaaaataggagcagtgggagaaaaacagagaatagcaaacatggataaaggaataataaaattaagacacctttaggtgacaaccttttaaaagaacaattaaaccacctgtagactgacgatcttcttctcagtaattttataacacatagactttcctttaaaggttagactttaggctgggcatggtagttgctgcctataatcccagcaccttttggaggttaaggtgggaagatagcttgaagccagaaattcaaggtgagtctgggcaaaaaagaatctcagaccaccccttcaaccatccccctccccgctgcactcctctgtctctcaaaaaaaaaataataataataattagccacgtatggtggtggtggtgtacacccctgtgatttcggtgtctctggaagctgagactagaggctcacttgagcccaggagttcaaagttaaagtgaggtatgatggagccactgcacttagcctgggtgacagagcaagactccatctgaaaaaaaaaaaaaaaaaaaaaaaaaaagaacaaagaaagaaagagttcagaaatgtttttaactgggattgtctaaaaatatacatgcaggatcacaatgtttttcttttttaagaaaatgtcctcagaagaacgctgtttcccaactctgatcacagcttatctactttagaactattagtgttgctatgaagaattcgagagggtctgcttgccgttctccagctgatcctataatttatagtctcttagcatgtttccctatactgcaatctcttccctaaattctttggatttcttaatcccacaccatttggatacaagacgagaatgcaaagctacaatataaggtgaaaaatcctcaaagaatctgaaccccatcaactgttcctaagaaactactgtggtgaagaccaatgaaagggatagttttttatttacatccatgcagactttaggtctgctgaaataaaatttagtgttcatatatctgttatacctggctgataatttgtctaatgatcgtaagaaccataatgaaatgagatttttttctcaggaaaatcaaaggcattatagaattgttttagcaggttgtattttatgcttttaaaacctgattaggttctctttatctctgggctttcctcaactaatataggtaaaattggttatttcattcacagtactcccaccaaacttgttcatatttgtttttatggcacttagcgcatcacaaagcaatttatcatttaatctatttgtttaattcttcttactcccagcaaatagcaaagtgactgctttgtaataggatttgtattaatctatcaatggtttaaaatgtaatattttaattcagaatgctatattttacatgcttagatttatgtcgcataagtgaaatttgaatatattttgttttatattgtcaaattgtgtattttgtatgcacacttgcagtccagtagacaaagaaggcacattctgaatttaatttcattagctagaatctgtaatgggaatataaaatgactcaacatgtgttgttgccagcaacaaatgccaccctagtacttatgagtcagatctagtttgaatgacacagccatctaaaaagccaatagtctattatagagcatgttttagagcaaagcatacagctaaacactatcaatacttagctatcatgcttctcattatttattttaaaatttttagatttttgttatagaaattctaagtacccattgaaagttggactactcgtctctaaagaaacttttatgtctcttttggctattaacataaagaagacaataactcactagtaaaattaaagtggttaaacccaagatggtttatttccttgaataaatttggtacacttcagagaatgtaaatattctccatgatacctataagaaatgcttttgggaagatattcatcaaccagatgtaccttactgacctggatatggtttaggattgggaggcttgctcctaatttttgtattcacagatgtaaagtcaaggtttacctgcattatgcgtggcatttctcagtcattccatctccatgaaatttcaaacacttgagctaaaatttgtcataatgaagaattgttcacatactgattttgtttcctcttcatataattattttacaataaagctttagtccatagtaaatcctctcacatcttaaaaattcatctataatgtcacattttccaagagttattgtttgctttatagtatataattattgagtactttgcatgatgcatttcaatgcaactcgaagatacagaggaagaaagcatgaagcttctttctgaattgaaatagtgatatttaatacattggccaaagagaaggccatcattgcaggctcagtatactcccagggcatgaagtccactccattcagcctctagagaagagctaagagatgaaaatcagaagatggtgctcagctgatgcagtcaggaggcagtcaggcatagacactttcctcatgtgcctttttttgtttatttgttttctttcattttgcaaagcgttaggaaaaaagacctgctttatgaattctgcagaactcaaaaatcactagtaaaaatggtctttggacatttatttattggttaatacgatcatatacaatttttttttattaccagtaagaagagaataaaaggtgaaatcagcaacaatgtgtatttcaaacagctggggaagtcccatattgatcactgccatttgaaatgtgatagtgggaactagggaaatattagacagttgaaactgtatttgagacccaaagaacagggagccaaagagatcaatacattcctgtactttttgctgaggctccttaacattgtgggttttttttttttaattttagctttactgaggtataattgacaaataaaacttgcatgtattcaagatatacaacgtaatgttttaattatacatctgcattgtgaaatgattgcagtaatcaagctaatttacatatccatcccctcacatagttacactgtgtgtgtgtgcatgatgagaatatttaagatctctcttcagcaaattttaagcttataatacaatgctattaactatagtaatcatgctgtgtgtctggtctccagaaattattcatcttacagctgtaaatttgtaccctttggccgacatctcaccatttcccctaccccccacctttgttaaccaactttctactctgtttctgtgagttcgagtttgttagatcccacatgtacatgagatcatggagcatttgtctttgtgtgtctggcttatttcacttaccataatgtcttgcaggttcatccatgttgttgcaaagtcaggattttcttctctttaagtgctaaataatattccatattgaataatattccatatatatatattacattttctttcccattcatccatcaatagacacttaggttggttgtttctatatcttggcaactgtgaacactactgcaataaacatgaggatgcagatatcagtgattttatgtccttcggttatataccctgaagtgatattgctggatcacatggtagttctatttttaatattctgaggaacctccctactgttttctatatagctgtgccaacttaaattcccaccaacaatgtataagggttcccctttctccatatccatgccaacattttttatcttttttctttattacaatagacatgctaacagatgtgaggtggtatctcactgtggttttgatttgcatttctctgatgattagtgatgctgagtacctttccatatacatgtagaccacttgtatgtcttctttggagacatgtctactgaaacgtctagcccattacctaatagggttgcttgaggtttaaaaaataaaataatatgagtttcttgaatttaatgtatattaaccctttatcgagtatatgttttgcaaatattttcttctattctttttttttttttttttttttttttttttttgaggcagtatctttctctgtcacccaggctggagtacagtggtgcgtctttggctcactgcaacctccgcctcccaggttcaagcgattctcctgcctcagcctcctgagtagctgggattacaggcatgcgccaccatgtgttgtcttttcattttgttgattgttacccttgctgggcagaaacttttcagtttaatgtagttccatctgtttatctttgcttttattgtttgcatttttgtgttttatccaaaaaatcatctctgaaattacaattatagagcacttttttctgttttctattagaagtgttaaggtttcaggtctcatgattaagtcttcaattcatttggagttgatttttcatatgtgtaggataaagagccagtttcatatttttgcatttgaatattagcttttctaacaccatttattgaagagactgttctttccccttcatatattcttagagcctttgccgaagattaattgaccatatatacctgggtttattttgaggttttctattataaatatatatacacacacatatacatatataaattatataaaaacacatacgtgtgtgtgtgtgtatgtatatatatatatatagttttcatgccagtgtgctggtatcatattgttttgataagttttgttttgtaataatttgaaaccaggaagtatgatgccatcagcttcattcttcttgctcaagactgctttagctatatggctttatatgaattctggtttgattttccatttctgtgtaaaatgctattggaattttgataggaattgaattaaacctgtatactgctttggaacgtataggtatttctacaatattaagtcttctcacccatgaacacaggatgttaattttttcatagcttcaattttttttattaatgttttattgttttcagtgtaccttttacctccttcgttaaatttctacctaagtattttattcttttttatgctattatacatggcattgctttcttaatgtcttttttgaatagttcattgttagtatatggaaacacaactaatttttatatgttaatgttatatcctgcaattttactgaattaatttattagttctaccagttttgttggtggagtctttagagttttctatatgtaagatgacgtcatctgcaaacagagacaattgccttcttcttttatgtttcggatggttttggtttctttttctttcctagttgctctggctagaactttcagtgctatggtgaatagaattagtgagagtgggcattcttgtcttgttcctaatcttgttgggcaagcttttagcttttcaatgtttgatgtcagctgtgggcttctgatatatgacttttattgtgtttaggtgcattctttctattacctcatcttttggaaatttttatcatgaaaggatattgaattttgtcaagtgatttttctgcatctattgagatgataattttgtcattcattttgttaatgtaatatatcatgtttattagtatctgtacagtaaactgaaacatattgcatcccagggataaatctaacttgatcatggcactgttgaatttggtttgttaaaatttttttaggatttttgaatctatgttcatcatggatattagcctgtaaatttttttggtagtatcttgtctgtctttggtgtcaggttaatattggccttttaaatgaatctggatgtgctctctcctcttcagttctttggaagagtctgagaaagattggtgttaattattctttaaatgttaaataaaattctacaatgaaattatcagtttctgagcttttctttgatgggagatttttaattagtgaatcagacttctcactcattattaatctatttatattaatatttctttataagtctttgtaagtcatgtttttcttggaatttattcatttattctaggttatctaatttgttagcatgtaattgtgatggtagtctcttatgatacgattcatttataattttatttatttgagactctcttttttctttagtatagctgaagtttacaaatttggcttattttttcaaaaaaccaactcttggtttgttgatcttttctattgctttcctagtctccatttcatttatttctgctctgatctttgtccttttcctttcactaactttgagcttagcttttttttttttttttttttttcatagcttgaggggtaaagttggattgtttatttgagatctttctattttcttcatgcagccatttatcactgaaaacttctctcttggacaatgctgcatcccataaggttttgtatgtttcctccttcatttgcttcaatatatttttaaattttccttttgatttcttcttttaaccatttattgctcacaatcatgttgtttaatttccatatatttgtgaattttctagttttcctcctgttaccaacttctagttgtataccattaagttgaaaaaggtccttggtataacttcagtcttcttgaatttgttcggacttgttttgtgacctaacgtgatatgtcctgaagaatattccatgttcatttaagaataatgtgtactctgctgctgatgggtgaaatgctctatctgttaggtttatttggtctatagggtagttcaagtacagtgtttctttgttgattatctgcctggatgatctggggttctggaggcaaagcatcccatacatctcatggtagcgtctctgatggagtcagtggagctattagtagcttctgcagcctcccttctctctttccagcctctcccagttactgagcagtgtcaaccacttcaggattctaggtgaagcaagatagaagtgagtctattaggcagtgttctgcatgctggaggtgtcaggcactcagtcactatgcctttactttccatgtaggagaaatcatgggctgtaggggcttctcttggcatcaacctgtgccaccctggggtacaggcgacataggtaacctgatactgttcttcctttgataagtcagtttttggattttatgatgccacagtctgctggaacttcttcactggacttccagatttccacaaaggtacttttgtttgtagatacttgtttaagttgaggctgcttcagaggatgatgatagaagctcctgtttcaccatcctgtgcatctaattagctagtgttgctttaagtgtaaggtacagagccatatctctgctttaaaggcctaaacttattagaatgaagggcaggattgacagattatgctagaaattctttgtgataaattaatcacaattaaacataatataaattaattaagattacatttgtgtaaaatgagccgtgaaaacaggtattttttccaagttttattttaggttcagggggtacatgtgcaggtttgttacatgagtaaattgcatgtcatggctgtttggtgtacagattattttgtttccaggtaacgagcatagtacctaataggtagtttttttttttcatccttgccctactcccaccctctgccctcccacccttcactttgtgtttattgttcccttctttgtttccatgtgtactcagtgtttagctcccacttgtaagtgagaacatgtggtatttggctttctgttcctgcattaatttgcttaggataatggtctccaggtctttccatgttgttgcagagaacatgagttcattcctttttatgactatgtagtattccatagtgtatatgtatcacattttctttgtgcagtccactattgatgggcatctaggttgattccatgtctttactattttgaatagtgcaatgaacatatgtatgcatgtgactttatggtagaacaatttatatttctttgagtaaatactcagtaatgggctttctggctcaaataatggttctattttaacttctttgagaaatatccaaactgctttccaaaatgactgaactaacttacatacccaccagcaatgtataagcattcccttttctttaaagcatcaccagcatccattattttttgacttttattaatagctattctggctggtgtcagatgatatctcattgtggttttgatttgtatttctctaatgagtcatgaagttgaacattttttatatgcttattggccacatttatgtcttcttttgagaagtgtctgttcatgtcctttgcccatattttaataaggttgtctgtttttttgcttgctaacaaggttcttagagattctggatattagacctttgtcagattcatggtttgtgaatattttctcatattctgtcggttgtctgtttactcagttaatactttcttttgctgtgcaaaagctctttagttcaattaggtcctctttgttaatttttgtatttcttgctattgcttttggcatcttcattatgaaacctttgccaggagctaggtattggcatgtcttaggttttctttcagaacttttatagctttaggttttacatttaaggctttaatccatcccgagttggtttttgtatatgatgaaaggggaaagagtaaagtttcaatcttctccatatgcctagccagtcatctcaacactacctatttattgcatagagaatcctttcccttatgcttgtttttgttggctttgtcaaagatcagatcgttgtaggtgtatggtttcatttctgggttctctaacctactctattggtctgtatttctatttttatatcagtaccacgctgttttcattgtattgatctgtggctattcctatcaaactatcaatgacatttttcacataattagaaaaaaactactctaaaaattcatattgatgcaaaaataaaaagcccaaatagccaatgacatcctaagcaaaaagaacaaagctggaggcatcacactacctggcttcaaactctactgcaaacagttcttaaggtcttctgaactttttgaatatttactatgagtaatgcagtaaaaatctcccttgcccctctaccttccaactgaaaaaatgttcatttaactgaaagtttgcaaattgcagtttgaaaaatgttaaacaatgttagttttggagagcataagtgggaatggatgatgatcttaaattgaaaaaaaattaatattatttattcaataaaatctgaatcaatattcagtttaagtgactagatttacataatgaagattttatttctcataaattaacttcttacctggttttatttgatttttgtttgttaccagtgccttaacttacctaatatattccttacacattcatcatgcagttgacacttgaacaatacaagtttgaactatttaggttcactaatatgcaatttttttggataaatatattagaaaactttttggagatttgtgacaatttgaaagaactcacagatgaaccatgtaacataaaaaaagagaaaaacttagatatgtcatgaatgcataaaatatatgtatacatcagtctattttatcatttactaccataaaatgtccacaaatctattataaaaaattaacattttttcaaacttacccacacaaacacttacagaccatacatggcacaatttgcagtggagaggaatgtaaataaatataaagatgccatataaaatcacaactgcacaaaattaactacagtacatactgtactagagtaataatttcttagccacttctttttgctattatggtgagcccaagtgttgcaagtattgcttaaagtaccatgtagcatcagtcatctccacatcagcaatttgtctctccagtaaactgcatagtgcagtaaaatttgatttgtgtaatttctcagatattttttgttgtttaatgcaatacaataaactgaataatgccatgggaatgaagtgacactagcaatgctggaagtacttccaagaagcagaaaaatgtcactacattacaagaaaaaatgtgaattgggccagatgcagtggcttacgcctgcaatcccgacactttgagagggcgaggtgggtgtatcacctgaggccaggagttcgagaccagcctggccaacatggtaaaagccctttactactaaaaatacaaaaattagcctgccatggtggcatgctcctgtagtcccagctacttgggaggctgaggcatgagcaaagagagtgccactgcactccagcctgtatgacagagcaagactttgtctctctccccaccccactacccaaaaatgtgaattgcttgatatgtaccatagactgatgtctgcagctgtgattgcctaccatttcagacatttgattcatcttggaagccaataacataaacttacagtatcaataaatacagtactataaatatatattttttattattttcttaataacatttttgctctagcttactttattgtaagaatatagtatataatacatataccatactaaatatatattaattgactatgttatcggtgatgctgtgggctaacaataggctattaggagttaagttttggggaagtcaaaagttagacactaattttcttttctttctttttttttttttttttgagacagagttttgctcttgttgcccaggctggagtgcaatggcactatcttggctcacggcaacctccgcctcctgggtttaaatgactctcctgcctcagcctcctgaatagctgggattacaggcacccgccaccacacccagctaatttttgtgtttttagtagagacagggtttcactatgctggccaggctggtctcggactcctgacctcaggtggtccaccctccttgccctgccaaagtgctggggttacaggcgacaaattttcaaatgcatagagagtcaatcccctaaccctttatttgttcaagtgctgattatgttataaacttttctttaaatgtgctgaaaaaaatcttttaaaagttttgtttgctataacattggatcattgaattagatattgggggtctcccaataacataaaaatcatcctaatatttaagaatgtttggcttatttgcttccttatcatttcattaaaaattgttagacagtgaccactctaaagtaatagaagaaaatgcacaggaagctatctgctcccatcggcttctctttttcctctgccctgctagagaactttattaacgttatgcttaacctgaaacttgtatttcaatctataaatagaaaaattgtttttaacatccctaatacctatggtttaggattaagtataattttaagtatttaattaactcatcgtagagagcatatttccatggtgccaaggcagttatgaaattagaagggacactatataaaaatattaattgaactaagtaaaactaaaagttactcctgcctttccctttttccccaataccaggaaaattaatatgtttaaattgaattgccttctttcccctgaatctgtcttttcttttctcagccaatcacaatcccactttgaattcttcaaagtgcaaccaaaatgctaccttcttgatgaagcattctctgactttttcatcagaagcaatatctatctccttaaacctgtgcagattatctcttactttcttgcaccttttgctttgtagtatagtaatttatagaaattcctatagtccttgagaaagtgaagttccttgattgtatgtttgtatcttattcgcctctgagtggaaatatcatgaaggggttgagtgtcttgggcctggagacagaactatctgtgcttaaagttcacccattatgtgatcttgggcaccttattccaccactcacatttttaaatttatcctccaaaacacagggttacttcaccgggaagtgcatttaaagaattagaatagtaagcacttcacaactactactagctattgctattgctcatatcaccttcagataaggtgtgcatatagtatgcagagaaattaatctattagattaaaaaatctatactagataaaatatctattagataaaagaagtatattttgttcttgttttcagcaattactgcttctcacacttccaagaataatgaatctctctttttcttagtattcctacctccttgttattgaattagcagtatttattgggttttcacagggtctagagaagtatataaggatcgtggggaccgggcgcggtggctcacgcctgtaatctcagcactttgggaggccaaggaggatggatcacgagatcgagaccatcctggctaacacggtgaaaccccgtctctactaaaaatacataaaattagctgggcgtagtggcgggcgcctgtagtcccagctactcagcaggctgaggcaggagaatggcgtgaacttgggaggtggagcttgcagtgagccgagatcgcactccagcatgggtgacagagggagactccgtctcaaaaaaaaagaaaagaaaagaaaaaaaaatcatgagatataagaaatattatgacatgtttccttactctcaggatacttaacactacaatttggtttgaccgtttgactaaaagacatgaaaacaaaactgttgcataaaggattgccttctctttgcatcacaaaaatgtataaaatgtattttaaggaggaaggaatatttatatagaaacatttttgacatagccatatttattataataccattcttatcggttgcgttaaatgaggtagtcaaaggtctactctctaaaggtcttgtcgttataaatcaataatactcttggcccaatatgcagtattcaaaaaataatgaaaacaaagcaatctattttgagcacaatgttcatattttttcagtgaattttaaataaagagccatttatttgaaaactactgtagaatttcttgtcatttttggtagcattttttattatatatatcgtgttctatagtagtaattatagtgtacatggaatttaaatccatgtcttgagttattatatttaaaaatcacatagatttttttcaagtgacttcttagcctagttttaagttattcgatttttgggtgttctgactcagagatagcattttaaaaccccagtcaccctccacctctgtactattccttttttttatatatatactttaagttttagggtacatgtgcacattgtgcaggttagttacatgtgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatacggtgtttggttttttcttcttgcgatagtttactgagaatgatgatttccaatttcatccatgtccctacaaaggacatgaactcatcattttttatggctgcatagtattccatggtgtatatgtgccacattttcttaatccagtttatcactgttggacatttgggttggttccaagtctttgctattgtgaataatgccgcaataaacatacgtgtgcatgtgtctttatagcagcatgatttatagtcctttgtgtgtatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtggtgatgagcattttttcatgtgttttttggctgcataaatgtcttcttttgagaagtgtctgttcatgtccttcgcccactttttgatggggttgttttttttttcttttaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtactgcctaggttttcttctagggtttttatggttttaggtctaacgtttaagtctttaatccatcttgaattgatttttgtataaggtgtaaggaggggatcctatttcagctttctacatatggctagccagttttcccagcaccatttattaaatagggaatcctttccccatttcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgtgggctcttttttggttccatatgaactttaaagtagttttttccaattctgtgaagaaagtcattggtagctttatggggatggcattgaatctgtaaattaccttgggcagtatggccattttcacaatattgattcttcctatccatgagcatggaatgttcttccatttgtttgtatcctcttttatttcttcgagaagtggtttgtagttctccttgaagaggtccttcccatcccttgtaagttggattcctaggtattttattctctttgaagcaattgtgaatgggagttcactcatgatttggctctctgtttgtctgttgttggtgtataagaatgcttgtgatttttgtacattgtttttgtatcctgagactttgctgaagttgcttatcagcttaaggagattttgggctgagacaatggggttttctagatatacaatcatgtcatctgcaaacagggacaatttgacttcctgttttcctaattgaataccctttatttccttctcctgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacacttattgatttgcgtatattgaaccagccttgcatcccagggatgaagcccacttgatcatggtggataagcttttcgatgtgctactggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagggtgtatatgttgaggaatttatccatttcttctagattttctagtttatttgcatagaggtgtttgtagtattctctgatggtagtttgtatttctgtgggattggtggtgatatcccctttatcattttttattgtgtctatttgactcttctctcttttcttctttattagtcttgctagcggtctatcaattttgttgatcctttcaaaaaaccagctcctggattcattaattttttgaagacttttttgtgtctctatttccttcagttgtgctctgattttagttatttcttgctttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatattgtgtctttgttctcgttggtttcaaagaacatctttatttctgccttcatttcattatgtatccagtagtcattcaggagcaggttgttcagtttccatctagttgagcggttttgagtgagattcttaatcctgagttctagtttgattgcactgtggtctgagagatagtttgttataatctcttttcttttacatttgctgaggagagctttacttccaagtatgtggtcaattttggaataggtgtggtgtggtgctgaaaaaaatgtgtattctgttgatttggggtggagagttctgtagatgtctattaggtccgcttggtgcagagctgagttcaattcctgggtatcttagttaactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatattttggatagttagctcttcttgttgaactgatccctttaccattatgtaatggccttctttgtctcttttgatctttgttggtttaaagtctgttttatcagagactaggattgcaacccctgcctttttttgttttccaattgcttggtagatcttcctccatccttttattttgagcctatgtgtgtctctgcacgtgagatgggtttcctgaatacagcacattgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtcttgatggtctttacattttggcatgattttgcagcggctggtaccggttgttcctttccatgtttagcgcttccttcaggagctcttttagggcaggcctggtggtgacaaaatcggtcagcatttgcttgtctgtaaagtattttatttctccttcacttatgaagcttagtttggctggatatgaaattctgggttgaaaattcttgtctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttatggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttcttgttattcttttttctctaaacttcccttctcgcttcatttcattcgtttcatcttccattgctgataccctttcttccagttgatcgcatcgactcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccattcagctttgttccattgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttctttctaacagacaggaccctcagctgcaggtctgttggagtaccctgccgtgtgaggtgtcagtgtgcccctactggggggtgcctcccagttaggctgctcggggggtcaggggttagggacccacttgaggaggcagtctgcccgttctcagatctccagctgcgtgctgggagaaccactactctcttcaaagctgtcagacggggacatttaagtctgcagaggttactgctgtctttttgtttgtgccctgcccccagaggtggagcctacagaggcaggcaggcctccttgagctgtggtgggctacacccagttcgagcttccaggctgctttgtttacctaagcaagcctgggcaatggcgggcgcccctcccccagcctggctgccgccttgcagtttgatctcagactgctgtgctagcaatcagcgagactctgtgggcgtaggaccctccgagccgggtgcgggatataatctcgtggtgcgccgttttttaagccggtccgaaaagcgcaatattcgagtgggagtgacccgattttccaggtgcgtccatcgcccctttctttgactcggaaagggaactccctgaccccttgggcttcccaagtgaggcaatgcctcgccctgcttcggctcgcacacggtgcgtgcacccactgacctgtgcccactgtctggcactccctagtgagatgaacccggtacctcagatggaaatgcagaaatcacccgtgttctgcgtcgctcacactgggagctgtagaccggagctgttcctattcggccatcttggctcctcccctgtactattcctttcacttaaaatataaatgtactgaaatgtttttaattcaaaactaaccaaaaaacaaaacaaaaccaaagacaaaaacatcaaaaaacaaaaagacccttccttcaaacctgtatcacccctgaccctttacagacaatattatagttcctttcttcccaaactcttaattgcccaaatcaatgtactctcagtattcattttaattgaactctgatttaacactgatgacaattattttcttaaaactatcttctctttactattccatgatactaccttctttgaatgtcccttttgtctacctgttaaattctcttgctgagtgtaccttggtcttattttgcttctcttctcaatatgtgtacatatatatgtgtgtattctctggataaacctttttgtctgtggctttaaaagatcaatctcatgggtacaaatatgtctagctgcttggagtactttacttgacgtccaacaggcataccaaatttatcttgtgcaaaaatacattcatcagcattataatcaaagccactcattgtcttctctaccttttcctctctttcatgcccccacatcgaacttgtctccaagttctaacttttactttggcatctcctcttcctccattgctttagttgaagctctcatcttctgtctgtagcactacaacaatcttctctagggttttcatcctctagtaacccaagactacaattcattcctcatagagctgccctaatggatttctcaaagttggtcatgtttttctctttttaaaactcttctatgaatctccattgcctacaagataaagttcaaatgtcttagaatggcgtatgaatcactggttcttctaactagtatcaatttggtttacctatttatactttcattcaagtatttcactctgcctggaatcccttctttgtacaatttgattacgtttggaaccacatttctttctcaaatcaagaaaaacacagtcatgaagtctgccttaatgtaattctcttgtggcttctttaaaatatactacttcttcatttgtgccatctcagcctattacatgaacttgtatcatactagagactacatgttagtgcatgtaccagtttccatgtctgcctcttttttggagtacatatcacatgaggaagaggacctatccccaagacctaatacggtatcaggcatatccatagttatttttattaagaacattatttttaataaataactgagcacagtagaccttcagtagctgttcatggaaagaagaaaaaatgaaaagacaatgtcagattatgggaaatagtcaatatttttgacagaaaatgatataattgattttaaaaagttttgaatttaagcgtttcaattatgactgcaattcacacacaaaaatataattccacatggtaataaagattaccctaattctgtatggtaaaaaatgattatagaaaatgcattaaaaacaaatgtttaaggggaaaaagtagctatgaaacttttttgaaattcttcaaaaaatgtttaaactctttttttaaaataactttcagtagcactagtttgcccttggatacatacatgtattgtatttagagaggctaaaaggagaaagccagttaagtactattattgcctaagaagaacaaaagaaagaaaaaataagactgtatgcaagtaataccaatggattctcatattctcagtaggggcataaggaaattaatgtatctttctaccctacaatttctacccacttctgaaaatccaagtattattgaaatgcctatttaagaaaataaaatatttttgactaaaaatttctgaagaacaaagtgttattaatactgccaagttgagaaggcatcttaggagaagtgctaaaaaaaacacacacaaattaatcttattaacacattttaccatatttcacaatttttagatgccccattttaaaaaactaacagctgtgaaatatgtgtgtatctcacaatcaatgactattatagtgtattggcaacatttttgcttttttagggacacataaagatgccttttataatcaatggtgtcctaacttaatgaaatgaaatctaaattatatttggaacataatgggctaaaatagctgataaaaatgaaaaaaaatctgaattcacatgcagaaaagaaatgattgatttggatttgatcctcctatgatcctctatgagcaaaatcatgtattattatttttcttctggtaataattaaacatatggaaaaatatatttctgcttaatgctactccttatttgacttgcataccatatgtttatgtttaaaaacattctaagttttttgaacaatctaaatcaagtatattttgcctgctttcacaaaacagtttaaaaataaaaagactcagttgtaatgcacatttttaaaaaagtaactatgaagtttactgatctagacatttttcagatatccagtcaaattgctgaaaagcattttttcagtttatctaaaactatatgactgtatgtgtacaatagatgctaccagattttcttatcccagtaatggagattaatgatgcatgtcttgtctgtttttgggtatccctgctctagtgaattcttcactgtatcagtgactcttatcatcaaatttcagtacacatttctttcccacttcaatccaactaaagccacatttatcatcatattattttcatattcagcaaagagtttcatattggtaactcgaatagatatcttaatctgtacatttaaataaaaaaatattttatatgaataggacttgtttttcagaaaagtcatcatatacaatgtgtacactggaaattgcacagaaaatatttatatgctaaaaagagcactaagtacttattctccaaacattttcctaacactgctaaattatgtaatgttttcatattattaatttttatgatttaaagatgacaccaccccctagttcaaattagagagaggaaacattactacctattaatagctttacatttattattttgtaggaaatccttattatcaaacataggctttatcagttagtagcatcagttatcaagaacttaaaactcactctggatcaagacatgagagaaacaagatcctgggcttatgttaaggtaggaagaagtgtgcttacctcacctccagaaaacattgcaacccctaaaccctgaagcagtggttttctgacccaaaatctcaaaaaattttataaatgtacctcattcagtctcctcttttcctcttcaaattctgcaaccaacattccaagccttaaagacaaaagtatttccccatcacaagaacaagcagctcacacctaatgacttctccattcatacacacctaagaaagaacatttcttctgctatcacaccagataaacatcctcggagatctacctctagatcaaccttgcacaaagaaagctttttcatatcaggtctttcagttcctagaacctgtcattatctcctttgtctcccaccccctccaataatgtttttagatataatgttccttctgtttggaatattcttttaccccacttgtcttctcccttcacctttaatttactcatccattttcaagttgcagtacttcagagagtctttcctggctattcaggacaggtcagggctctcagttatatgctttcacatactatatttttatttgagtgattgtatgatagacatccatcctttccactggaaagtaggtcccataggagcttcaactattcccctcaccacccagtacataataaatatttcataattatctatggaatcaacctataaatttattttttccaaatcagagcattctatcatttgcctctagccacttcaaatatcttacagtacattctcaaccaagcaaataaattgtttgtattacagtgaccttgtagcttttttattgtaacatatttttcacatgcatgttttattttacatatgctattccttatagcacctgactgaaaaccttaacattgacataatcttctgagtcatacatttgttactgttcagtgatagcggtatactctccataaatgtcactatggctgacagataactttttcaactcgcctttaccggttggatcgttaggacttgctttactcaaactcctttctcatgtagttgacgttttcatatatgcccttgtcttccttgtatcaactaaccatgcttctctcttgtggttagctgttctgctgctagttccttttctcaattttaacatatcttaagaatattcagtcacagtttgccaacacttatcttctcagtttaaataagctttatgaaaacttgctgtgctaatcatgttatatataatgaaaatcttgaagttatgatatttttgctgggcattcataagcatggaaccatgactattattcgtgagaattatccgtaatattttaatgggttgttgcttttttcaatttaatataccatcacagccaccggatactgaaaagaaccataataatttaatttcatatcaagtaattttccttatgggtggtaattttctttattcacatctcttgggaccagaggtggtgttcatatgcggagaaaatagcacattcaaaggctcagattgtgagactgtggccaagggccagtagtagctcagggcagctaaattgcaaggtccatggcagagaagggtaggtaatagctggacaggcacactgggatcgcattgtaaatggccttgtatgacattctctggattttgacttgctgatcatcagtgtattttaaccagaaagtgcaagattagacgtgcaattgaaaaatattgtgtcagtttattacagagaagaactaaaaccatttgtattttcaaaacttcatgtctctgtaaaataattcaaaataatttgcattctcttctaaataatctaattgacaaaaatatatgtgcattttagatcacctgtgtaatccagattacatttgtcttcatgcctccacaaacatacctgtattccaaaaacctagtagaaaaaaataaaggagaattaaaatgtaaatgatttccactaagtgatggacgcctggcattatgttgcactatatggatgaaagtttctcagcagttcacagaggcatagtatgaatgagaatcaagttgttacacagcatagagtaattaaaggtataacaaacttcaaaagcctacactggagcagctgttacctgatccacattgccaaaggcgatttaattttaggaaaacaaaatcttatgccttattagatacatgttgctattttttattttattgtttttgtcattttgttcctgtatttgtaaactggttttggtattataattgtacgcagctaaaagcataaggacatatctattttttgaacatgcttaagtaacattaaaataaagtaatttaaatcaatattggaactttgatttttttttttctttaaaaggaatttaggggtaacttttattgtgtaatactggctattagtaccataacattagtttttattattatttcacacaatgttgatattatactgagtgcttctttttgatcatttttatttcattaggcttttgtttcctttgccttatttttgttaatgtttaagcatttaaaaggtaaagcaattcattattcaccttgttgtctttctctgactgttcccataaatcattatttttaaaatcttatttctagaaaataacaacttgttttttttttccttttcagttaaatatttgaaaatgtaaatatttctgccctatggtttggtaatatgaagtaatttattagataagatagaaaacttagtttattgaatttctgaaacatatttaagaatttgaaggacttattgttttcttttgcaatattgccacaagctttttatatttaaatacattaaaattaagttcgaactaaatttgttgagaaattctcacattttcctaaatgtttagacagttcctcaaattttgcaaaattagtcctgaaggtttagcagtaccattttatctattataagaatgccttaatctagtctaattttctatactgagaaaggtgatataatttctaaagatccctaatttgttacaattattgtttaattgttattaccaggggggtttaactattatatcagttttcaaagataatgtaatatttgattccctttttattattgaaattcttgtgtcagcggaatactgagtattaggagaaaaaagaagggtcaaattaattaaaaaggtaaaaatgttttaaaagatgaagttagaattattcaaaaccctttcatttaaaagagctaaattataaatttaaatgtattacatttatcagaaatcacaaatgtaaaatacattcttaagttcatgctctcaccctttcctatgctatcctttaatccagggggaaaattactacaactattgtatattttcatttgtacacagtgtcctctccatgggctgtagtctcttccacccatatgttatttgaggagggaattaatcatttacaacataaagccattctgtatattatttttctactaggctttaggtaaaataaaatgcataacacttccatacatgatattgcttgaaaatgatactgctatctattaaactgtacttcaatattctgttttacctgcagctgaatgtggtgcatctgcaacgaataatgaaggaattttgctgtctccaaattatccactcaactatgaaaacaaccatgaatgcatttatagtattcaggttcaagcaggaaagggaatcaatatttcagccagaacatttcatttagcacaaggagatgttcttaaggtaggtgaactcagacatacttgtatattgttcatttttagtcattaaatatacatcaatagataaatatatacatctatatatatatgtgtatgtatatagtattaaccgtaagttgattctaccattcacacattcaaattatacattaattctcattttctattattgttttcattgaaatagtatgttttgtttccaatttttttataataaaaggtaaatttttgttttatgatacataaattttaatgtcttaataataccaaaataagaaaactttaatgtcaaatatcttgtctaataaattattatatataaaacatcatcaaatgaccgtcatgtaatgtgatagtcatttctttaagaaatataatagtgacttgtttctatttgtattctattgtctataatgtaacttatttatttttgttaatacgtgaagaatcttttgcatttatgactatggatacattttatgaatatataaacctaacaagtcaatgtctatcaattaagaaaaaatatactttgttgataatgactatcggtgtaaacattatttatttaaacactttgaaataatcaaatatctacttttctaaaaagataacattttggcaaataaatattttcatagttgctgatttatattttgaatataaatattttggtaaatatagtttatatttatcattagagtaaaagtaaacacttccaaaaatcacatttaaatgtttttaaaatagttatgtagcttttttctaattgttaagtttttctaaagccaggtgaaaaattcattatacttctgttttcacaaatcttgaaaaaaaattatgttattccaaattggctgcagcaggagaattcttttttaatgattgattttaatgttattggttagtttctttttaaaaaaatattatttcatggtaattgatggctctctaacacaataacatgatatgcttataagatttgtataggctttggggaaaatttctcacaatgtatctagatgtatacaatttcaacattaatctaggatcaatatatgcattcttattttctgcatttttctccaactggcaacaaaattcactatgtaaaactctcccacctctagttcattgtttgggtgtttctgttaaagtaagttatgttttttcaattggagccaacattgagattaataggatgcttgtatatagaactgaggcagtgctttttattttcaagcaaattatggggggaaaatgtatcaatgcatagataagatctgtaagctaatctagctactactctgtaatgcagaagcaacaataataaacatgcattggtgagctaaaattcaggaaatgtttcttcacatcttcactcatgcctattattgttctacctaaaatatttctttgtgatgcttaaaattcattcatttctttcctatactggtattatttgggtaatttatttgggataacaaatgattcttttcagtaataaaataaaactttctaaaaggtcttacttatttggagtaaagccacatgcatttctgatatgtgctaccttgagaagggtggagcttcagtcataagtgacaacacaaggggatgtaatagggaacaacaaaagaaggcagaaaaaaaaaaagactcaatgtaaggccctttaaatgatttcttcaaatacagatttctcttatatgtttaaaaagttaaaaaatttatgtcctcaagaacttttaagaattctgtaattttccaagaatatattttccccaaagttgaaaatattatatactaaatattataatagaaacacaccaattcaattatccttctattcataggcttgcctgagatttattctgaattattactttaaaacaatttcagcaagccactctatagagacaatttagggtgaacttttagattccttatttgtcttcttcatggtctctctgccagaataagaggtaagatgcttaatgttacctcattcttcccattaatccaacgagaaaccattagctgaaagataccctttgacatggaaacatttagttatatacaagcagaaagatgaaccctcaaaaagacatatgattaattctcaaaaattgtagagcctaaagtcatcttagggtggaaagttatttgcctaactgaaaactaatccatgaaagttaatccccatctccagtactttacaatatcgaacatagtggagtcagttagatccctatatttaaactagcatataataaggaataaaaacaaatagcccattataaaatctgctgccccttgactgagagaatttaaaatcattgctttttcttttatgtggtagcattgattatattttttggaatgacactgtcttgtaatccttatatgagaatcaagtttaggaggagagatttttttctggtttcgtttactgtatgacataactatattggattctgaccaaaacaaaaataacaataacaacaataatatatgtgtgtatctacatctatttccatgcaaacattcgtgtacaacttttatctcagagttcagtgtccaggatggcactcacttgctcacttatctgctgtcttttttcttctctcctcctttctttctataaacaactttatttaaaaccataccagtagagtttacaccagtgagttccaagtgtaagccatcatatgactcctctagattttttttaagttttgattactggcacgcctcccaggttttctgattcagttcctctacatgtgggaatttggatttttataaagctctccagattatctgatgaccatcaatgtagtaattatgattatatccttctttggctctagtgttaaaatgaagaaagtttatacatcaaaatattttactgtagtgcttccaaggtagcacactgttactctaaataataaaaattgatctcaatattactagataattttgagtcattaactttataccagattgaaactttttttttgtaaaacatttttgttcatttgtgtcatttgtcaaaggtggataaataattttaataacatctgagaaaatcctatttaggcaaacagaacattttctagccatgaaaaagcaataataataatagtaataataaatgaaataaaaattcccgtgtgattcttacttaaagtggaaaggaaatttcactgcatccattctgaattgaacaaaactggtacaaaatgatcatttaggaatgtatcttttcttttcaatttgcttacttaatgggtattttaacctgttcactatgaccaaccttggctgattatgtgtttttataatggtgatagaacaaatatatacccttctatccattaatgtataggaaactcacactttagatgccttctgctattaatgtttacatataggaatagtaagtgggttaagtgacaattttcttgtgtgctacttacttatttttggaaaattttaatgacacaccacaggtaggtttggatttcacttgacactgcagctttaaggaatataaaaagatatatgaactatattttgtttataaaaaatcctttaatgttcacattaaaaaaaactttgaaacatatatgccttaaagtacattgacagaacagcacaaccagtgcaaaatctgctctgacctgtgataagatccagtttctatctaaatgatctctcaactatttccacttgaatgactaatgtgtatttcaaagttcaccagtccaaaacacacatctcctctctcctcatttttctctatttcagtagatagaaactagttactcaaggacgaagtagagttcattcttgcttccttgtttctttcacactttgtatattattcctcagcaaattctatggttcttttcttcacacttccggaaccaatcatttctcacctttgtaaattaccttggtctaaattattatctcttgcttggataactgacattgtttctaactgatcaccctatttccaccatcttagatcatgtgagctgttataacagaataacatagaccaggtggtttataaacgacataaatttattttttgaagttctgaaggctggtaagttcaagactaaggcactagcagattatgtctgatgatggccaccttcctcaaagagtcattttcatattgtgaactccatggtgaaagggatgaataagttttttgaggtatcttttacaagggcacttattccatttacgaactctgccctcatgaccagttagcctcccaaaggcctcacttcctaataccatcaccttgagggttaggattttaacatacaaatttggggggacacaaatattgagaccatagcatactctatagactgtttccaaatcaacaacaaaagtgaccctttttcatgttatgctttggctctaaacctttttttgttcctcatctcattataagtaaaatctaaagccctaaccatggcttagatagccctatgatttggcgtaattttactgtgcctgacattttctcctgccactcttcctttagctcactccactccaggcataatggcctccctgcagtatctcaaatataccaagcatgctatattaggcctccctcttttttttttacattgctataaagaaatacctgaagctgtataatatataaggaaaagaggttaaatgggctcacagttctgcaggctctacaaacatggcaccaacatcagctggacttctggtgaggacctcaggaagctcacaattgtggcagaaggtgaagggagaagctggtgttttacgtggtgagaaagggagcaagagagcaaagggacaacaggttccacgcttttaatccagcagatctcacgtgaactaactgagagagaatcacttatatcaatgggatggtgctaaaccattcacgaaggttctgcccccatgatgccatcacattccaccaggccccaattccaacagtggaatcacattccgacatgagatttggaaggcacaaacattcaaaccatatcacatgctctaacaccaagccgtttgctcaggctatttcttctgcttacatattcttcctcaggataaccacatggctgtgtccctcatttccttcaggtctctactcaaatgtcatatgatcagagtcttcaatgggccctcctataaactggtaaactcacctccatcatctctttccattattaatctgatttattcttcttcatagcactgatctacaacctgaaatattatgcattcatagttaattcctttaatttttgtcttctccaatagaacgcatgctataagacagcaggaactatttaactccactttaactccagcatctaggaacaatgcttgtcgtatagtaaatgctccataaacattcttttcttctagaaaggacaaatttactatataatttcagctactttctatgtaaagcaagagaaacatatttcctttctaattaagttcaattgttattgtttctaatctaataaaagtgaatatatttttataaaacatagttacttttaaatatttcccccattgccatgttattttgtccaaatatagctaataaaatttagggttatatttggtgatatattattagataaacatgcccactcaatcaacattacacaaatttattctaacctttgaaaacatattgtgctttggattatttttctacacacctattttgtcattaagaatgggctttagggacaggtaaacctaggttcaaatctcaaacctgtcacttaatagtcacacaattattgaaaaaattactccagatttctaaatctcaccttcctcccctgaaacattctgataataataaaaacttaaattcaggattgctgtaatgactaaattagataatgtttttaaattaaatgatgtttataaagcactcagcacaatgcctgcccctgcaaaaatattcagtgaatattcatgtaataggaatacatttcagagtctggatcaaaatttgcaagaaatgtagcaaaagatttttgtataaatgacctaatttttattttcaacaacctttttgctgggcagtgggaaaattaatctaggtcaattcaggataaactcagtcaattctgtatttgccaattcaacgtctgcacatattttggcatcaagacttcaagttgtcaaaaataaaaagtgcattttgtcctagggcattatctgtttgtggcaacagctgctgagctctctcatttgctacttggtctgaagtcagcagtacaattgggcatccactgctggatcctagttatcccaactgcaaaacctctttgcatctaccagctctctgtagtatattctgctctgctcataagaagcatttttcaattactctgtatatgacactgagttacaccagaattccatgtggctggctcaggatcaattgcctgaccaacccccagtatctttttttttttttttcctacctcttttctgcaagcatgtttgccacctttctgggctccagatagaaagccaggtacatgttccctctattgtctaattattggcattctattattcctcctacaaaaagggtaagatgcaaggtcctgtctaagaaacctaaatcagaacctaactaatttgttctccgcttaactcatctagggaatgtttctctagtttgtttggggtctgattgttttatttttttcaaagtggcataggatattgcagaaatactgaacttcttccctcacccttacttgtaaatatgtaatctaattaattctttcaattaacattcataagaggggtttattatatgtaggctctgtgcaattaacatcaaatagctcccattgtcagcctggtagaatgaaaattgaataccaatgagaaatactattttctgttttcattgttgctgtgtttgttgttattttcaaataaaaactaaggacaatgttcagaataaaggaatgtagcagggcattcctttattctttggaaaagaatttattctattccaaaattcaaggcaatctttttaccacggttacaattgtgtagtctaaagatttatttcttatgcaaaatgtagactatggatgattatggagaaaagccagtaaagtaacgcaaaattgcttttgaaactgggaaagaaaaggttaggaggaatgatgtcacatttatgaaaaattagatactcaaaggacttgattaataacattcttgtagagacatgataaagttattaacctgttgttttctaaagtgtattattttcaagtttctttcctatctatgtgtgagtctttgggaatagcacttatgacaggctattgttaaattttcagtaattttgagagctgattgttgaacatagccagtgccaaaaattaagttatattacaattagattgtaattaaactacaattaaattaacttaaattatattaaaaacaagagcaatacatataatttttaaaattttctaattattggaatacttttactattatctgtgcttttgaggttatttatgtatattgtatccctatggtagaaataccatgccacactgtggtctctaaccaactccacattcaatgacatcacattcacattcaatgatagcttgatgtcagccaatgggagtatttacactgtagaaattggcaaatgctacaaaacatggcttaacttgttgtttgcttattacatagatttaagtggaaatgggttgtgtctgtgcccattacattatgagtagcactatatattgaagaaatatttttttcagtatttgaaaactattatttaattaaccaaattagttgctcatatcatttacaaactaatgaagttctgacataatcctgtttttgatttttcactttccttttatttgttaacattaaagatgatcaagcagtatttatttaggaaatactcttgtttgtcagttgcaatcataaattgcatacacaaaagtctggcaaaaacaataaaagcattctgtaaaaatcaattagttatatgaaatgtatggtcatgaatattgtatattttattactatttgtacattgctcgacacctccctaaaatcagggattggaaaacaacagtgtgtgagccaaattaggcctgacacttgtttttgtaagtaaaattttattgggagaaagccatgtccattcatttgcatattgtctatggctgctcctgtgccacaatgtcaggactgagtagttgtgacagaaatggtatgcttctcaaagcctcaaattttattatctaacccttcttagaaaaagtttgtcaatatctctgtattgcaataaatgttattttaaaaaccttatgtacaagtatacacatttagcagttttttgtttgttgtttgtttgagagttggttgttaaacattttccagcacaccggtgatcttatatgtccagcacacatatctgccaattctgcttgctgttcattggaattctgtattaactctcccttcaaaagcactctcaaagtgccaatttgtagagactgctatgttaggcctcataaaacccttcatcctcttccattaaggataaggaaaataaaatgatttgtaataagctgcagaactttaatgtagagttggaagttcaactctattatataacaaaaaaccgaatgcccctgtaaagttggtccttcgttgtgccccttctccttcactaaaacatactagctcgtataattgagaatacattatgtagctgttttagaaacctaaataattgaatgcaaacaaaagttctctactctattttatattatctttggagagaatattaaaagttttagaatagagacttttttgattgaccattataaaaattgttctttattttatatgcaaacttgacatctaattcacctttttagaaaatgtatttaatttccaaatcaacctataaaacaaatgaccaaaagtaaaaatgctaggatccaagaggaggaataaattggagatttatatgattatacatatgttcatgtgtaatttctgtcttcacattttacttttatatttactttttgctcttggattgatgttaacaccttaattgctaattcattagataaatgagttagaatatgccttctatttatatatttatcatatcattcacaacagcaagagttttgagtgttgataagtagtttgttgtaatacggttcaacctactggattcaggagagtctgtacaccataactaatttcaggcctagatttattacaaaaagttttggcaattaaaacatggcaatgttaagttttagtttgttctggtgtaagtaatcagacaattgcaaccttttaacaaattaaagtctcagcaaagaatttcattaacattataaaagccatcaataactttcatgatattaatccttaagtcaacttaataataataatacatattaaacaaaaagaaaggggatattatgcttaaataaacaaaaacatacttaaaggtcttgattttaattagaacagaaatatgagcactaagagtctcaaataaaagtcctacggctctagtcagacccaatttaatcactctgtactgtttatttacttttgaacaaaaggcatattttgtttgttttgttttcttatttgtatgcttgtattcatgaccactttaaaagtaatttatctttggttacactgctttctccctttgttgcctttatgttttcatatatttgactaaatttgaaggattttatttatgagttaaatagcattgacttgatcattactataaaaatcttctctttttaagggcttcctaattaatacttgcctttcatgttgattaagcaattttatgcatgcttccaaaatttaacagttgaatgatccagtttcattttattttgatgattatagtggagcttcagcagtatttgttttctaccttttgactcaacagtgttaaataaattgtagttagcagattttgttactgaattatattcacccagctgtacttaaaataatttttctttcctgaaagtactagctcttttatcatgccctttctttaaatgattatttttttaatgtgtcttataaaaagcttctttcatatatatatatatatatatatgtatgctgcctggtgcagtggctcatgcctgtaatcccagcactttgggaggccaaggtgtggagatagttttagtccaggagttcaaggccagcctgggcagcatggcaaaacccatttgtataaaaaatacaaaaattagccaggcttggtggggtgtgcctgtagtgcaagctacttgggagtctgagatgggagggtcacctgaactgggggatgttgaggctgcagtgagtcataatcacaccattgcactccagcatgggcaacagacaccctgtcaaaaaaatgaataaataaaaaagaaaacaaaaggaaaaaaaatgtatgctgtgtgcttctaatctaatatacagacaattttgtgttaatttgtttttgatcttcaggttaagaatgatgtcttactatgttatttttttaattttagttacagcacctaacaaaggcttagaactaaataactaaatgttgacttattttgttagtttttacattgttatatataggaaaaatttatatgtatcaagtaatagtttctactatcattaatttttgcttttcattactcctgaagattttttaaaaattaggaaagactttttaaagaaattagaaacaaatttcaacatccaatttttatttccccagttacattaattacttgttccatttatattctccctttatttgactatttttggcaaactgaaagttcttacaatgtatccacacataaatagagaaatagttttatccaagaaacaattgattgtattttatttatatttatatttttcatagcaattaaattatatgttggtgagaagttaaggggaacacaaggaaaatattatttggggataccttgataatattaccacaaataagatccactggatctagtggttaaatgatttgattgtgaatgtgtagctctaaacaaagaatttatttactatgtaatatagaatcataaaatgaatgtattcagaagcatacttttgagaatattgaacatttcagactcacagacatacaagttatattttgccacaagcaaggttttcttacctctgcattatcccaatgactactattcttaagaaatgaaaagttgaatgttatgtaatcaaacaaaaatcatgcatgcctgagctaccaacctcaacatttggtttggttttgttgaagacagatacattcttgctgataactaaaacagaaacttatttgcatgataaattagattcctccagggattcaagatattcccttataatattaggaaatttgtgtatacagccctctagtatccaaatactctcaagagtgaatgtacattttttaaaaacttgacagagtgtataaaaagagagagaccaagtaatgtttgctgttaggaattcaatgaccatgtcgccttgaacttaagattctcaattccttactttctcttatttctaccttctctctctgctgtaaagaacaagtaaacaaactgtagaagcctagagggtacacgtgagtctatagattccatcaattacaaatggagcgtgcaagaaaggccttgtcagtggagacttagaatttctgtgtagaaaatgtttaggttaatgtggttagaagagaacatttaggagccgtggaaaaaaatttggcataaccttaacattaaattctaataaagttactttgaaagaaaggttaattattcacaagtttttatttatagatcatattgaaacgttctaaataaatcatcggtttaaaaccaacaatctagtataagaaaaaatatattattcagattaatataataataataaaacattccattgtgtaccacctaaaacatcatctcttaggtgacatcaatgtaattatggaggaacatttatgctatggcaagatccctagatgtagaatccaacaacataatttttactctaataccaggccatgagtaagtaaggcaatctgagctaagagatcagtaacttcaagcagtattctccaatttttcttgttgttattgttcacctaagaagcccatgaaactccatgaaacaaaatagtatggaataaagtctgtcagggagagttgatctttgggaaaccacaaatcattgtgatacctaaaatattattgctcccaagaaccaatttttacacctttgggggtcataatgattatgttgagaatgcatgccttacaggaaaaggaatggtaatatgcattgttggtaaaccctggatttaattactacacactttttaggaaactatctagaaatatatgaacatgtcccatatttcatatcccgtatttctagatatctcatatttctagaacttttttgctgaagtacaagtaccaaaaaacatgaggttacacgtaaaagagtgtttatatcagcattacttgtagtggcaaaaacttgagttcattaatacgggaacggtagagcaagttatgatggagtcaccatacatctctcaaacagaagaatctatattactgacctgaagagatgtctataatgataaaagaaaaacaaattagagtgcaataagcagttatactttcagaaaaatgagaatgatgtgtgggagcttatcagtttcatttttgtgtatttttgctttattaaattagtttctaaaagcatttagacctcctttaatttaatattttaaaaatgtcaaatatgaaacaagttaaagagcatggaaaagttacaattgcaccagacacaaatatattttatgttagtcatgttgttggaaaagtaaatgtttgatcttgagaaagttgcagagaaacagccaagtaaccaagtaaccaactttagaaaccaatctttaggtaggtattcttaattttaaattgtctcccagaaaaagcatttttaaaataataagaaaagaagctatatcacctgattcaagtattacttaaagtacactaagcttggaattttaaaattatacatgtgaattctaacttccttaaccttgtgttcatagaaaccaatatatttagttgccctttggaaatgtactgatctgatttagaaaaagtacacttttctctttttcatagatacaaatacatgctctgaattgattattattggcacatttacattttaattataaatatattttgcagatttatgatggaaaagataaaacgactcatctactaggtgcttttactggtgcatctatgcgcggactgacacttagtagtacttcaaatcaactctggctagaatttaattccgatactgaagggacagatgaaggctttcaacttgtgtataccagtaagtattttagaagagtaaaatggccaaacactggggtgctgcatgtatattaaataattacattgcacaaattgaaatgatatccaatatttgattattaatttacagctcctttctacatatataattttatttgaccctaacaacagcccggtaagttacaggtattttagctattgccattttacagttgaaacgactcagtttgttttacagaggttaagtaatttttgacttcgggtttatttacttaggtagttttaagtagcaggattctattcatccagtatttaagaaatacaatgaaacttttgttagatggaaatccaatgtttgaactctcatcttgaactgcaaagatgcaatgattattattggtcagttataaatgataactaaaagacttcaggttgtttcacactaaagagtaactaaagcttttagtttgttctgcttttgtgttgacttgttttataacaaatactttctcacagttctattatctcattatgttaaagtcagctattttgactatttaaataagttgaagttcaaacactaagaaccaggggtagggtgggtttcatcaattgttatatgaattaaatggatgtgttttactagtaccgttatataagaaacagactagttacaccaatgaaaaataaattctattcaaataatatatttcttgattttctactccgttcaggattctttgctaataaattaaagtgcgagtaaaacaggtgttacttcctatgtatttgataaatttacaatctgtcagatcaaattgattcttggaaggtcagagcactcattaatgttgtatagtaaaataagtagcaatactcagaaatctttattgctagaatgcttgacaaaatttactgactcctataaattttctcaagaagtcagatgaatggaaattattatagaaactaagaagttaaaaaggttacagtatcaaagataatcatataggatcttaaagggaatttgaatcaaattataatttgtgtaaagagtctatcttaatggtataagaaatagtagacaagagaatacaatgactcattgtatgaaaacatttttgtccataatactgagattatctatttatttcagtgcttttctttctacctgttaaaatttttacatcactaacattaactaaacataaattaacaaaatgaatgctgaatacatatttttaaattctcagaactgtgtgtacaatgtgatttcttatgagtcttcctaaggaaaaataatagtccagacaaattgtgtttacaagtattgttatgtgatggactaaaagtaatgatattgagcaatatcaatattgtaatgatattgagtaatgatattgagtaatgatattgagcaatatactattgctcaaatataattggtgtgatctgctcagatgggcaaacttttttttttttaaatatgctgtcctctttctctttctctgttttctaaaagggccactgatgattttgaagtaatattgaaatgcatgacacaatgtttacgtaatggtttttgttctgcatcatgttgcatttcttttattttctttctttctttctttcttttttttttttttatttgagacagagtttcagtcttgttgcccaggccggagtgcaatggcgcgatctttgcttactgcaacctctccctcccaggttcaagcaattctcctgcttcagcctccctagtagctgggattacaggcacccgccaccatgcctggctaatttttgtatttttagtagagatggtgtttcaccatgttggccagtctggtgttgaactcctgacctcaggcgatcctcccacctaggcctcgcaaagtgctgggattacaggcattagccaccatgcccagcctgcatttctgcttgtctgaaatatttgtgggtttcacagaagaaacctggatttttttgttttgatacataatatctatgtaacttgaggttactgatgcaaaatagtagccattgtagggcatacctatatttgaaattttatggggtgctcaggtgactggaatgagtaagatcattgactttattgtcattagtgtgaactgtagaatttttttaaaaagatattttaattagcaaatatttgaagtcacatttcttttcttaattaacaattaattggctgggcttggtggctcacgcctgtaatcccagcactttgggaggctgaggcaggcagatcacctgaggtcgggagtctgagaccagcctgaccaacatgaagaaaccccgtctctactaaaaatacaaaattagctgggcgtggtggcacatgcctgtaatcccagctactagggagggtgaggcaggagaaccgcttgaacctgggagggagaggttgcagtgagccaagattgcgccattgcactccagcctaggcaacaagagtgaaactccgtctcaaaataataaataaaataaaataaaaattaataattgtccattaaaggaaatgtatgtttatggagactggaaactacagaagtgggaagagagtataaagctgtcattcttaaaaagggaaaacatacatttataaatattttttagtcttagagataaaactaaaaatttccatatcatatctgtaaacaaaatgtttatagcctacttccaaggtatcttggcatatcagtagacaattttgtgaaccaacagctgggttctgagctgtattctctcggaaagggctttagaaatagtgatgcatctgtttttaagtgtatttgttcctaaatattacttcttatttttacagtggcaattcttctgcatatctgcaactatctaaatagttacccacagatttcctagctttaaaagaagtttgttcccatcctccaagtatatactatttgttttccaaccatagcacctgtgcccaggctactttctattttgtgcatgtcctactgactttggataccaattaaccttcaagatccatctcaaatatttattcatgaatgcttatcctgattctatcagctggaattaacagacgtttcaatgtttcttttgtggtagtttatatatgcaactaatataaccgttatcacattgcattgtggttatacttgtttgcgaacatatgtgcatcgttcttcaacacgctattttccttcatagcatctttagtccatttagttcaattgtatctttttacatactcttgatgaattaagatgtcatctgaatatgaattttataaaatgctttcatgatagtaaaacagttctactaagccacatattttaaatattcacaaaattcttggaagcagtaattattcaattcctgaacgtgatagaatgtgcatcaggatttcgtgtttaaatcctcatatccagttattcctaaggccaactctaaccctgtccattctgtggtacatttcccttacaatgattccagtttcatttctgaaatatctaacagagagaatcataggtattgcagaggaggtcacagtactcacattgacagaatcagaacaggagcgagaacatttgtctagggaggatcaggtaagacttcataaaggagggcgtattaaaggtcaggttggtggttcacagaaaaataattgtgggaagtattacaggcaaagagaaaggaatgaggaaagacacagagattaggaagaacattcaaggaaaataatctaattcagattaatcccacgtatcttgatgcttctcacaatttctagtgggagaacaagcaggctgtttttggccatcctatcaaatgatacctgccctatttaatgatagtcaccctgtattccattatctattttgttgagttagcaacacttgccattgtctgattattttcagttttgggtagataaaactgcatttggctgagataaaatgaaaaaagtatgttagaacagacctttaaagtgcgttttatttcaattatcttattggtccatttattatgtaattgctaagtatagtaaatggcctggtagacacagtgacttaaatgttgcttttggctttaactaatggaaaaccttaccatggcctaaacaatcagggtttattttgttcatataagaaaaagtgaagagtgagaaagtaggtagatcttgattcaactacttaacaagatcaacaaggattttgctcctgtctttctgctgtggcatgcctagagggttcactttttattttcatgtttgtggtgacatggtcacaagttggctactgtaactatgggcatgtttaaggcatgaagaaaggaaaaaatgggcagtgccaaccgcatatactccttttatcagaaatacaaaatctttcctgggaatccctgtaagataccctcttatgtctctatcctaaactggaccatatggttctgccttaattttccagcaaagcagcctggaatattcagtatgtggaagactaaataattggtttaactttagaccatcatgattcactgctgtatatcgttagattatagctgggaacaaaatcagagttgttagcaaggaagaagggagatattgagaagacaacttacagtatttactacaatgtacagctgtcacgaatattaaaaaaattaggttaaagatactgaactaatatctgcttctatgattaatggtgtcatggaagcccagaaactcttgggtgtttataaaggaaaagtatttggctgactcatgattaatatttttagctctactatgctaagaagactgtgagcttctctcaccttcttccaccaacaaataaattatatgcatacctagtatgaaaataccataccacactagacagggagaaaatatcccattcctttttctttttcttttttcttttcttttcttttttttttttcagtgccttgctctgtcgcccaggctggaatctctgtcttctgggttcgagcaattctcctgcctcagcctcttaagtagctaggattacaggcgcccaccaccatgcctggctaatttttttgtatttttaatagagacagggttttgccatattggccaggctggtctcgaactcctgacctccaatgatccacctgccttggcctcccaaaatgctgggattacaggtgtgagccaccatgccagccccattcctttttctaaagcaaattaaatctgttcagtcttcatctttagcgttgtcaagaaaaatctcatgtagtctttttggggaaatattcttctcccaaataaatttctcagtcaactctggtttgatctgacaattaaagtgtggacagctatactgttgaatataaaacatgtgtgagatacacttagatatttatgacctctaggggatttcactgctcttccatccctcaaacctcccagaatccaactcccttattgagtcaggctaatcttcctcattattctcaaaacaattactgtcatttactcttgcttttgagaaatctgaaactcatcccaaataaatatccgaatgagacataatgtcaggtactttacgcgacacaagttacttgttaatttccctgtgaggaggaaccaataaaggcatacctgttcttctgagagagaacagggagtagggtaagagaaaattactacttccttctagagttgggaaacagatcagaaattgagatcacaatacagtatccttcctaaaacatcactctgttctccataatcctatagcagaattcagcaaaacccagtaggttattctgcccagatcccttcaacctctcaacacacatttcaagaatgatttctaaatctggtgtattttactctctctctaaaggctaagttatagagatatcatttctacttggtcacctggcatatcttcccttttactcttctattgaaatttactaatttatttattattgaaattattaatctggtcataggcttaaattttgtcttttcccagtggaatattatatattgaaaatatagagaacaattaataagagaaagttcctgcccataacaaactaactttttagtggggcaagacataaaagaaagttatgaacaaaaggtaagagaactacatttagaagtaatttaaaacagggcaatgggatagatagtacagatgagaccactttagctaatttgttcagactccatcttaaaggagatgttatctgagttgatacctgagtgataagaaagaataatcacatacaggcaaagggttctaggcagagggagtagcaagtgcgaaggcctaaaagaagtctgagcttgagttatatgcctgtagctaaatgagcaaggagaatgagacaaaatgagtgataaagttggaaactagcagtagcaaataaccggggttcatcatctcatgccaagggaatctaggtcaaagacacaagaagtgggtttaggagcagaggtttaatagccaaaagaaagagcaaagagaacagctctctttcttgtgagagagaggggttcccaaatgggacttccagcccatagcagagtacaccagattttatagacaggcttatgaggtggtgtctgattttcataggtccaaaagattagttgaaccaggtatgacatttacataacacaccagaagctggctgccccaccctaatcttattttgcaaatggggtctttgcctggcctgcaccatgttgccttctccttactgtatgcatggctggcaaagagaagagaagaaggagccaccattttgaacatgcctagtcccaaatagcctttttctattggcacaactgccagcattcacccatgtaagtgtccagcttgcttgtctatgtttgcagcttgattttataagctgctctttgttagaaaagaaaatgatttggtggccgcttttcattaaaaggaaaaacttaccaagaattcccataccctcactatctgcctaaataatttcttaactcctatatcattaggggcaaggtggagtatagtacgggcttggattttatttaaaaggcacatagagactttggtcattatcataatgttcaatataagaattacaaataacaacagctaacatttatctaccacctaccagatgcaaggcataacccaaagagggagataatattattattcccagggagaaaatgaggaaataaaaagcatagcaaagttaccttactcacccaaggtcacatagctaacaagtgcagacatggaaattgaactgagagtctttgcctctagaatccatgtctctaaccactatgctatactagctctgaactcaagatttgagtttttcaagttttatagatttgaagtgttatatatttatatatatttcaagttttatagatttaatgtatttttaaaactgtccaggtaagagtaaaaaaaaaaaaaagagagagagagaaataatgttagtgcaattcttcccaaagaaacttttgtcattttatttttgagaatctgaatttttttttatttttgttacatttactatcggggaaagacttattcctgctatcattcatattgttcatgaaatctctaaactctatttgttgaagattatttaattacagattcttttagccctatatacttgtagttatactacttttattttgtaaaaaggaattgagtatttttaacagccatctattacagagccaaattgcaacttattgatggattatactattgtcttatcaaaagctgacctgctaaatatgcatgttgcccagccattagtcagtactctgggctcagatgttttcttattatctcctctgcacatttaatttacaaaaaatcccactggagaaatgttcattatcccaagagaaaactgtaaatatatttggatgttctcagccttccagttttgttgcttgaaatcatttaataatctacatggagcatggccatttcaaattttatattcaaattaaagatgggcattaactaatttgtgatgctttttcttgcatactagccttgtgaatatacaataaattagtctttaatttagttaccggtttgttgttggcaatgtaaatcgtaaaaaattatcagatgacttattaactctacctttattcttactatataactcatttaatgcaaatgcaagtagaaaataagtaaattacaagggagcaacaaagcccctccatgtggttctatgtcctacaaaccagttagcagatacatttgacatttcttacatttttaaaatatcaaaataaactgggtgataagggaggtattgatcaatgctgcgtgatatagtccaaagtattctaactgaaatactaaagaaaaatttcttaattaactgtcatttacatagacaatattaaatttcttcatactagaataataaaagtatcattattttcatagccttcacatcatagaagtttagtaaatttaaacttacatatctaaggacctgctaatttacatgttacatacaattaatttctggcaagttgaagacctaaatgtaaatatcaaaactttaaaatgtttagaaaataaaagtgtggcttagaaaagctgtgtctttaaggtagaagaagatttctgaaataagatacacaagcaaaaattcatcaataatcagtagcatttctgaccttctaagcactccttgaagtgtagaaaccaaaaatctggcaactacatttttcagattctcttgccaacaaatatctctgcttagattctgccaattaaaggcagacctgtgagagctgaaaggtgagatcgatggagaagccattattttccaccagcagctacaggcaggagtatggtgctgtcaggttgttggatgtggcagcagtttccctgaactgctgaatttcctgaaagccagcagtggtcttctgactttcacacactttgcatttccaaaatcatcaaggcctcaaatttcttgttttgaatcttagctacacacagtacataagaggcttctgttttcccgaccaagtcccggaaaaaaagaaaggaatggaaaggagaggagaggagaggagaagagagggaaggggaggggaagggagaagggaggggagaaaggaggggagaagggaggggagaaggaagggaagaaggaaggagaggaagaaggaaaggaagaaggaaaggaaagggccaagaaaacctccctatagaaagggacactgtaaacagaagtgaaacattttaaaaggaggtatttatataatggaaaacatgcactctctagaaaaaagaaatcctacaagtcaataagaaaaaaaaaaaataacctaaaacaaaaacatgggccaaaaccaatttcacagtagagggaagttcagcagaataaaaaaatgcttaacttgataggtattaagaaatgaaaaattcttttttagtttaaaagtgtggtgattaggttttcacactcgtgtgagctgtgccttcctcaattcttttttagtttaaaagtgtgatgattaggttttcacacttgtgtgagatgtgccttcctcaaaccttgttacaacgtctgcacattacccatcggacatggaaagaaaaaagaaatgaaaatggaaacccaaataagatgctatgacaccctcacagagtaaatacaagttagaaagctgtacaacaccaagtactgatgacaatttgcagaaattgaaacttataaactttggggaatgtaaattggtagtcacctagaagattaatttggcaatatctaataaaattcaatttctggatatatttagattacaccaactatacatttaggccaaatgcccaatgctgattggttttgaccaagttaatattcagtcaaagatgaacatcaccaacctagaatgtggtacaaatctatgatgtacaggatacaaacttagcccgtttaatattacttactagattatgtctaacagattaaaatttaggaaagtctgtcagtaatgtattttctagtaagaactttatatgtaggaatgaaagcatctgccattaaaaaaaaaaaagatccttttatcttaactcctgaaagcaattggaaatgcatagtaataatttccacaagctttttttgcttaaattcttaatttccataaactaaaaactggaagggattgtcttcttaaagcattcttctaaagttgtagctttaaagtttgatttttgtatagtttgattagtgagaaatacatgttgtgtcaaatttgtttttattagttctattaatgagaaaaagagtataactcttcttcaccattttctttttttctttattccctttatattctttattatatctcaatcacagaggattattgcagctgttgtttgttatcttgaagtattccctgttcgtgaattctgaggtggcacagttgacattctgctttatagttaaattccagagtatttaatggtcaatgaagatatgttagttttatgtggcaatagtaaaaacttccaaattgctaaatacaaaaagaaatagattgttaaaaaggaaattgggaaagtatgttagctaaatacgttagagaaatatgcttgccatatatgttaataaaagttgatataatgaagttgatataaaagttgatataaatgaagaggtcttcacttaaatataaagaattttaaaataggatgttttcttgcaagactcatggccaaaatggaatttaatcaccaaatattaaatatagttcccccaaattattctgcctaatattatgaattaagttcaccaacaattctatagaggttaaaattattgcataataatataatattcatgtctccttgcattatatcaacttttattaatatatatggttttggcaagcatatttctctaatgtatttagctaacatactttcccaatttcctttttaacaatctatttctttttttatttagcaatctggaagtttttactattagcacatgaaactaacatatcttcattgaccgttaaatactctggaatttaacttataaagtatatatttatgttttaactgaattaaaaaaataaagcaagtaagagtctttttaagttacttaaaatatattttattacatttaaaaatgaattttcacatgtcacttttatttttaaatgatgtaaattatttgtattactggtagtgttttgctagtaaggtatgacattaccctatgtgaatacatagttactcataaacaaattgagagaaattatgttgaggtcaaaattttactatttatcttttagtaagccaagacagaagttaagtaattgattaggagattttggttgaatcttgaggacaaagtgaactttatatctttaaatagtgcatgccctataaaaacacgtgtacatgtgcaaaaggagacatagaagtatagcattttcatagcagtaaaaaattggaaacaatataaatgctgcaaaatcaattagtttgggaatatgtcaccaacggaataccacagagtagttaaaatgaatacaatgtgtttgtgtgtgtgtgagtgtgcgcatgtgtgcatgcctgggtatataattataaagataaaacgcaataccaggcaataaatgaagccacagaatttttaaaaccattatataatttataaaatgtatgaacacttgcaaaacactatatattgctcattgatgtatagatatgtaataaaaaatatgtgcaagaataataaactgaattagaatatttgctagctctcagggaagaaacagagaaagactggggaggagtacaaaagaatctttaacttgttttgtaataataatattaacgtgaagatgaattaatatgaatggtaatctgaatattaatctgaattaacattgatttgagtctgacacaactatgatacaaaactagaatctgatagagctagtggttgaatttgttgtcatcctttatatttttttgtagatttcaaataacttacaaatatattagatatctttggagaaatatgctacacggtggcaggaaaggaatgaaatctcagtttaaggtattcagaaaatcaaaaacatctaggtaatggggattatcagttcatttttgttctagaaattttcatttcaccagcgtataaaatttcacaagcagtgttgaatatttatagcatatacggtttttcatacacatctttatttaattgtcagtttcaagtatttgagcttttcaatgaaaagactagcagctgaacgtttccataaagataagacatttctgcatatttatgaataagcaacaataattccaccaatttggacaaaattatgttgtgctttgtagcttatatactattgtccatgtgcattttcagctacaatgcaaaatattataaattgtcttaatttacaaagaatatatccattttacctcatcaccagcaatgcccaaccacatttacagaaaattcaaattaaggaaggatgaatttggcaataaaccttgaaaacagagcttgatttccatttttattttgagaaatgatatatggtaaaactcaaaatacattgcatcttgaatgataaactgaatattatatctgctggaagaaatgcaaacttgtaatttttgagcaaagacgtttaaatgtagtattaagtatgcagatccatgcaaagtaatatgttctgaaattttaaagtactacttctgctgtttcttctgtgtttgagagactgacctgtttgactattttttcattgcatttcattatatatgtcatgatttgagttaatgactgctaacctctttatggctatgtctctgatgctgtttgcatgttcacccaaatggggttatcataaattgagatattcaggaaattcttgaaactatttttaaaaatggtctctcaaatttcagtttcttatcagcattactttatttttcagttgtctcctagaaataattgtttctaagaatccacattcaatcatgaacattactgagcattactgagcatctagcctgtctcaggatttgtgctagataggtactgtgagaaagagggaggggaaaaaaggaaagaatttcagctatacaaaaacaaggaaaagaaacaatcattgcaaatgaattcaaaggtacaaataattctatgatttaacagaggaggaagtgattaagaccccttaatagagactaggaaagactcctaatgttctctgagagataatgtttatctcaactcacagaaataataggataaacttagtacttagaactatacaagttcttgtgactttatgtatgttgtgacaatctagaaagtcaatgatgcaaattagtgatttgacacaagtgagctaatatacacttttttgctttctaattcaaatctagattaatttggtcaagaatctatgcctataaaagttatgtagatctctttttgatcaccatataatttaggacacaagtaaaagttttttttctccagcatttttgtcttaagtgattttccttattcataaaactatctagaatattcttaaaggttttctatcctcagaagctgtaattaatataagttttcacctaattgtccttggtgtatttattacatcatttaccctacatttttatattttgcaaaatattaaaaacagaagaaactatatagctacggcagcttagattttgatttgttcatatcaggtttggtttatcttttgaagtgtccttttccagttccttcagaatcttaattgtgttgtgttaagactgttgggatttttagcattcacctttattaactttactttgaatatgcaaatgaggtattcaggatgcagatagattcttattaagtaatataatgatgatgatgatgtctgtgtcagctctcctttcacctagtccttactcctgggggcaacaccatgaatacctaatgaaaaaatcttctacagaagtggccaggggcttcatagacaaaggaagaaaaacaaatgagcttattctgctgctttctctctctcctctcctggaaggtgggagaaaaacctatgctccttggagattggatggaaaggatcatgtgttcttactctaaccttttgtaatgtaaatatatctatttaagggacatattaatctcccatatctcaaacttttataacctagagatttctgtaaatttctgggcctcattcttcattgaaatgtaaacataaaccttcctcacagttacataaatttctctggagttttctcactattcatacagttgtaaattaacttctcaagtgtcgctcttagcccaggatctcagtttttagcaaattcattcagaaagccccaaccctgtagaaacacagaaatattatctctacatctcagaatgacaacacgtgggaagcctctattttttttcctgtgagaatttctaagaactgtgctttttccggagaaagtagaatataaaaatttagagttcatcaagctgattagtatattagcttgataaagtatattttaaatatgagagtattcactttcttctaaggttatacaactaaagcagtccagttatatttgcaattgacattatttgtcatttggctagttattatttcacatattttgtcttaattttaaaatgttgatgatatgatcttaatagttatgttgatcagtaatgcaaaacccaattctctgctcacaccccttctgacgccatatatgtatgtttcttcctcgcaccgaccaattatccagctctctggtgtagggatagaaagatgtgatacctttcgtcaccctcatatgtgtcatgctgatattcctatttgacaagagaaaagcataataaatttattggatcatggttttatatgacatgggagccttcagaaataaagacccaaagaacccgtaaaaactgtctgtttttatgctgcggttcagtgatgaatggtcagctacgtagaaatgtaattggacataaaaggtataatctatcagtaatagattgagaatgggaaacccagcaagcctgtttgttcaaattcttcttgacctctttatggagctttcctttccagggtatggggcaggacccctatggaatgagggttttcaagggagaaggaagaaaatgacctttctaggttctgtggctcgctttgggggagaggttttctagtttttatgatgcatcttggggaagaagaattctggcttgtatgactagctttgggagagagaaagtggcagaagggcagaagaagggcagagagaccttgcttctgaggccttctaatcacttttcattcaaagcactcagcatgccaaagtgccatactttggagtatattgttctgagcgccaacacttgaaaccgacttgatgtctggtaattcaattcaattctaacactacttgcagttaatatagaccccacagtttaggggctcaatccgacaagaatgcccacacttcagatgccaattgaaaatctaggcctcttgtatttctgactgacgagctataaattggggtttcccataacttcctccttgagtttgataatttgctagaatgctcacaaaactcagggaaacatttactcacctttattggtttattataaaggatacaaacgaagagctaccaaaggaagaggtacatagctgaggtccagaagggtcccaagtgcaggagcttctgtccccatggagtggggatttggggtatatcacccttctagcatgtggaggtgttcatgaatctgaaaactctcagaacccctctgtctaagattattatggagattttattacataggcataattgattaaatcattgctcctcagtaattgactcaaccttcagtccttctcccctccacggagatgtatgtatatgacccggccatggggacggcactgaaagttccaacacaaccttctaatcatatggttggtttctctggcgataagcccccatcctccaggaacaacttcattatagaaacttaggtatggatggcttatgataagtaacaaaaactgtactctcactcttatcactcaagaaattccaagacttttaggagctctgtgccaggaatcagggacaaagaacaaatatatacttgttgttatatcatggtatcactcagaatctactattaactctaaatcacttgaagcagacaggaagcttagtaccacaagccatggtaattatatagaccatggggtatcattgataaacttcaaaaacacaacacattttaattttcaagaaaaaaaaaggtctgcatggttgttgtatgatacgaaaattaaatatggtaagggcaatatgactaagaataagtatgtaatcatcaaaaatagtaaaggaaaggaatgatttgtatagatttaaatcctcctcctaaattttgcctttaatcaatttatatttttgtcccaggttttgaactctcacactgtgaagatcctggcattccacaatttggatacaagatcagtgaccaaggccactttgctggtagcaccatcatttatggatgcaatccaggctacactctccacggaagtagccttctcaagtgcatgacaggggagagaagggcatgggactatcctctgccttcctgtattggtaggatactgtcatagattttcattgaatatttctgtgaaaactttatcaaattctttgcatttttaagaaattctttctgtcctcatagaactaacactttatatcgagaaattaatgaactcatagcttgaatttgtcaaaagaaaattaatggaaaatgaaaaggtccttttcataactttattcattattcctcccataatcttctagtttgtgggggacaatatggtctctttgaagtcattttatttctgctacctcgacataaaatggaactcattactaaaatgttaagacttttaattatacacatttattgaattgcattggccagatttttttaatttacaaaattattacctattgtggaatcaaggtggattagagaaaacagtaacctattctcttttctcatgcatgttacagcatagcactcaatttcagtaggaaaaggaatgtgagagtgacataagatatattgctttcgtgaagctagagaatgatcattttctgtcttctttgcatagctggggtaccattttattcctaccatcttgtagattagttaatgcatagatgggtaggtgggggtgggaaggtagatagacaaatattgacaggtgtggatagagatctctctttttctctttttcttttctgctctaaagaccaagtaggtgtcagattggaatactaggacaacaaaggaaaacaactttgtagcaaaacactaactctccagcagagaacatatatgcagtgattcttcagcctttctttttttgatggcatttatagaggcagaaatccattctgtgtcaggcctatatggataaaattgactcaaatcttttatttttagaaggtgtactgaggtataattgatatacaaaaaactacacatatttaatgtgcaatttgacttaccttttaagacctggaccttttgacaaaagtagaatatttctgtcgttttttgatgtggtcagcataggaattgccataaaacttgctagaatacaaatagaaaatatgaaattctagttattataggccttgcaactaattgcgtagtggttttgatgctatgagacctctgttggtttattaaaacattgattcatgcagaaaacaacatggttttatctaactaaaatgcaatcacagttcttacttttcagacggcatctgaattttggagagattgtgagggtgatacctaaaataataatcaaattaaattgccaaaagctggaatatgatcaataatcagcccattggcattggttatgagaaaaatgtaccactgactaattctctctgatgtgattatgaaatatgttcagaaaagctttaagagtttaatagcacaataccataaatgtataaatattgacttgccatgctgtttttaaaattaaaaccacaaacaaatacattaaaagcatatatatttttatgtgtgttgaaacaagctgaagatattctctactttttggaaaggttttatacaaatggaaggatatttagtatgagatcagaaggttttaattatgttcgcagcaaatcaatgcattttatgtttacaagtactcaaaatcaaaacatgttgacttgatattgcacaagatttcacaggtagggtaatcttctttattaaaattctaatgatggatgatcaaataaatttagcagctataaacagttggacatatggtgagtgatactgaataatttgatgataacagaagatgaaattctattttagatggtgttctctactcgcaatgattaatagctttaacacttggcctatgattataatagcctgtgctcattaaccttaaatatcttctacagctatgttttagcctcagtcaaataaggaaacttttcttaattatttagattacttataggtaattatatttctgaatcttattcattgatgaaacaaaaattagtttttgaggcaccatagctggaaggatttaacctgtatctcttctttaaacactaaatttcattttattctgcaaacataagttttatatagaatatgaactccagtactacagcatatgacactggctcatttgaggtcaaaaatgccaggtaatattttataacaaagaaatatggggggaaacagctatgtttaagttcaagatgcaatatagtgcaaaattctctaattgactataaattaatcaagaagaataagtatcaactctgttctcaaattaaatgtaatcaaatagtgataaatcataaataaatgatgaaaaatgaattaatacaattatgtttacagattgtccaaaagaatttttgttagaaaaaaatgaaaaaccataaatggtgataacatcttaaatactaatatctttttaatttaaaaatctcccgagtgtgttattgtaaattagattaaattaatgttgcaataaaaggtaatattcccttagccctccatgggtatatcagtcagggttctccagagaaacagcaccaataggatatctctctttctctctgtctctgtctctctcttttgtctctctctctctgtcttccttatccatctatctatctatagagctttatttaatttaaggaactgaatcatgcaatggtgggggctgataagtccaaagtccatagggcaagttaatagcttagaaactgaggcaggagttgctgaagttttgagaaagaatttcttttttttccccccaggaaacttagttgtgctcttaaggtcttcaaatttattggatgaggcctacaagtcaactgagtgtagatgttatccatacctataaaatagttaattaaataactggcactaatagcccagccaagttgacacataaaactatccatcacagtttggtgcaatatagtatctaaaatttttaaaacaagttaacatatatgcagcctacaaatttgagccattagattctagtgttatcaggtctcttccaaatgctaaaactttcctgctttgaccttctttggtctaataataataataatcaaaaataaaaagtttaattcagttatttaatctaagataataggaaagttgtcagaatcaaaatggagtcacttgttttaaaaactctgacaaacagagctgggaaagccataaggggagggttctcatgcacaagtgcctgataacaagaactatcacaaaagattcaaatgtgtaaggcattccacagtgttttccttgtttctagggtttaaagacgtagagcaatatgctaactaaaatacttagtttctctcttttccagtacagagactctttctaggttgttcactgacgtaaaatcactccagttatcacaacagtattaaatagtattaaaatggagaaggaatcccctaaaatataaaattttaattatattgcatgacgatactcacattcttagtttgataatttttataaaaattagagaccacattaaatcaaaacctaactagattttactgaagtaaggaatctaataaaaaatgccattttgacttttgggagagtacaagggaaagggtttaaaatgatttaaaggggaaataaaaggacaatgaaatttagaaggcctgagggactgcagtaaagattagtttttctcaaaggcggggtagcaagatgatgaattattcagcctgcaatttgttagcagtgagcaacttgccatctgtttcccttttaaaattatcgttatttaacaacacatcttaaaatgtttggaatcctaactcagaggttttgagtgtgtcttgttttaattctttaagtaggtttcagttttgttgtcttttttgtgctctaacttgagactctattatttgattgtattatatattcttgcttcaattgatactttaaaagtttatacaaatgtatactttaaagaaacaagaaaatcagtattcttttgtctactcatgagaaatttgtagattgttttgaaaagattggcattaaattgtggcttaaatttctattattttttatcagctgaatgtggaggtcgttttaaaggagaatcatcaggaagaatcttatctcctggctatccttttccatatgacaataacctgcgttgcatgtggatgattgaggtagatcctggaaatattgtcaggtaaatgaatttcattttctcaacattactagggaatctgaagtgcctaaccaacccctatataaaattaatatccatttatttcattttttgtttgtttgtttttcttgaggcagagtcttgctctgacatccagaccggaaggcagggctcgatctcggctcactgcaacctcctcctcataggctcaaatgatcttcccacctcagcctccccagtaggtgggaatacaggcatgtgctaccaggctaggctaatttttaaatattttgtagaaacgaggtctcactatattgaccaggctggtctcaaaatgttgggctcaagcaattctgcctcccaaagtgctgggattacaggtgtgagccactacacctggcccattttgactgatatacagagttttgcaaattattaccctagtgcatcctcattaacaattaggagaaataagaatagaaggggactgaataccatttcctgttgtccttgtccctaaacacatttgtgaaacacttgctctctgcccatgtaatcatgttagatttcccttttccgcagagttcctcacattgttactaccccttagataagtacagagtcattatctcaaatcaacaccagtctgacttccaaagctatcacaggctctcagtcccagccttactatgcagctttggctagaatcatccttgacatatgagctacttggtgtgttttcaataacaaacaataactttaaaacttaagaattactacttatataaagtagtaatataaattccatttatatacaatggaatttcagacaggcttctaggtggtatactactatgcattgatggatgcagtgtgagttggtacattacttttgcaaggcaatgtgcaaactgaaaatagactacactatatcatccccagtttatttttctttagtctaagtcgtgcattgttttatataaatattattaaacttgaaagtaataaattcaccagatttctgcaatttctaaaaattaaacattatttgatgttaaattgcaacttaaatttaaagctgtaacgattcatgtatcaaacataaatgtattgtatgtagagttgagcatgtcaatataattagatttctaaattttgcaccaagcacaaaaagcacccgattctaattttgtctagcttaaacttaaaacagaatagatttaacatgaaacgtggcaaaagcatgtactgtagagtcagaaaacttgagttcaatttttgactatgccactctttgggaaattatttcatttatctaaactccatttgccatatttgtaaaattaagataaaaattattcatatttcattgggtcattataacaattaaacaaataaaatatatgtaacgcattttgcacagtgcctagcatgtagaagattatctataaatgtcccctgctgttgccctagttaaatccatgaacacgggaaagaatgtatgcctgaagtttctacaatttgcaaaggtgatgtaatattgtatttaataatattctaaaaaaacaaattatatgtctcaagaaaaatatattaagaatatatgctgtttatgtaattcatttttaacacatagcaaaaaagaactatctagtaaaaggcataatgcacatttgttctattttttctttaaagttgaatccttgtttaaaataatcagagaaatatggttctcccacagcttgcagtttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagtaagttttttcaaaaaatttcttcaatgcaaaataggaaggtgatgtaaatagtcatgttaactttactgttcaaaattttaattttaaaattttaatgattttaaatattcgtgtttctagtcttcctatatttctgcagcaaaggtaaaatatacatgggaaaaaggtaatacaactaactttgaatattgattgttgagacttctctccacctgtaaaatcatttattcttaaagtaaaagtggtgttaaattactcagctaaaaaaaaaattacatcacaaaagcttataatctggaaatagtataaaagtagaagttttaaaatatgaagttttgcagatgaggaaggaaatgactacttgctattacaaaaaatacaaccctacatttttcctgttttttaaaaattatctaaatatcttaattatgtattcacagacatctttgacaaaatatttcagatggcttttaaattaaagattttctataacaataatatgacaatgaaatagcattccttgtaagtaattaccagtgttcttgtcttgctaatttttttcttctcatggcactgctaagtggctaaatatatgttgttctgtaaaagaaattttagtttagttgatggataaaatgaataaaaacttaaaatgtttaaatgctgttttaacttgttaatgcacattatctctttgagaaaattatctaatagattttttatctgtatagtcttaaaaagtcctattaacagaaatgtgtcaatgtttctatgatcaactatgagtgaaaaccagtactcttcaaatgtgtcggaattcaaattctggctgtttactaactgctaattttgggcacgttacctagtgacccgatactgggttttctaattgacgtaggaataacaatgctcatctcataaataagttattaaatctaacagaatcatgtgtgcacagtatttggtattgagtagataactggtacctaatgaactattatttttacataaataaatgtaacattgaaatgtcttgaaaataaataatacaaatagtttaaaaaagtatgaaggaaggacttttgaaatcagtgccaacaaaatataccgttttaagtaaacaattatacagttaaacaattgtcttggctgactttttgtttatggaacacaattattctccctactaacacaaacaaattattttgtactatatgacccaagttcatgtgaaagagaggtataaactgaaaagtcaatatctctaaatttgcactttaaatatatattttgagaaaatggaataaaataagaaaataatcatataataggtgaatataaatggctccgaattagaaaacatttaccaatgaaatattcttcatatttgtatattctactctctactgtttatttttttaagtgggaacaatttgtcagagagcggcttaattttagttatttctattgtagtttagcaataaacaattcttgcttttactttagattagtaatacatagtgttttccacttaaattgttattgcaattaaatatctgcatacagtaatatggaaaggtgtctcaagctcagtgtttgcaaatgcaacttacactttacactcaaccttatctggttaagtggaaacacactattttagatgcatttctgggaatttttattgtagataatctgtgaaaatagcagtacatttttatatttattatatttgtagggcacattaaagttatagaaacaatatatttcatactagagctttaataactctgccttcataagttttttttaagatgaatagaaatttgatctgagccttaaaatcaacctattgaaataaagttacattgatggttactacattgtgaatgaaaaattaacctcttggctagagatcttttctaaaacatgtgcttacacagcttttcaagtgttcagatttgaaatgggaaaatattcttttcatgaatgaagtcttgatgggtgccaagaatcaagttaaatgctttatatacataatctcatttaattctcacaaaagccatataagatatggttatcattctcattgcccaaagaaatacattaatgttcagaaagtcagttaatttgttcaagatcatacaactagcagatgcctggagtgataactgaaactcacatgtctgaaaggagattaatgtcatgctttgtacatactaaatgcttagtagttattattacagtattattattctagatacatgcattaatatgccagggggaatagaaagctttcagttatatattattagctgcaatggagttctacattttaatcaatttggtttcctgattataattccaagcaccacatcaaaggtcccaatctaaaaaaggagatgaaatatgagtgaaaccgtgagaagaaatggaggaaagccggagtacatacatgcccatctgaaagggacagatgccctctctggttctaagcattttgccctataggaagacaggaaaattttaaagtggaatttgaaataagaaattttatctaaagtcatctagtttctaaagtatacaagtggtattaaagagaatgtaaatggactataggccactaaacaactaccgtgggtcaaacttggctcgtgggatcatgtttgccacttcagtgctttacctaaattattcttccctagataaatctatttcatcctacccattcattcatatgttcatccgctaattcattcactcattcatcctaggagagtctagtaagaaccaggtattaaacatatttatcactaattaattctcaaactcatcttttcattaactcaagcaactcttaatttcatacactctctctctctctgctgctttccatcaccaaaccttcttttttctttagtgttagttctgctcccatgtgcttaaattctgctcattcttccagactctgtgccaagatcccttttcagtaaaatattttcttactattctagctcatgctccttccagtagttgtatttctttttccccaaataaagaccagtataaaaggcgtagcaattcattgttctagaagttttttggttgttttttgtttttttagagtcaatgtcttgctctgtcacccagggtgcagtgcagtggcacaatcacagctcactgcaacctcaacctcctaagttcaagcgatcttcccacctcagccccccatgtagctaggactacaggtgtgcaccacacttcactaatttttattttttttttgtacagatgaggtctcattacgtcggccaggctggtaatggtattttaattatggtgcctttgcgcccccaaatatattaatatcatggatacctttgtctcttaaaatgtctatataaaacacatattttgtacagggtgataatataatttactatccaaacttaaggtattttggagattaaaagcaagtgctaataaaaattaagctcagcaataggcacaaaccaggatgctcctacaaaatcaggaagtattgtcgttttaattgtcagattttatttgagccccccttccccgattagtacaatttaattccattcttcttttgagcaaatagctgtccattgaaagtcaaaataattaattaaaaataataaatcaggcaatagtagcagaacagtcttcaccaatgaatgtaacaggtgatacgtgtttccccaaacttggtgcaaagtaaatttaacagaaatgtaggccacagaccaacttgataatcatcaagccactgtcggcagcctcatgacttttatttcatgatccattcatcctttgtagagtctgttgctttatctcttggtgttattgtctgcaaggcacttttgcttaatcagagctacttaagtctaacattgccacttcacgctgtcctatgtgctgtcctcacttctcagtagtcagcttctatatcctctgcttacattttaatctgcctgtctcattccactttagttccccagggaagatatcattgggtatcatgctgtcatttgcccacagaatagtagattctgacagagcattttctatgctcttcactctttgacctctctgttgagaatcttcccctgctgggtaatacaaaatgctgaggcccgtagctaatactgttgaaaaatctcaaggaaatatatcccttagccatgagaggttgaagttccccagctttaaccaattgcatggtgcccctgcctttgttctcatccttattattgttccctgcactgctctaacagtcgactagccactcacttctttatccctccagcaaaacttttctccacatttctacctgactgatctttccgaaatacaaaattggacatcacttctctgttgaaaattatttaatggccacacaaatctaaactcaacactttggcatgacatttaaagcctccagaatatgtcccaacctacctgccagcttcactcctcactattcatttatatacatccagaggtctaattaaattgtcctgaaaggacaatatcgtcgcacgtttctactgctttgcaaactctcttccatattcctgaaacacttgtacctacattcaaaatttgtacaattttagtcattttccaggacataggctaaatgctacttctagtagcaatgaactactagacagaattacttatttccatttccacatatgtactgctcttccctggtttactaaggacagtccttatttatgcctgttgtcctggcattctgactgtgttgacatttatcctgtattttccctttttaacaaagtatcactattagtagttcattaaaataagccacagtgtatttattagatccccgctttgtgacataagtttgcagtgctcagtaattataatgcatggttacatctgaaagacaaatactattaggttggtgcaaaagtaattgtggtttttgccataataacttgtatctatttctcaactttttccagatgccaggtgattaacacttacctttcaaggatagaacataggacacttagagataaaatgaagcattcttagatatgaacaggtcacccattctgaccctagatggtggtgggaagagcatttattattattattattattattatttttttttttttttttttttgagatggagtctcgctctgtcgcccaggctggagtgcagtggcacgatcttgggtcactgcaacctacacctcccgggctcaagcaattctcctgcctcagcctcccgaatagctgggattacaggcgcgtgccaccaggcccagataattttctatatttttagtagagacggggtttcaccatgttagccaagatggtctcgatctcctgaccttgtgatccgcccgcctcagcacccccaagtgctgggattacaggcatgaaccactgtgcctggccaggaggagcatttgacattgttgccctgacagatattttgtataacagatagttatgctacagcatgtattgtggtttgaatgatacgtaagactgccaggccatgaattggcaggattagggggaaatatgggaaatatgtgttcttgaagtatgtgtagaaatagagactgagcagttgatttacagacctacaaaatatagcctgaatactcatgccacgagtatatatgctgtttattttattgtgtaaatttggaactaattactttatcattgaaatatgctttattatcttgcaatagacctttatggcagcaatgagattttaaaaattaaatgtttaatgaaaaagtttgtactgaacattcatttcttaagaaagctgatatccactaagatgtccaaaaggaaagtcagttctgctgaaggggctgtcaagaaacacccaagcagagatcagcaaggattctacaaaaaccaatccttgtgaaaattgaaacgaaaccaaaaagataacagaaaatgatccagaatagttttttaatcactatttgtaaatccaagaatttcatacatccagaaacaaatttttttaaaaagcagagagtagcacataatcccatttcaataaaacttatttagataagtgataaaacttttttaagagggaaaatcatgcactgatcatttatttagctgtgtgaacagaaattagtaaaacattgaattaaatgaaacactattattttgtgtatcatgtttacattttataggctagtgaagagggcagttttattaatatatgccaaaatatggatcagattgaatggttatttgaagccataataatgcattaaatacatcctcatcattttaaagtacctgatatattaaatatgtgttaatcattttacagtacctatcttcaacagccacattatttttatttcaatttattttactgtggtaagaacaattaacacgagatctactttttaagcaaatttttaggtgtagggtacattattttggttataggtacaacactatatagcaggtccctaaagcttatttatattgctaaactgaaatattatgccagttgattagtaactctcatatcccatctcccctaagcccctggaaaaaaccatttcaggctctgattctattaatttggctattttagatacctcatataagtgaagtcatgcagtagttgtgtttctgtgactggcttattttatttagcatagtgtcctcaaggttcgctcatgttgctgactattgcagaatccttcttttagagaccaaatcgtattccactgtgtgtctttcccatattttcttaatctgtcattagacaattaagttgtttccaacatcttggctatagtgaataatactgcaatgaacttaggaatactaatacctcctcgagatcctcatttttattatttaggataaatatctagaaatgggattgttggatcgtaaagtagtttcatttttagattttttgaggaaccttcataatattttccatagtggctggcaccattttgcgttcccaccaatagcatgtaagagtttctatttctccatattcttgccaacacctttttttaataaataataaccctcctgacaggtatgaagtaatatattattgagatttttatttgcatttccttgaagattagttatgttaaccatttctttatatacctgttgtccatttgtatgccttttttatagaaatgcctattcaagacctttgactgttttttatcagtcatttgctattgaggtgtagaggttccctatgtcttttggatattgatctattattagatgtatggcttgaaaatattttctcccattccatagcttgccatttcaccctgttgattgtacagaagcttttaagttggatgtattcctgcttgtttatttttgctttcgtcacctatgcctttggtgtcatgtccatgaaatcattgtgaataccaacgttataaagctttcttctcttttttttatttccttctggaagttttacagtttcaggtctggcgtttaagcttttaatccattttgagttgatttttgtgtaggctgtaagataagggtctaatttcattttttgcttctggatatccaattttctaaataccgtttgtcaaggagactatcctctcccctttgtgcattcctggtacccctccaccactgtccacacctttttgttgccctgtcttatggtgtggacctgttaccgtttcatagatttatttctggtctctctattctcttccattgttctatatgtctctgtttgtgccagtaccatacagttttgattattgtactttggtaatatatatttgaaatgaggaggtctgatgccttcagttttttattcttttgcaaaactgatttgactattcaagttatttttggtttcatgtgaatagtagaaatttttttttctatttacaatccatgaacagaggctgttcttccatttgtttgtatctttaatttctttcattattgttttatagttttcagtatacaagtctgtcacctccttagttaaattatttctaagtattttattctttatgagattattttaaattagattgttttctgagtatccttttcagatagttcgttgttagtgtatatagaaacacaattgatttttgtatgttgattttgtatcctgaaactttattgaatttattagttccaacagtttttttgataaagtctttaggattttctatatatgagattgtgtcatctgccagcagacactattttacctattttttttttttttttcattttggaggccttttgtttttctttcctaaactgctctggccaggactagcagtactatgctgaataggagtgggaagtgaacatccttggcttattcctgatcttggaggaaaagttctcagtttttttttttttccagacagtatgatgttagctgtggtcttttgatatatggcctttataatgttgaaacatttttcttcttctattcctaatatattgaggatttttttttaagaaaaggcatttaattttgtcaaatgctttttctgcatctactgaaattatcatgtgatcatgtgatcttaatccattattctgttaatgtggtgtatcaaaataattgatttttgtatattgaactatctttctgtcccaggaataaatccgacttggacattgtgtgtgatccttttaacattttaatgtgctgttggatttagtttgctagtattttgttgaggatttttgtacatgtattcatcagaaatattgatctctagttttttttcttgtgatgtatttttctggctttggtatcagggaatattgcctttacaaaattaatttggaaatttttttgtttgtttttggttttgttttgttttgtttcaatttgcgggggttggtgggaagagtttgagaaggatagaaattaattcttatttaaacgtttggtagaattcaccagtgaagtcatctggtcatgggcttttctttgttgggagattttaaaatactgcttaaatggccatattaataatgagtctgttcaggctttctatttctcatgatttagtcttggtagactgtatatttctataaatgtgtccactttttttcctaagttatccagcttgtaatcatataattgttcaatatagtctcttatgtctcttatttctgtagcattattctttcttttctgattttatttattttagtcttatctcatttttcttggaatagctaagggaatctcaattgtgttgagattttcaagaaaccaactctagttttattttttaattgtttttctattttctattatgtttttatattttctttaatcttatttccttccttctgctaactgtgagcttctttgttcttctagttcgttgaaggagaaagttaggttatttacttgagacatttttcctttttatgtaggtgtttattgctatgaacttcttacatagtcctgttttttctgtttcccatgcattttggcatatcgtgtttttgtttcatcttgaggtgttttctatttctcttttttattggtatgtaatagttgtacatatttatggagtacaagggatattttgatacacgcatacaatatgtaattatcaaataagagtaactggaatattcattatatcaaacatttgtcatttctttgtgtagtacattttaaatattctcttctagctattttgaaatataaaataaattcttattaactatcatcactctactgtgctattgaacaatagaatttgtgccttctgtataactgtatttttgtaccctcttcatcccattggaatgctgcaattcccagtatctagtaactaccatttgactcactacctccatgagatcaattttttgttagcccccatatataagtgaaaacttgcaatatttgtctttctgtggttggcttatttcacgtaacataatgtcctctagctccaccaatgttactgtaaatgacatgattttatgtttttcctccccgtggctgaataacattccattgtgtatatatagcacattttctttatccactcatcaaatgatggttgattgaataccttcgttattgtgaatagggctgcaataaacatgcacgtgcagctatctctttgatatactaattttctttcttttggataaatacccggcaatggtaatgctggatcatatggtagttgtatttttagcttttaagggaaactccatactattttatatagttgctgcattaattaacattcacaccaacagtgcatgagcattccctcttttttttgcatctttctcagcatgttattttctgtctttctgatagccattttaactggcgtgagataatatctcgttgtggttttgattcgcatttccctgattattagtaatgttaagcatttttttcatttacctggtagccatttgtatgtcttattttgaaaaatgcctattcaaagcatttgctcattattaattggattatttgtgggtttctttttgttttagtttgttttgttgtgtttttttgctattgagttgttttagttccttatatattctggttattagtcccttgtcagatgggcagttagcaaatattttctcccattctgtaggttatctcttcactctgttgattgtttactttgctttacagaagctgtttagtttgatataatcacattcgtttagttttgcttgtgttgcctgtattttgaggtcttatgcaaaaaatatttgccagaactaatgtcctgaagtatttcccaatgttttcttctggtagtttcatagattaaggacttacatttaggtcttaacctattttgattttagttttgtgtatggtgagagataggggtctagttttattcttctacgtatggatatccaatttctgcagcacaatttattgaagtcctttcacagtgtatctgttaaaaatgagttggctgtagatgtatggatttatttctgagttatttttcctcttccattcgtctgtgtgtctatttttatgtcagtatcacactgtcttgattactgtagctttgcagtatattttaaagccagatagcttgatgccactaagctatctttattctttttgctcccaaattgctttagttattcacgttcttttctgatcctataggaattttagaatttttaaaaaattttctctgaagagtggcattggtacttttttttaaataaaaaaatgaactctggcaagttttactaaataaaaattttgcattgtttacttttcaccagactattctggcatgcttctaatgatatcagaatcacccggattaatgatagccagtatgcattgtatgtagtatatttcacatgctgtacccaattcagtgttattgccactgtagtggtggatagcagttttggccaacaatacttagtactctaattcagatttcttcaaagtcaggcagtttctaaaaaggatgatgaattttgctttgccttgtctgatcatcttcagagttggcttgtaccttagcatatttttaatatgttgttgtgttcagtttgctagtatttggttgaggctctttgcatctatgttcatctgagatattggcctatactttccacttttcataatgagttggactccagagttaattgactccagtgaggttttcatcttctttgtggcccccatcttcctgccttaggtgcaggacaggccccactcaagagcacccaccaagatggccaaggagcaagaaaatggcattggtactttggaagaaattactctgaatttgtaaatgactttgggtagtaaggaccttataaaaatattaattcttccaatctatgaacacttaaatgtctttccatttttcttgtgtcctattgttttaatagtgttttataaatttcattgtagagagatttcactcctttagttaaatttatttctaggtattttatatattttgtagctattgtaaatgggatttatttcatgattttttttcagatggtttgttattcgtatataaaaatgctactgagttttgtatgttgattttgtatcctgccacattactgagtttatttataagttctaacaacattttggttgaatcttttaggtttctctaaatataagatcatgtcatctgcacacaaggacaatattacttcttcctaatttcgatgcctttttgtttctttctctcatttaattgatctgggcaggacttttagtactatgatgaataaaagttataaaagtggtcattcttggccttgtcttgttccagatcttagaaaaaaggctgtcgacatttccctgtttaggatgatgttagctgtgggtttgttgtatatggcctttgttatttttagatatattccttccataaccagtttgttgagagttgttatcattaagggatgctgaattttgttgactgctttttttttagcatttgttgcaatgcttcatatagtttatgtccatgattctgctaatgagatgtatcctgttcactgatttgaatatgttgaatgatagttgcatcccagggatgtatcccacttgatcacagtaaatgatctttttaatgtgttattgtgttcaatttgctagtatttggttgaggctctttgttttcttttcatgctgtgtctttggttttggtatcagagtaaattggcctcatagaatgagtttggaagggtacttccttttcagttttttgaaatagtgtgattagaattggtattaggtcttctctaaatgtttggtagaattcatcagtgaatccattcgttcctgagttttttattgatgggggactttttttttttactactttgaactcattacttgttattggtctgctcaagttttctatttcttcatggatcaattttggtagatttatgtgtctagaaattcatgtacttctaagttttcccattggtttgtatattcttcttcataatagtctctaataattccttgtgtttctgtggtatcagttttaatgtctcattttttggctgtgatttttacctgaggcttctctcttttctcttaatctagctaagaaaaaattgttaatttagtttatcttttcaaaaagagagttttcattttatcctttgtatcttttttcactctcaattttttttcctgttctgatctttataatttctttccttctactaatttggggtttgatttgtcattgttttctagttctttgaggagcatcagattgttaatttgaagacgttctacttctttgtataggtgtttcctgctataaattagtactgctgttgttgtatattttaggttttatttggggtgttttgtttacatttccttttttcaagaaatctttttttttattttattattattatactttaagttttagggtacatgtgcacaatgtgcaggttagttacgtatgtatacatgtgccatgctggtgtgctgcacccattatctcgtcatttagcattaggtatatctcctaatgctatccctcccccttccccctaccccaaaatggtccctagaatgtgatgttccccttcctgtgtccaagtgttctcattgttcaattcccacctacgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgccgcaataaacatacgcatgcgtgtgtctttatagcagcatgaattatagtcctttgggtatatacccagtaatgggatggctgggtcaagtggtatttctagttctagatccctgaggaattgctacactgacttccacaatggttgaactagtttacagtcccaccaacagtgtaaaagtgttcctatttctccacatcctctccagcacttgtttcctgactttttaatgattgccattctaactggtgtgagatggtatctcattgtggttttgatttgcatttctctgatggccagtgatggtgagcattttttcatgtggtttttggctgcataagtgtcctcttttgagaagtatctgctcatgtcctttgcccactttttgatggggttgtttagtttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatgctaatgcctaagttttcttctagggtttttatggttttaggtctaacatttaagtctttaatccatcttgaattaatttttgtataaggtgtaaggaagggatccagtttcagctttcgacatatggctagccagttttcccagcaccatttattaaatagggaatcctttccccattgcttgtttttctcaggtttgtcaaagatcagatagttgtaggtatgtggcattatttctgagggctctgttctgttccattgatctatatctctgttttgttaccagtaccatgctgttttggtcactgtagccttgtagtatagtttgaagtcaagtagcatgatacctccagctttgttcttttggcttaggatcgacttggcgatgcgggctcttttttggttccatatgaactttaaagtagttttttccaattctgtgaagaaagtcattggtagcttgatggggatggcattgaatctataaattaccttgggcactatggccattttcacaatatttattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgctcgtgatttttgtacactgattttgtatcctgagactttgccgaagttgcttatcagcttaaggagatttggggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatattggctgtgggtttgtcatagacagctcttattattttgagatatgtcccatcaatacctaatttattgagagtttttagcatgaagggttgttgaattttgtcaaaggccttttctgcatctattgagataatcatgtggtttttttctttggttccgtttatatgctggattacatttattgatttgcatatattgaaccagccttgcatcccagggatgaagcccacttgatcatggtggataaactttttgatgtgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccaattcctccttgtacctctggtagaatttagctgtgaatccatctggtcctggactctttttagttggtaagctattgatttttgccacaatttcagagcctgtaattggtctattcagagattcaacttcttcctggtttagtcttgggagagtgtatgtgtcgaggaatttatccatttcttctagattttctagtttatttgctagtttatttaggtgtttgtagtattctctgatggtagtttgtatttctgtgggattggtggtgatatcccctttatcattttttattgtgtctgtttgattcttctctcttttcttctttattagtcttgctagtggtctatcaattttgttgatcctttcaaaaaaccagctcctggattcattaattttttgaagacttttttgtgtctctatttccttcagttgtgctctgattttagttatttcttgccttctgctagcttttgaatgtgttcactcttgcttttctagttcttttaattgtgatgttagggtgtcaattttttatctttcctgctttctctttcaagaaatcttttaatttccttcttaatttcttcactgacccattggttgttcaggagcatgtcatttaatttccatgttatttgtacaatttctaatgtttcttttgtctttgatttctggttttattccattatagtcagaaaagatgattcaaatattgtggaatttgtcaagacttgttttgtggcataacctatgctctatctcagagaatgttcctggtgctaatgagaagtatgtatactctgcagcagctggatacaatcttttgtaaatgtcaagtaggtccatttggtgtgcagtgtagttttattccaatgtttctttgctgattttctgtctggatgatctatctattgctgattgtggagtgttgaagtcccccactattattgtactgttctttctctctccctttagctgtattaatatctgctgtaaatatttggatgctttgatattgggtacatatatatatatttatgattgttatatcctcttgataaatggaccccttcattattacataatgaattcctttgtatcttttcagttttttgacttgccatctattttatctaagtatagctactcttgctctttttttggtttccgtttgcataaaatacatgtttcattccttcacattcagtatatgcatgtccttatagatgagtatgttccttgtaagcagcatatatttgggtcttattttttcgttcattcagccactttgtttttcaattgaaaattgagtcaatttacattcaatgccattattgatagataaggacttacaaatgtcattttgttacttttttttctggttattttataactcctctttttctttcttcttcacttcctttgtggttaagtgattttcttaaccacaaagttagtatgtttgaatcccttgctttttatttttactttctctattataagtctatgttttgtgattactgtatggcttacaaagaaaatcttttagttgtacaagttattttaaactaatggctacttaaggttagtggcagagaaaagcacagaaacaaacaaagaaatatctataaagccctgcattttgatttcatactcctccccatatttaggctttttgttgtatcaacttatatctttccatattgtctatctcctaagaaactgttatagttgttatttttgatagatgtgtcttttcttcttcagactaaagacacaagtgttacacaccacaattacagtattagaatattctgaatttgtctgtgaacttaattttaccagtgagttttatactttcagatgatttcttgctgtatattaacatcctttttttttcagatggaaggactcttattagcatttcttgtaaaacagttatgatgatgaagactcttaactttgtttgtgaaagtttttatttctccttcatgtttgaaaggcagtttttctcactactatattcttggttagaaatttttttgcctttagcactttgaatattccatgacactctctcatagcttgctgagaagtctactgccaaatgtatcatagctcattgatatgttatttgctttgcttttgctgtttgtagaatcctctttgtccttgacatttgagagtttgattattaaatgccctgggatagtgttattttgattgactctgctttgtgatctttgacctttttatacctggatattcatatttttctctaaatttggaatgttctctgttatcatttctttgaatatattttgtatccctacctctcactccttctttaagtccaatgacacttagatttgccttcttgaagccattttctaaatctcgtaagccttctttattcttcttaatcctttgactgtgtattttcaaataacctatcttccatgtcatgaattctttcttctgcttaatcaattctgctgttgagacactctaatgcatttttgcattcatcagttcatcaattgtatttttcatctctaggtttctgtttgattttttaaattatttatatttatatatataatttatctaataaacttctaaactgattatctgagtttcttgaagttcactgagcttcctcaaattagctattttgaatgcaccaaaaggttgcatatctcgggcactccaaggttaatcactggcgccttagttagtctgtttgcttagatcatattttcttgaatgttcttgaggcttgtggacatgtgtcaatcaatgtctgggcatttcagagttagttatttattccagttttcacaatctggccttgttagtacccatccttcttcagagaacatttcaaaaattcaaataggatttattattgagttccccaagcttgtagtcactgcagctgttttagtactagagagtattctaagtccaactgcactgcaaccatctagtggacttctatgtacttatttctgatggacttttgggagatcatggaaaatttcttgggttgccaggatgatccttcactcactttcgtctctttacctcaaacaggagtctcttcatactcagctgcctggagtttgggaaggggttacatggccattcctgtggctgttgtaactggcacccaaagcctgcaaccttccagaccagcacagcactgaggctcacccaatgcccataatcatggcctgactgctgctgatgtttattgatagcctcaggcctctttaagcagctggtagtgaagccagctcagatttgggtttgttccatcctgccagggtagcagatttccttctagcatggggtggatctagaagaattgatgggagcagtggcctgaaatcaggggctttggggatctgccgcatgctgtgttgtgctgtggtggcactgtactagtttccaaggcaaagtcccccgtactcttccctctccttccctcaagtggaagatgtctctctgtttgtctctgcactgtgctaggggaggggtaactgtgttaggggaggggtgacataggcacttctgtggcccccgcagctgatgtcacactgggttgcatcataagcccacagccttccaggtcattgcagcactggggctcacccaaagaccatggtcactacagaattgctgccactgaaatttatttgaggcccaagaccatttcagtcagctagggcttaagcccttctgccgtggctgtggctacagatttctatcttgcctggtgtaagaataagtattccctctgtgggtattggctcggagtcaagggctttggaattctgcccaatgctgtgttacattgtggtaggatcaacacggacttctaatgcaaagtcccaactgagttttatatattcttgtgttgtacgtttgctgtgtagaatcctttcatttcaaattgaagaactttcttggcatttctcctaaggcatgtctaatggtgatgagctccttcagcttttgtttgggagtctttttccaaccttcatttttgaaagacagtttgaccgtgtatggtggcaggctattttttctttccacattttaaatataccatcactctcctttatggtctgcaaagtttctgctgaaatagctactcttatggagcttcccttatatgtgacaagttgttcttctctttctgctttcaaaatgttttctttgtctttgatgactattgacaatttgcttgtaatgtgtctcagtatggatttatttaggttactcttatttggtgttctttggacttcttgggtctggatgttcatttcattctccaggtttgggaaaattttagctattatttatttgagtaaactgtcctgtttttctttttctcttatccttctgacactctcataatgtaaatattggtccctaaattgtgagccttaaggtttcttcacttttttcattattttgttctttttgctcttttgactgaattatttttaatgatgtgtccttgagttgctggtccttttattagcttgatctagtctgctgctggacctcgctagttatttttcactttagttattgtgttcttcagccgcatgatttctgtttggtactttcttatattttctatctgtttgttggaattctcattttgttcatgcatgattctcttgagctttctgagcatctttatgatagttatttttatttgtctgtcagataaattatatagcttcattttattaaggctgctgtctggagatttatcttattcctttgtttgaattatttttttctgattcttaattttccttgatgctctgcattggcatatgtgtattatccaattatacacactgcatcccgtcttcccagactctgcttgtaccagagaagaccaccatcaaccagcctggccagagattctagagtctctaccaacaactctttccctttacaaggagaaacagacagctggatttttgttggtttgtttttttgaggcagagtcttgctctgtcatccaggctggagtgcagcggcatgcttacagctcacggcagtctgaacctcccaggctcaaactgatccttctgcctcagccttctgagtagctgagactacagacatgcaccactctgctggctaatttttgtactttttgtagggttgtggttttgccatgatgttcaggctggtctcaaactcctgaactcggcctttcaaatattcaaagtgctaggattataggtgtgagccactgtaccgcattaactgtgctttttgtgtatttgctctgtgctgacccactgggggaaactatgacactaccagtccaaaccactatttccattatcccttatttgtggcagaccagttagagttctaagactggcaaatagttgccagttctttaggcaatcccggcaaagttggggcattggatgcttagatcaactctttttcttctcagagagaagctgagagctgattttgtttgtttatttgttgtttttttgtggttgctgttgttgctcatgttatgctgagcagcaaagaagacttgggacatctgagcagcagggaagcttgaagctaggggcatcaattgcccctagcttccatctctgttttccccagctggtgtactgcgctggtcccatcagagatccaagactggcaagacagaagccagacctttgtggagtcctcttggaatggttggggtgctacatgtgcaaaccaaggcctttctcctctgggagaagctgggagctaggagtgaatcgcttcctgattatatgtcactgtgccagtggtgaggagtctggcgagagggtgttctggatctctctgctagttttggtcagtctggtttcacattcacctgggctgcaggagcctttcacttagtttctggatttctcataaaggaaatttgtcgatgatttgttcctgaatttgtgtttttttggggtagagtgtacaggactttctactttgccattgtgctgatgtcacttgtcatgttctttttattggaattatttcctaaattaaagtgctccttggtattcaatttatcactggcatcacgacatctttgttagtaacaggtttttttttcctaattacttgctagcatgttatgaagaatgggatattttgattgagaatttactgtgtttgaatcctggtttactgtgtttaaatcctggtatatgttgggactttagacctaagagtgtataactagttattttaagatattattacttggttttttttaatgaataaattgcctacaatctttaagatgataaatcattagaatagatgtttggattggctacatgatttttaaatttttagtacttatattaaggagtatgtataaactgctaataatatctgcacactaattacaaaaaaactcaattaaaatttttttaaaaagtggtgatgaacttgcaacttgcatacagtgtattagttaatgtacatgaggaccatagtgttatcactgatgatgtgaaaaccagaagacacaaatatgttttaaaaagcaggaccttgtatttaggtcagatgaatactatacgaatttcatcactttgtattctaaattctcttctgagaaagtatgaagagtgttaatatgccagctcccttagcagaacttcacaaatagttgaataaatctatttttatgtgagtcacatcaattgcttcaaataatcagtaacattgattgcctcaaatacttaaattccaatgcaagttttatttttgtattcatttcatgaagtcaaaataaagtctttgaaagttgattgtgttaaagataaacatatattatacattcagttaaaaattaatattttattagttttaaatttactgagacttgttttactgagaaaaccatagcccaacatgtttttttaaaaaaaataccttgtgcacctacctaaaaaaaagtatattaccattgtttttgaagtgttttataaatatcaattttgttgatagtgttaattattcaatatcattacttcacttattttatcaactactcaagaaaagtgttaaaatgccccactgcagtttcacatttgtctatttattctttttatctcttacttttattttttgcctcatgtgttttgaagatatgttatgagctgcatacattttggatgctatgggttttttttgacccttttttgacccttttattgatatgaaatctgtctctttttctctggtaattttccttgtgttaaagtttactttttctatatatatatcatatgatgccttttagcatctttttacttttaagttatcagtgtctttatatttaaagtagactactagtaaatagcttatggttgcatcttgattttttattgtttgaaaatctctctcccttagttggagtcttttaaccattagactacttatatttaatataattattcacttggttaaagtttgtctaccatattgctattttttttattgaatccacctgttaattgttacttttttcttaccatcatttttttctcttctattagcttattagctatacctcttttgggaggaaagaaagcatttgctctaactcttgtaacgtgtatctttggcttatgaaaacctgtcattatgtcaaatagacaaacctatcattaaataatattataccacctcacatataatgtaagaaccctctaatagtgtatttccatttccttcttcagttctttggggcatgttttcatttatcttacttttacatatgttataaacatcacaacccttttaaaaaaactttaagcaaaaaaattatcttttaaatatttaaagtgagcaaaggccacaaattaaaatttaatattaaagataaaattatttattttgtgataaaatacaaatgtaaattttggtggtacataaccttataataaaagcaaagctcttataaaattaaaaaacagaaatgtactaggaattggttgttgtatacacaaaattcataattgcaaccaataaaattgtaataattacccatcacaataaaactgttgttaaaatatacaaatatttttatatgcagttgaaataattgaactaagtggtgtgtgtttgtgggttgtgggtgtggttgtgtgagagagagagagagacaaagtaaagctgattcaaaaaataaataaaagaacatagtatgccagtaccatgttctctttttccagatcattgtcaataagtcctagaaaggtttgggtttttgaagtactattttgcaaataaactaaaatgccctactatgatattgaatgattttgaaaataaaacgtttacattttgatagctattcattaaaatccactgaatatcttaaaatattcagttagtacagtgctaaaaatcttcagtttttacaattttaagtaaatagcaattattgaaaacaataactgaaattgaaacaataacaataattgaaagcaattattgaaaacaataaacaggaagacacttaagtgtgatttctttagaagaatgaaagttcaaacactgtacaatattaaaatttgaaactttagtattttagtatgccttgacttgttaaagggtctttatatatatatttatatatataaaatatatatacatatataaaatatatatatttatatatataaaaaacaaaaactatatatataaagaccctgtatatatatatatatattttttatatgtgtgtgtatatatatatatacatatatatatacacacacatataaatatatatatatatatatatgtatatatatggtttttggggtttttttgggaggacggagtctcgctctgtcgctcaggctggagtgcagtggcgagatcttggctccaggcatgttccacctcctgggttcacgccattctcctgcctcagcctcccaagtagctgggactacaggtgcccgccaccacgcctggctaatttttttgtatttttagtagagacggggtttcaccatgttagccaggatggtctcgatttcctgacctcgtgatccgcccgcctcggtccaccatagtgctgggattacaggcgtgagccactgctcccggccttttgatagttatttttaattggattaaacttctactttattctgggatagaataaagttaagaaaatgtatatttaatataaatcatatataaataaaattttatatataaaatttattttgtatataattatacagcttgtagataaatatttcaaaacataatttaagaaaacttgtttgacaagtttcatattataaaagtgtgtcaaaaatgtattctgaaaagaagttaaaattcagtacatgtgaaaatatttgagctgaaatgtttacgtactgcttaatgaaaataaaaataaaattgaaatttttcttcatttcaaagaattaaacctgagcttaccaggtagctaacacttacaaagaggaaattttctcaattaaaaatagtatggcttatgatgatatcagtcgagctaccgacagtttaaaatatataaaaatgtttctggcaatactaataaaaataagaatatattgaaaaaacacattctttagaaaaaatagtaaaaagggcattaaatgtggctaagaaaccaattaaagaatgaacatgtgtaacagaaatgattattttgcacgttattttaatattcagataattcatataaagaagatgctttttgtacacagatgtcattttaattttttagaaattattttatttttaaaatagattttgtataactattgtgagacatacatcaatataatatcaattatgttactcaatacatattttaattatataattttatttacttttagcttcttgtttcatgcttaataattttttcagtttcaataacaaagtcatcagattttgatacacatgttattattttaaaactatgttcacatctactattcctcttagcctgtgttccttgaagggtaaggatatcatcctgttgatatttgtgtccccataacttggcacggtacctggtacttggtacttagtaaatatttaacgaatctgattgaatgggtaaatcttctaataatgtaaaactaaaaacatacaaatactgtatagtgtcagtcagaagtaatgtgaaaccatttttacataatttttatttcttttttttttttacttactaatactggtcatccccatatactagaattctatttcaaatcaactcatattttctgtaatctttggatgtaaaatgagtttcttgtacagatccttttgatagtcttcaacctaacaagcctttgattccacaaaaattatatcattgactgtatatgatatgatatgatatgatacaatgccaacaacttttgtaggcatactggagcataagaatctatgaaagcagggctgtgttgtttctgttaatatctccaacatcaagcataatacctggctcaataattatttggtgtaataaatgcatatgcatttttaaaaaagagatttctatatacttggaagtatattacaacactggctttgaggtttcttttccataccatgcattaagcagctttgtttctttcctaggttgtttagaatgtgtctgtcatgctgccatcaactttaacctgacttgccatatcattagatgtatccttagtaacataatgaaattctaaagatagccacatttctgagtagctggcagagtgtgggcctaataatgatgttgaacattctttataaaattgatggatcatgtacaaagcaagggctcaatcaagggcaaaattctccagggtgaaatccacctctaggttaccatctgcatttcaaatattttctaattgatttgactctggatgagatttttctcacaggttaagtattcccattacccatcttgattttcttatagatagggaagtggagaatacagtgtcattttttagccaatacaaaaatataaggcaataaagctgaaagagagggatgtgagaaactgtgaataccaaatttggcccatgaccttgctaagtctcctgacacatggcaaaaaatataaaattactgcttagaaaacctatacagagcatattaaagtgtacttgtgttttttcatttcagaattgtattttcataggattatgaatataattgttagaataaaaatttaatattttgtctgattctaaataaagcagatgaaatattcctaggccagttttacagataaggcaggaaagattcagggaactaatacaagggattaatatcttttcttaatacggtacactaagtctaagtctcctgcttctgatatcattactcatccaactgtatgagatccaagatttttcttctttgaaaggtcttgaaataaacaagtttataccaaaaagtcgattttctgaacataaaggacacataagaacttaagagtgatttcagtgtatttattctttgttataccaagcaaagcagtaagaaaaccggcgtgttttcttttgctcttgtcaccacaatggtaattcaacttatctctgacttcaagtaatcatccatatttcagttgaaaactacatatgcaccagctcggcttgtgaaatctatattaagtgaagtgcatatttccagtgaaattatactcccaactagatggaagcaaagataaaataagtgagaagtatattgacagtagcaataatgagaactcagttatattttgcagtagttagagccatctggttattttctgaacaaaccctaggttattcataacagagtaaagcgattaaaatgtaatgtaaatattgttatggcacacttgaaataaacatctcctggcttcaaaataatatcatattataaataaaccttcagcatacactgaaatgacaaatgacagttttgttcattcatttattcattcattcattcatttgtttttaactataataagaagttctcttcaaattcttgtactgatggacaatttatttcttcctagggcatagcaaagctagatttgataaggacgtgttacttaatgacgaatgctatgaactctttcagtggatttagatcagtgaagaagattgatggcattgtaaaaacaatttctaagtaatatatgctttctcagataagcatacattcttttacaatgaattcaaagagattccttatatataattagaataaaacaacatatcttgaaaaattgtttcttctacgtataagcagttagaaaattgcattacttttacatgtctatcttttttcacattcggggtaatgagaattttagccatgggtacagttatttgtttttagtggaatagaaacagttctattttgaaagtaaaaatttgtcatagcaaatgtatttctaatttattataacaaccagatagaaaaactcattttattagaaataaatggtagcatacaaagtaaaatcactggcataaaaagtagtgtaaaaattagaagattttatatttttgctaatgttcactctatttcttatgtcaacgatttttaccttctattttgaacaatttctaaaacatatttttatatggttattataataaattagaagtacatttacaatgacatcaattgtctaggaaaaatttatataggtgaaattttatacttattttttacatttttactttctaaatcagaagattaaaaggttttataattttacaatattttggacatagtaagttaaggaacctaccagatatctaagtacagaagttaaataggcacttgaagagaatggttaagagctcagaaaaaagttgaggctggatatacaaatttcaggggcatcaagctaaaaataatacttaaacttatgaagttatttagtgagaaattgtggaaagaagggacaagagcattaaggactaattcctaaggtactccagccctcagtcattaggttatcaagtaacaaaagcaaaagataccaaaagagagcagcaaataagccagaaagaaaaccagactaggctgatgaatcggaggccaaaaaacaaaacaacaaaataaaaaacagtgcttgaagaaggaaggaatagtcagctttaataaatgttgctgaaaggtttttgaaagaaaccataaaagttaccactggatatggcagcctggatttaaaaacagtggaatagaggaaagactgacgataaaactggagacaattgtatagaaacttctctcaggagatatatttaatagattttctattaaagaaagcagagaaatgggaaagcagctgaaagaggatggggatattataaagttttgtttgtttatttaaaatggaagatagaagccacaattacatgctgttgagaatgatccagtatagtactgtacatgcgactgagaatgatccaatgtgctagtgatgcagaggagatgaagaacatttaggagtaagtccttaacagtgtttaatactagcaacacaagaactagggttggctttttacagaacaaggccaacttctccattttaaaagacaaggaaacaaaatatggatgtaaataccagtgaggtgatggatttgatggtgttaagaagagagtgcttctatctattgctttaccctctcaaaaaattataaagaaggaaataaaacaaaataagggatgagaaggagaaacagtgaaaaagcagttggagtggaaatgttcttcatattgtagttactttaaaatgttatttgacatatatttggcatatatatggctaaacttggatatgtatatgaataaattttatttctattatttttaataaccacaaatataaccttgcctctttcttttctgctttccattatagtaaaaatgtaggcagcaacatatttttatgtgtaataaatggatacaaattgttctatatttcttgcctttccatttcaaattggtcgaattttttttggtcaattctttcatcaatagacagctgtcagagttccactagtaggatatggctttatgttatttctggtaatgggataggtttgtgctgagacaacacactataatggttaagagccctgctggttgagttcaaattccagctctgctaagaacatgcatttaagatctctgagatcttaagatctcattttacccatttaaaaatggggatgaaaataccactttgtaaggattctgtgttttagcttgagtgtaaactgagctgctagtcaagtgctttgcatgctatatgctctaaatacagagagtaattattgctattatcattattttattggtctctattctgaattaattgcctttttaaagtttctctttcttagctggtctttattcaatttgatatataacaatagaaccctatttaataaggctttaatgttgacatcggtgcaaatatttttaaagaaattaatacatttaagatgttataaatatgtaggtttttggactactttagtgaaaataataggtggataactgctcgtctgattttaaaatgacacttaaagattaatagcatgtttcagagacttccatttaaataaccatatcgttgagttttacgctctattcaacacttaagcacattttattacaaaggctttatgacttttatttcaaaaatgtcccttggatatggtcttatacctgcatttgttctttaactgtccctaagtaattgtatgatgttgggaaagcaccttagcctttttaagcctcgattttctcaatggaaaaatatggataataatagcactcagacttcctgtgaatcgagaggcagctcatagcatggtgttttaaatgtagaaagtgctcaacaagtattacatattagcattattagctattgacatatgcttctatttgtatactttttctgtgtgactattattatttctaatgagtgttaagctaatttaaggagtacagtctacatctgtgtaacagactagtcactggataattcctagactaaccaaaatgaaattggccagcacttttgaggcaaagaaaacaagaaagggaagtaatcttttattgacaatttcatgggattttacaggtcaaactcgaattatattttgatgttataacatataagcctattattcactttcaagtatgttccttttatgatattattacgagtgagacaacaaggttgttaagaccctttatctttgttggaatttctgcttactttgcatatttatgttaaggaaaaggaggcatgaatggcagacttaaaatctaataaaacaaagatgtgttttattagtcgaacatcactctccacttataaaaccaatccataggtgatatggtttggctctgtgtcaccacccaaatctcatctctaattgtaatctgtgtcaccacccaaatctcatctctaattgtaatccccacatgtcagtggaggggcttggtgggaggtgattgaatcacaggagcggacttctcccttgctcttctcttgatagagagtgtgttctcatgagatctggttatttgaaagtgtgtggcactttccccttcactctctctctccttctctgccatggtaagatgtagttgcctcccctttgccttctgccatgattgtaagtttcctgaggcctcctagccatgcttcctactaagcctacagaactgtgagtcaattaaacctcttttcttcataaattacccattcccaggtagttatttatagcagtgtgttaacagactaatacaatatatcaattttagtttgggtagaaaccattccagagcaaatcaagaaaaatttaatgagtaagtttccctctctctctctctctctctctctctcacacacacacacacacacacaccattttttataaaagatctctatccatagtggaagactataattcctcagattctttgatgcatgatgctccatttagtgctctgctgagaaacactgatggatattacaaaacaaattcacttataaatttagtgcagacggacagtcatggctcactgtagccttgacctcctaggctcaagctgtcctctcaactcagcctctcaagtagctgggactgcaggcatgcaccaccatgctgggctaatttttttttttttaattttttctagagacagagtctcacttagttgcccaggctggtctcaaactcctgggatttagaaatcctcttgccttgatgtcccaaagtgctgggattacaggtgtgagccactatgcctggcctctaattttaaaatgttgccacttcaagaatgttatataaaagaatgaaactatataatattttgatattgtattgttttcacttagcacaatttccttcaaattcatccaagtcatatatatgaatcattcttttttattactgagtaatattccattgcatggatttaccatcgtttaaacatttacctgttgaatgacatttgggttgttcctagttattagcaattatggataaagttgttatgaatatctgtgtgcaggctttcatgtgaatataagttttattttcttttggataaatgttcaagagtgcaattgctgtggtatatagtaagtgaatggttagtttcgtaagaaagtgccataatcctttccagagtggttttaccactttacattcccaccagcaatgcatgaatgatcccgttttctccataattaccagcatttattgttatcatatattttttaaaaaattgagccaatttgaaatgtatgtagtagtatctcattgtggttttaatttgcatttctctattagttagtgatgttcaacatcttttcatgtgttttctgatatcgttttcattaaaatgtctttgctcattttgtaactggattgattgctaattttcttcctttttttttgagtttcgagagttgtttatatattctagctacaagtcctctgcggatatgttcctaacaaatatattttcccagtatgaagctttcttttcataatcttcagtgtctttcacaatacatttaataatgttgagtaaatctagtatttggtaactaaaatactatgccactttttcaaataagttagcacataaattatttaaaatatggagaaagtgtttattgtatagcatttaaaaattgaccccaaaattttaaaaattaattttctaaaacacagggatatatgaaattgattttggtagttatcaaaactaaaattttgtctctgtcttttgataggttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtataggtatgaattaaagaacaattaaaattttatataaacataaaacaatggttaaaaactggtattgttcttaagaaccatattctagactagattctatatgagagtctaagatttcagaggattattaacctccgcagaatgtacaaaattgtaaaatgattattatttttccatggggtaaaggctgatgatttcattaattttttcaatgcttctaagattctaaaacagttatgaatcaaagctcttggaaaattatatcaccctttatttactatgtagccatagttatccattgcttaaagagtggattcagaccccatattaaaatgggtcatattgatcttgtctctaaaatggttatttcatttaagaaagaaaatattgtcagaacctatgtcagaatttccaagctttgtctttctatttaattcatgtaatccaaaggaatattggtttttatttggaagatctaagaagctgtagcgcctggatcatacttccagctgtcttttgtctccgtgctctgttattgaatctccaagttagactctagaaaattaaaacaaattatgatttggtctgagaaagacttagaggaatgtcccgcttttggaataaaaatagttagaaaatatgctatatcattaaactagtttaatcttaaacttttttgttctgttcaggtgctttagtatttgtgtcatcttgaatttacgacacattttgaacaaactatgttttctctactgaaaattttatttatttacatactctctcttaccacactgtaagcaacttgggagaagattccataacttgttcatcattgtgtttcttatagcatttggtacatgcaaatgtatcaagttttagagggagaatcttatttttgttcacttacacctaacccataaacttcacagtgacttattttgaaagtcccatggaaataggaaaagagtgttagttcttcagttagaagtgaacaaactcaatcaattattcagatttattttaccccatcttgtaactcccacacaaaattacaaaatcaaattcattagtcattaactgtgtctcaggcactgttctaaacagtgggaaattagcaataaaacaagacagaaaagtactctgttcctatgaacttactttgcagtgaaataataaaaaaaaaagttttacaacacattttctctattttataaagttggatttaagaaaacactaaatgcaccaaacaacataaaaaggcccaaaccagccaggcagtagacggacagttctagatctctgctgtaaaaaataagacaaatgacaaagaagtaaatttattagagacccttttataaagcatgaaataatggcatcacttgaacagttcagatttagctgtatctcccattacactatttctattcacacccatattgttcttcatgtaccactgcaagattctaaatcaacaaacatcaattaatttacatttactgtaagtgcactcatacgatccggggaaacaactgttaagaaatgtttgcaaagaaagagattgaaataatgtttcgtatctgtttcaaaattttcaagtttgtttactactcaattaaccaaaaaattttcaactaaattaaaacttcttattctaattaattggaatttgaccacatatctcatgaagagcatatttatgtaaagaataaattataaaacaccaaaatcttactgtagaacttcttgctttattgtgattcttagatttggctaaaggatgttgcttattagaattaccagaagggccaactgatgacaattgtttttacataaaatcctaaaatattaaatggcttatacaaaaattctagataacactaaaatccaaggtgcaaaagatgaaaaacttctgagatctgctattacaaatttccatttttagacaagaatatgctttagctagcaagtcctattctagaaaaaaaaaagctgagtactaagtcttacttaagttaagcaggttgtgtgaggtttttctatagataatgatactgtgtattatttttggtaggaaaagatagcttgaggggaagatataaattagagcttctctggggaagaaaataaccttaaaaaaaaagtctgaaaaattgctaaggctgcagaatgcttgacctctaaaactgataagaaagaacttcatgattggaaataccatgccaaagattaaaccctgaacttcttagaaactccataattctatgtctaagaccccgaagcataaagcgttttgcttgcttgcatatagaaacagtcagtcttatagcaagtaccaaacagaaggacgtcatctttaagagagttaataaaattcattccaacaaaattgacagcgtgtaaattactttgacattgcccccgggaaagtagaagcattcaatatgaaggtaaataggaaagacattaatgtgagtgggcttttgagatagaaagaagacacaaataaaattgaatttgagaaacaaattaagaagattttaaaatagttatcaatagttgatgcccatataactgcctcagaaaacactgcattcagagcaaattactgaaaacttaattcatgaatccctgacttatattttgaatgctttatggttagatgggcaaaaatagagatgcatttctaaatgctatttaaagttgagtatatttaaagataattttctttactcactaagagtttgggatttacaaacgtcagataatgtctctgcttttcttgttggctttcgtaggttttcaaaatcaaccacagcattgaaatatattgagaaatctttgataaataatttaaatagatgcacacctgtgttcccagctactcaggaggctaagatgggaggattgcttgagcccaggagtttgagatgagactgggcaacatagtaagaccttgtctctagaagaaaaacaataatttaagtaatagaataaaaatcattttagagaatcttatatctaaataatagatactttactatatgtaataaattttcttaaatattttgtgataaggaatatacatatataacatctacatgtatgtatgcatctctatactgtttctaacaataaaaaagaccaatgttccttctaaaaaataaggacaattgaaacaaaattactcccctaccctctccaaaattacacataatccaagtggaaaaaaatcacaaagaacattttgctatcattctggtcttttttgcatatatacatacatataagcatacctcattttattacagttcactttattgcatgccacagatattacgtttttttacaaattgaaggtttttgtcaaccctgtgccaagcaagtcctaatagactttttttccaatggcatctgctcacttcatgtccctgtattatattttggtaattctcacaatatttcaaactttttcattgctattttgttgttattgtgatctgtgatcagtgatcttttatgttactattgtaattgttttggggtgccacaaacaaatgcccatgtaggacagtgaacttaaccaataaatatgtgttttgagtgctcccctaactgactgttcctccatgtctctctctttccttgggcctacctattctctgatacacagtattaaaattagaccaatggcctctgagcattcaagtgaaaggaagagttgcacatctgtcactgtaaattaaaagcttgaaatgatgaagcttagtgaggaaggccagttgaaagcccaaataggctgatagctaggcctcttgcaccaaatagttacccatgttctgaatgcaaaagtaaaattcttgacagaaattgaaaattctactctagtgaacacaggaatgataagaaaacaaaacagctttgttgcagatatgaagcaaatcagtggtctgaatagaagatcaaaccagccacaacattcccataagccaaaacctaatccaaaggaaggccctaactctttaattctataaagacatagatgggtgaaaaagctgcagaagaaaactttgaagcttgcataggttgatttgtaaggtttaaggaaagaagctatctctgtaacattaaagtggaacgtgaatatgtaggtactgaaggagaagctgcagccagttacccagaagatctagctaagatcactgatgaaagtggctacattaaaaacagttttcaatgtagatgaaacagcattctattcgaatagtgtcatctagaactttcattgctagagaggagaaatcaatgtctggcttcaaagcttcaaaggacaggctgactctcttataggggctaatgcagctggtgactttaaaataaaaccagtgctcatttaccattctgaaaatcttaggcctgttaagaattatacctgtgatctataaatggaacaattaagcttggataacggcacatctgtttacactatggtttactgaatattttaagcccattgttgagacctactgttcagaaaaaaagatgattttcaaaatatcactgctcgttgaaaatgtacccattgcttgttcaactgcttgttgaaaatgtacaaatgagcttttgttcacccaaaagctctaatggagatatgcaaagagattaatgtttttatgccaataacacaacatccattttgcagcccatggatcaaggagtaattttgaattttaaagtggcattatttaagaaatatattttacaatactatagctgccaaagacagtgatttatctgatgcatctgagcaaagtaaattgaaaaccttctggaaagaatttacaattttagatgccattaagaacatttgtgattcatgagaggcagaagaaatatcaatattatcaggagtttggcagaagttgattctaaccctcatggatgactgtgatgagggggtgtttaagacttcagtggaagaagaaactgcagatgtggtagaagtagcaggagaactagaatcataagtggagcctgaatatgggacaggattgctacaatctcatgataaaacttgaacgaatgaggagttgcttcttatggatgggaaaagaaagtgatttgttgagatggaatccacttctggtaaagatgctgtgaacattgttgaaatgacaacaaagaacttcaaatattacataacttagttgataaaagcagaggcagaatttgagaggagtgtctccaagaagttctactgtgggtaaatgcaatcaaatagcatcacatgctacgcggaaatccagtactacggcagacttctttattatcttattttacgaaaatgccaccccgggcgtggtggctcacgtctgtaatcccagcactttgggaggccgagacgagcggatcacaaggtcaggaaatcgagaccatcctggctaacacggtgaaaccccgtctctactaaaaatacaacaaaattagccaggcatggtggcaggcgcctgtagtcccagctactcaggaggctgaggaaggagaatggcgtgaacccgggagacggagcttgcagtcagctgagatctcgccactgcactccagcctaggcaacagagcgagactccatctcaaaaaaaaaaaaaaaaaaaaaaagaaaagaaaatgccacagctaccccagatttcaacaaccaccaccctgatcagttagcagccatcaacatctaggcaagaccctcctccactagcaaaaggatcatgactcactgaagactcagatgaccattagcatttttttagcaataaagtatttttaattacgttaggtacattttttagacacaatgctgttatgcacttaatagactacaagatagtgtaaacataacttttatatggacttggaaaccaaaaaggttttgtgactcactttattgctatatttggtttattgtgggggtctgaaactgaaactgcaatatccctaacgtatgcctgtatacgcatttgctattatactttttttcatattcacatattattttcagagccccaaaggtaaaatatgttgctatttttattaaaacacatagctacaaattagattgtgcatccatctctacagtcatcttcactatttacataatcaaatataaagaaccactagcaattcaacaaacgttatgaaatatatagtatgcactgaattctaggaataaataaaatatagacagagtgtctagcttacatattagtgatgagtgctgacacctgaatggaatattaaataaaatacagtcaatacagtcaaagaaatgaccgagatgggcagaggttactatggataccagagggttaatattacatattagtaatgaatactgacacctgagtggaatattaaaaacaaatacaataagagaagcaacagagattggcagaggttactatggataccataatggtttagagagagatgaagtagtgcccattctggggtctacaggaaaacttcctggaggcagtgatgaatctaaaaacataagttagagttatataaatgtagaagggaaacaggcatttcaggaagaagaaacaaaatgagtaaagtcatggaagaacaaggaaatataagcagtatgataatatttgagtataatttatgtgtatacactgatggttgatgaaactggaaagactgtatgggtcagatcatgaaggctgtatgggaattgggacattatattttagacaatgtgaaacagttgcagaattttatgcatatacatagtacgattagatgttttcactgaggaaaaaaatggggaataatcgtttcaattatcaattgtaataattcgagaaagagaggagttagacctattggtagtaggcaagaaaagaaggaccggttgaaaatagctacagggtggagtcctggcagggcttcttgatagattggatataaggatgcagtgaaaaaaagagaagactcttaggcctctagcttgggactacaggtggatggtatgctcatctaacaatttaggaacctaggaaaagaagccaatttaatttgaggttgagtatttaggctattctatatttgatgtaccaatagactacagagagagatattcagtaaacactctggcatatggtttagagttcagccaagaaatctgtaggaggagatagggaaaggtgttatcagggtataaaaattagaagataaaaatcataagtttacatatggtcaacaaggaaaaatgtaccagtagaaattaagagaaccatgtaaggaacttaggagatcaccaaagttataaggagatgtaaaggaagaagtgtatgataataagactgaagtctgtataaagacactagaagaaaaccccagaaacactggcttctaagattccagaaactaggatggtgaatttaagataaagatcaacaattaagaatgactacagatatgaagagaaagataaaggcagcaaagtcttcattattattataaatgcagaagtcacttaagtataagctaagaaatgtttgtattgggagctagctaagaaatgtttgtattggggcaatggttgagaagagaatgagaggtagaaaggaccatataaagacatctagaggccaagcatggtggctcacacctgtaatcccagcactttgggaggcttgaggtgggcccatcacttgagctcaggagttcaagaccagcctgggcaacatggcaaaactctgtctctccaaaaatacaaagattagctgcatgtggcagcacacctctgtagtcccagttactggggaggctgaggtgggaggatcacctgagcctgggaggtcaaggctgcagtgagctgtggtcgtgccactgcactccagcagcctgggccacagagtgagaccctgtatcgaaaaaaaaaaaaaaaaagacatctaatctagactctctaagtaatagaaaggttattgtgtctctctaaatgtaatttaaaataaaaataactttaaaccttacgataatttttgtcatgttgaatactttggcacttttctttgagaaacaacataagaaacattttcctcctttagttttctgctttgttggacttgttagtcatcttaatctgtcccataggtacatacagcacaggggtgcagaaagagacagtgagagtagatgtccccttcaaaaagcttagttatgccaaattaaaaaaaaaatcagaatttagtaagaagagactttgattcagacaggattattgcaaggagcagggaagggactattgcaacagggaatactaaggctgtaagatctgcacctatctcaggagttagatgaaaaggcttttttttctttttttagagaaggctaaacaaagctagagagaaccaggtacgaagtcagaggaaagggcagcctgattgaatagtagatgagagaatgttgtgctctgaatccaacctattctccggaaatatcctgtgctgtcttaaagctgagagtgggacaaagttcaggagcctagaataaggagggaaacgtaatcaaagtttgtttcacaagaattttattcagattaatcagtgagccaagcagttcagctagaagcaaagaatcggaactggtagggtctgtgtctggtcttgccataaacaagagggtgacaaagacagcttatctaggtcatgataagtgagtcttatctaagttatatggggcagggtgtttccttatagtaaacaattttctgttaaaaaaagtgaaagtaagtaggtcatagggaagtttgttttatttttaagatgaaagaaacctgagcgtgtttgtggacaaagtggagaaagccaggaaaagtaagggagacaaataattgaacaagtgttttggataagggagagggattatgtgaccaggttgacggtgatatcttgattaggagggactctatcctgggattgtaaagagaaatattcaggaggcatttaagcttggagatggaggactacagaacatcgaagcagtttatgtctaatcattttataatgtaccacaaaaacatataagcgacaggaaagtagtggtgaatatattaagtctgagcaactagatattctcaatgcagtaagagctgagacaattttctgagagtgactcaggtactgagacaagagtagcagaggtgcatggaggaaggcagtaccagacaaaagacaatggaaaaattaccaaaccgtagtgatgatattacatatctcaactcatgcaaggaacagaaatgctgaaatgttgccagaatcaaaattctcttccttacaaaaccagttttataggacaaaaaaatttaatttcccttataactgaatgctcatatttatctcagaaaactacaatttcgaaaccaaggtgagagaagaatgccgatgtactgattatgtgtaggagacattgtgagaatgtgagaatcctaatcttaatgtccctcacttgggtgtgtgtatttatttgtatttcccactctcccatcccaccacgaagacctccatatctttcttcatttctctatttttttgaagatgtcaatttctgtgtaatgtataatttcttgaacacaagctctgtttagcaaacttcaacagtaatcccctaaagaatctattctctgagtttcactgacaattttttgaagctctccatttaagtgttatggaaacctttgtttgaaactgtaataactgtactaaataaaggtgccaggagagacatgaaaataagctatatgtctcatgtcttatttttctatttattattagaggttttgttttgctttgatctgattttttctggtaaccagaggaaaatcatctttatcacttttttaatgcttttcttttgacatgaaacaaaataataatagaaagacagaaaagtatatatgcattctttttggtctcttaaagccaataaagcagctaaattttatgtatccatgtatgtatgcatgtattcaatattttaatggtctttcttgaaacataatgctgtatccaagcatcaagtactataaaattcaggtctgtacaaagcctcataagctcttttagagacgtgatttcaaaaatattgatagctaataaattgtattaatgtttaaagagattttatttgtttgtttaaattaaagcaccctgtggaggcaatttaacaggatcttcaggctttattctttcaccaaacttccctcatccatatccgcatagcagagactgtgactggactatcaccgtcaatgcagactatgttatctccttggcgttcatcaggtgagttcttatatatttatttccacgttaaaaaaatatattgttaggccattttgctttagcatttgtactagactaattcctatttctgtatatagcattttttgttattttttacttatcccagtgctaatagttgttctagctttgccactgtcatttgtgttaccttgggcaagttatttatttgagtgagcctccattttcccgcatgaagctaacagctggcatcacaaaacccagcctctttccctgaagatttcattggaagtgttaggtaatagcaactcagtgattttccaagtagaaaagtccccaatctttattatctaaggttgatgtaatcagttatgttgactctagtagcacaattcctttttctgccaccagtatgttaaagctccttagtttttatgtgaaatgttaagcttaaatatacaatattttctaacgtactgaggccagtttgtttttcctaagtaaagataatttgaactcataaaaatttagcataattgtaaataaataaaattttatttttgtgatttgtagtggtacattgctaattagtaataccaaagcaacaacaatgataattttagttttatgccaggatcctgttgtaagacaaattcccaagctaagtactattactatccccattttctcaattgaggaaacatcaatacggacattagaaatatcaaaatggatgatacagggcttagtttacatataaaattattctagttgataacttgagggtagaaggacatattacatgaagtgcatgacctaaatttgatttctagctctatcatttattatgtgaccttaggtagaccactgattttaaagagccttaacatacacattggtaaaatgaaaagcataatctcttccttatacaacaggactattggcaagatgagttaatatttattaaagtaccttgtaaaacataaggtaatattagcatgcactgttttttcagtttttcagaaaaaaaacgtaataactaagactctaaaatttccttagaaggaatatttttgttttaatttcattttcaaagaagttacaatacttgaagtattgatttagtcccaaactataaattaaaaagaaatgtactgtgttccattgttaaataagctttcagccttccgtgcataataaatactactgtgtcatttacaaagctcttgtttctagtgattctcccaacagatatagaaaaggaagttgtaattaccatcaaagtttaatgttggaagagatgaaattcagaagttgtgttttatctcagaacaagggtaataagtaatgaaataaagtttaatcttctgacttctgctatattattataccaacagttaccaaatacaggcctcagatccactgaaaaatttcaggataagttaattgaactaagtgttgaagctactgaataaattaaaacaaaatataatagtgtgatggtctcccaattttctcacgttagaggggcccatatataagaaaagtctgggaacctctgcactatcccattctttctttaccactgcttatgcacaagtaaactgagcagctggactcttctttcttgtacatgcatatgtaaaggatgagattgtggaacgttaacttctataaattctttgggttcggaaataatgcctttcacgtaacaaatctattgcttagatgcaggcaaatatgataaaacttgccaaaatagtttttctactgatgaatgtttaacaatggcaagttttactggtttcattttatatcataaactggttgacttttcttgctgacctaaatgaatctatcctttaccccatatttctctaccacagtatgagttaggaaaaacagaaattgattgcatgtcccctgtcttctaaatgtatgagttccatgatcattgtgggacaattgttatacttttgaaggttgttaaggcaagtttattatgcaaatcttgcaatattaacacaactgatttgaatcatttacatgctaaaatatcctttttcacattacctaattctgataatgtattggtttgatatctcctacattaggttttaaaagaagaaaatatatttactttcaggaaaaagaatgcctaatacaatgtgcaaagcttcatttgagttatttaaatgtaaataatatatttcaacttttgatttcagcttttgtccatatctgattgtagagttaaatttttaggagtactattgatgaagaaaaaagtagtttgtgttttcatgatgcaaaatatatggatgaaaaagttttaaaaatacatattatcctccacataaagtaacttgcataagaatatgtcactaataagggcagaaacaaggcttgaacttgcattctctgactccaaatcctgtatcttttcatcaactaaactctttgtcttacaatcacttatatttcctctgcatacaatgtcaacttaaaaaatatgtaaaaatatcaagtttttttctttttcccctgcttatttgatatttatattaaatatgttgttgccaggtgattttttatattagcttattttgacagcgtcttttattatttttaagcactgaattaatgtttgattatataactattatggttaacagcctaataataattatcctacttctctttctttcttttgttctttccttttttttttcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatggatctgttagttacactggatttcatctagaatacaaaggtaaatatgaacattccatgttagtatcatgatttaaattatagatattttatacaggagaataatttggtatggcccattgttagtggttagttttatgtgtatttttaaatgcagattatgtacagttcatctcataaaagcgttctcactgtagaattttcttattagtgggaaggaaattagcatttctctaattactaccaaaggaaaggtatcaggcaaacaaattaacaattagtatattggaggagttggctggagccacacaacattaaaaaataaaaaatacaaaaaaagcctcattttgtagaagctgaagtttcagtcaaataccttaatttgatgaacactttcagtgataaagggaacaacgtagacgataactgtatttcagaaaatatgtaagctgggtgccatcagtcatgcctgtaatcctagcactttgggaggccaaggcaggaggattacttgagcccagaaatttgagaccagcctaagaaacatagtgagagcagatttctacattgttttgttttaattagtcaagaggggtgtcatacgtctgtagtcccagctactcaagaagctgaggcaggaggatcacttgagcccaggagatgaaggctgcagtgagatatgatcatgccactgcaggccagcctgggagagcaagaccgtgtctctaagaaaatgtctacagatatttaaatatgtcaatattcataataaagagaagaaatatagttataatgttttagaatacttctgctagtgtttaaatgaattatgttagaatgcctgtggatatttataaatatatttttctaaaattttatagtttatgtctataggaacagatttagatttaggttgtgtaaaatttaaatttatttttcaattactgagtccatgaatggcatactaataattcacctcaagttatcaactgatttctgaaaacacatgctttgatttgttaccaccttttgtttaatattttcaataatggaaaattatatagagtaatgaactccaaagcatccatcagccaacttgacaaaaattaacactgtgctatatttgcttcagatctctttattcttactttaaaaaatcaaatattacatatacaatggaaactccttttgcatttgccataggaacaggggttagtctcttcagggctatcgtaagaggtcacgataaatttcacaacacatgatatgggtaagaaagatgtttttagggaaatgaaactcacaagtcagtaagaaacagaggcttggagtcctccgatatctctgtcatcacttggaactgtatgccagggcaagggtatctgctggacattaacagtatagttttcattccagtggaaagcttgatccctccgtaagtctctcatttcacaagaaaaagcaggaaaatggccttgttagtaggaaaatatactggccatttggcacagacagtgaggtttggggtgttggctgtttattggggttttctgcaaatgctacctgctctgtatcagaagatgcttgggggaagtttagaccttgggaatatgggttcgaaactcttttagagagagtgagcttgaccacaacaccactctaaccacctggtagataattcccttaccatttgtggggacctggctagctggccatgtaggcaaaccataatgagcattcaaggtcatttttcagatattcctgctcttttcatgctagtattcccctaatcctgaagttgatacttatcttttccatgtatttatgcttgcacatatttttatatttcttattttcatacaaattttgtatttttattatgtatgtatccttctgaaaattgatttggccccttaaattgtttttgagatttatcaaaattagaaacatatagctttaatttattaagtcctttatgatactccaccatatggctatatcaaagttaatatataaatttttctgctgatagacatttaggttgttctggtttattactaccagaaatgaatgacgatgaaatgaacattcttttacatgtcctcatgaacatatctgtgagattctttttaggacatctgtataccaaagagtgggattactgggtcaaagggtatgaacctcttcaatgtaactctgtattgccgaattattctctaaagaggctgtaccaatgtaaactcaaaaatcagaggatgagagcttcagaaattccagtttttaaaaaccagtgcttttgttaaacttggaagttgctaattgtattaaatgatatctcattgtcatttttattgccttttcccttattactattaagttgagcatctttttcctattttgcatactgagattttctttctttttttttttttttccttgagatggaatcttgctctgtcactcaggccggagtgcagcggtgatctcagctcactgcaacctccgcctcccgagttcattcaattattattaattgttttaactatggtcccgagttttaactatggtgtatattgccactgaattattactctatattacaaaaatatatctatgttgtctgaggtaaatgcccagggtttgtcatttggcgccaagaagattaaggacagggacaaacatgaagagtgagtttaggggcagaggtttaacaggcaaaaaaaaaagacaaaggaggacagctctctctgtttcgtaagagaggggcatccaaaaggggaaagccagcccactgttgactgcgtcagattttataggcaggcttgaggaagcggtgtctgagttacatagggcccacagactggtttgaccaggtatgacatttacatagtgtgcggggaaggctggtcaccccaccctaatcttatgcaaaaggaggctttgcctggcaggggctatattgtcttctccttactgtactcatggtttggcaaacagaagggcagatgaagcccccattttggacatgcctagtcccaggtagccttttcctatgggcacaactgtgggcattcacctgtgcaagcttctggcttgcttggctatgtctgcagctccattttgcaggctgctctttgttagaaaagaaagtgatatgatggctccttttcattaaaaggaaaaccttactatctgcctaagtgatttcttattaactcctgtatcattatcattgatttagtaccatctgattgggctataatttttagtccttgtactctttttgtctggttttgatatcaagattacactacctgcctaaatttaggagcattcttaattttctagtatcgagaatagtttgtataagataggatcatctatttcttgaatgttttctagaactgaaactatggacccagtgatttaaggtggtggaattttaatggttgtaaatatatttagattagcttttttatcttagattttaaaaaatctttttctaaaaactagttcctttcattcatgatttcacacatattgacatgaaaatattcacagtgtttcttactttatttgctgctgcatatttttgttaacactgtttaatatttttattagtattgcttttatctatgttatttcctctgttttattttctctagatttgcttatcctttttctcatttcttgagataaatactgcttttgtttttttttggagacagagtatcgctgtgttgcccagactggggtgcagtggtgcgatcccggttcaccgcaacctttgcatcccggattcaagcaattctcgtccctcagccccctgagtagttgggattacaggcatgagccaccatgcctggctaatttttgtatctttagtagagacggggtttcaccatgttgaccaggctggtctcaaactcctgacctcatgatccggccctcctcaagagctgggattacaggcgtaagccaccacgcctggccaatactgcttattaattcgcattttttctcttggatctacacattttcatttaagaacctcttaagctgctatgcaaacattttgatatgtacagatttatcataattttattctaaattggttctaagtatagcattatgatttttctttgctgaagtgctacttaaaagtatttcaaactatcaaaataaaatttaaatctataacttattatattataaatttctaatttacttgcatgatcagatatgtatgattctggttctttggcttgtcataggatttgttttgtggtctattatatcgttaatatttatgttccttgtgtactaggagagaaatttgtatcatctaatgagtgcaagtttttatatacatccaataaactccctaattatattgttaaatattcatcttctcaccattttttgacctgctcggtctagcaattattgaaatagttgggtaaaatctactattcttaatttgccatttttcttaaaatctttaccactttgtttatatattatgaaagcctgctttcaggtgcatataagttgcatttttttctggttttttgataccttggatttagtatatttatacttattagcctttttcttttattttttgcttcatatttgttttgctttttctgtattcctaatttcaaaatcttccacttgctacctaataatgtcaatatctgatacttccttgcttatttatttttaagtttacttaccatgtgcatccccctcactccagtagccccctacacatattctaaaatacaagtttcttaagaggaaagcctttatctgttcattcaccactatacactaagtgccaagaatagtgcctacacacagtaattattcagtttgctacttgattgcttttgagcatcgtaaagaggtgttttctgttttaaaatcaagtcataattcaaatattagaataataacattctttaaatgtgagaaaccttggagctgattcctgttctaaattttatacatgagaacttggcttagaaatagctacttatacctgcaagctgaaaggcttatacatatgacctgtttaaaaaagaaagaaaagaaagaaagaagaaagaaagaaagaaaccttttaacaaatctgtagagataaagtgaggttctactgtaaattagtattaataaaacatttccaaatatcactacgataaaagttgcagcaagagtatctcactagcaatccaatggtagatggtactaactgattatggctttatttctcatggaaactggtcaggaccttataatgctttctctaggtaacacaccatgtagcccttactaaagcctagtagttaagcaattgagataaaacctatttgccattatctcagctgaatatatgtccctccctatttccccagcttaatcaatttcaatgttttcatcatttccaaaaacttaagattcatgctgtcatagataaagaactacaaatgtaattttttaaaaagagatgttgtttactatgcacttactctactctagattcaatgattagacctcatgagtaggtatgggaaggacagagataatgcatgtataaatgcaataaaaacattacagaacagcattgtaagtattgctatccccattttacaaagcaaaaaattgaaaatcgaattgttaaaatgatttacacaagactacataagttattattacattgagaataaaggcaaagaaaaatataagtataggtagagagaaatacataattatcccattaactacatccttcttccccacccactgtcttcacctattataccagtacacatttagacacaattccaccaggtcttatttttatactccagatgatatttctttacaataatgttctcgagatccaatctcattaattttctacctggtcctcaaacccccgctgtttatgggaaaatttcattgcccacttcagggtcttcagggtctgtcttatcagcttccttatttcctattcttattttggtaaatgtttcctctgtaattgtccagtttcttaaggctaacaatgcttgtaatgatgtttataatgatcattgtaaaacaaacatctcattattttcaatataaaaatatgcacacccaaatgaatggacatataaattgaggccctagatagtaaaaatatttttctttgtcttttgtaacatatatcacaaatgttgacttaagcatgttggtttctatagcacttaaaaagtaaagttattagtggtctttttcctttttaaaatttttaatttttacaggttcatagtaggtatatatatatatatatatatatttatggagtacatgagatattttgatacaggtgcacaatgtgtcataatcattatcagggtaaatggggtatccatcacatcaagcatttatcatttatttatgttacaaacattccaattatacgcttttagttacttttaaagatacagtaaattattgttaactgtagtcaccctgttatgctatcaaagactagatccctattcattctatctaactttgttttcataccattaactgtccccacttcccaccccttactcttcccagcctctggtaagcatcattctactctctatctctacaagttcaattgtttcaatttttatctcccacaaataagtaaaaacacgaaaagttttcctttgttatttttaatttttgtgggtacatagtaggtatatacatttagggagtatgtgagatattttgatacaggtatacaatgtgtaataactgacacgagggtaaacggggtttccataatatcaagcatttatcctttgtgttacaaacaatcaaactatactcttttagttatttttaaatgtacaattaaattattattgactatagttgccctgttgtgctatcaaatactggatcttattcattctttttaattatttttttgtaccaattaactatccccactttccccccaacacctctactacccttcccagcctctggtaaccatccttctaccctctaactccatgagttcaattgcttttaatttttagctcccacaaataagtaagaaaatgcaaaatttgtctttctgtgcctgacttattttacttaggtcctccagttccatccatgttgttgcaaatatttcattcttttttatggctgaatagtacttcattgtatatatgtgccacttttttttatgcatttgtctgttgtggacactttaggttgcttccaaatcttgactattctgaatagtactacaataaatgtgagagtgcagatatctcttcgatatactgatttctttcttttggatatatactagcagtgggattgctggatcatatggtagttctatatttagttttttgaggaacctctacactgttgatactgttctccatagtggctgtactaatttacatccccctcaactgtatatgaggtttgtcttttctcctcattctcaccagtatttgttattgcctttaattaaaaattaagacgtggctggacgtggtagctcacgcctatatttccagcactttgggaggccgaggcgggtggatcatgaggtcaggagatcaagaccatcctggctaacctggtgacaccccgtctctactaaaaatacaaaaaattggccgggcgtggtggcgggctcctgtagtcccagctactcgggaggctgaggcaggagaacggtgtgaaccggagaggcggagcttgcagtgagccgagatcgcaccactacactccagcctgggctacaaaaaaaattaagacgtaagctttattgtgtatgttcacttctagctctaataaaacatatatagtataaatatatatatatacatatacatctatttatattcagcagaaataattttaaaagaaaactaaaatattttagatgcagcgatctaaaatatatcttctgatatatcttatttggagactgtaaggaggcaaaatactcttttacctagtatctgttcagtaggcaaatcactattaagcagaaaaaattaattatgcataaaaataatgctgataacttgtctgcctcataatttttattcagaaactaaaatcactttccagctactgcctagacatttttttaagtattctccaggtgttttcaaaatttccaggtgtaattgctatggcatatgtggatataaataaagacagtattattcatagaaaactattcaccaaggatttaaagcagtatgtaaacataataataacataagggcattctctcaaattgaggctagcaatgtaaaattgttgcagaggcattatttttaaatttgtcaaacatgtgtccctttcctcaaaaaaccggatgcttgcattacagtttcactgacattatattgaaacattgaggaaaacttcaaagaaggagaaagcaaacttttcaaaagatgaatattaggagaatagacttgtcaacgagattaatccttttaaacagaaatttaaatccttcctctaccctccagggacttagtttaattttacgaagcccagctataaatgccaggtttctgttctgtctaaaaattacattgcgttttcctgcttgtttaagggaaggtacaatgtaaagttttattttttataaataaacaaatcaacccttgcatcactaaatgcccattcttagtgaccaaattaagtagttaccctgctggttctttcataaaaagagttgtgtgaatattttatgtgaaagaaatatattccatggtttgggacaaaatttttacagagcagcttgagtataatatatggagtgcaaattttgtgtaagtgtatccatgtgtgtgtgtatatgtgtgcttgggagaagatcaagtcatttagctctggtttgaaacccaggaatcacatttatctatttgcacatgtcagcacacctcctccccaacaggtttcccatcgcctttttacctaatctgttccttattctctcaatgctcactttagataccactttttagtgaggttcctgaatgcttctctttatacagcatgccaaaatcgcaagtctttatttaatataattgctttctttaagagactgtaatttccgtgagtgccagaacattttctgattgtccactgctacatttccagagttagcagggtagtgagcctttaagtacttgtagagagaaagaaagaaaagaaagaaagaaagaaagaaagaaagaaagaaagaaagaaagaaagaaagaaagaaagaaagaaagaaagaaagaaaggagagaaagaaacaaaagaaaagaaagagaaaggagagaaagaaacaaaagaaaacaaagaaagaaagagagaaagaaagaaaagaaaagaaaagaaaaagaaaatagtagggtcgtgagcctttaagtatttgtagaaagaaagaacgaaagaacaaaagaaaggaagaaagaaaggagagagtaaaagaaagaaagaaagtgagagagagaggaaggaaggaaggaaagaagggaggcaaccttcctcatttatctgttattctattaaaattatttaaatgtgtggttctaccacttcctctttagttgaattgggagaaattatatatagtgttcttcttaaagcacagatttctcattatttcttaaaaatgctaaagtacattaaactccttgcaaacttttatgaatgaaagaaacatattcttactggtatagttaattatattttgatataaaaatatgtttgtagtagccaaacaccaagatatcgttgacttacatttcaaagattccatgactcatattcagagatatacccactgtctgatttcttattagcacaaaacaaattctgatgtagaaaatcactacatttgttatcctgatttattgtaatggcctttacgttgtacatttctttattatttcttaagtaatcaataattacaaaatggaaataatctcaaggcctcatccagatctgttaacaacaaagtgttctagtacctttgccataaaatgaatgagctaatctttccatttctctacatattttcaaattattctgtcagtctctttgttcaatatctgggtacaatgaaaacaattcctctgctctgaaaggattttattttttaatctgtctgttacctctagttttgaaagtgttttgcatagggatagaaaatctgtcaaaaaatactgtggtttggattttgctattttacaatgggagacctatgataaaaatgtggagaatgactggagaaaatagggtaagaaaaatggttgcagggcagacaaatagggccttttattttgctgtaggtggtgaaatgaactgagctcaacataggaagaaaaaccacttctaggttcagtaacatggcattacttgtggggagatcttttaaataaagacgttttataagggctccttctttttttccaaagtaattcatttatagtacctacacatggattattagcacataatatttataataaattctaaaaccctatgtttgactatatgcattggatactaaatttaatgagaagatctatgaagatctttagaatttatttattatcttactaataaatatgcattagcaatttgtcagatatgcacaagggctcctttgtactttgagcccccccaaaaagacagaaatgatgctgctgcttttccttctgggttagaaaaagaaatgaacatgtcttaaaggtccataaaaaacagtcagctgtcccttggtatccctgggtaactggttccaaaccttctgatactaacattcacagatgtgaatatataacttatatacatcctcccacatacattaaatcattctagattactaataatacaggatatgatgtaaatgctaggtaaacggttgttatactatgttatttagggagtaatgacaaaaaaagtctgtatatattcagtacagatacagttttttccaaatattttcaatctgcagttggctgaatccacagatgcagaacccatgtattacggagtgccaactgtattttaaagcaattaatgttatactaacactgttttacagcaaaactgcgagagtcctgctttgatccaggcaatataatgaatggcaccagacttggaatggattataaattagggtcaacagtcacctattactgtgatgctggttatgttcttcaaggttattcaacactcacctgtatcatgggagatgatggaagacctggatggaatagagccttgccaagttgtcatggtaaggaacatattttttggctgaattttcatgattagaaaaaatcaaaaaatatttaaagacatttctgtgtttcagaacatcaactattccacatacaatctacaagtgtcgtactagcaatgcagagattttatcaaacattttaaagttgaattcaataaagacctggttttggaaaagtgcttatattcccaggtgtctctaaagcaatatgtgtactataataggcaaactttctgagaactgggttactgcctgttatgctaatttgtgtgccttcaggacttgcacctgaaaacgttaggtgctcagaaaatattggctgagtacatgaggaacaaacacactgaaactaacatttcaacacaagtagataaatttaataatttaaatattattaagaactggtgataaatctttatctgtaataaggataaagaagaatatgtatttcttctaggaattaggttgtctagaaggagatataatactgcatatttaaaaatcatatacttgtatataactctctctatataagaaaggaaaaacagagaaacagtgatatcattgcttagggttactagagactccctaatccattgaatgatcctagtgcattgtacaaaaattaacacagaagtgatatcatctaggacagatttccccagctataggtcaccaacagtgaatcataaaatcaattcattgggttgtgaccagcatttttataatagacatagaagttaatcaaataaaattaaattaaaagttaataaaataataggaaaaaagtatactttaaggaacatagagagagtactttttttctttgtttttgaggtggagtctggctctgctgctcaggctggagtgcagtggcgtgatccgggctcactgcaactccacctcccgcaatcaagtgattctcctgcctcagactccctaatgactgggattacaggtgcacaccaccacacccagataatttttgtatttttagtagagtttttgcaatgttgctcaggctggtctcaaactcctggcctcaagaaatccatccacctccactttctaaagtgctgggattacaggagtgagccactgcacccggccgagagtacatattacttttggaacttttctctgttatatataaagaaataaataaaatacaataaatatacctctgtgtatatatttacctgcatgcattcaagtgtttgaattggtctatgatataaattgcattttttactattaatttcagtgaaaataaatgacaatttttgatatctaatacacatagtaatttttcctagttgtagaatgtattcacttataagaattacatgtgcccaatttctgacttacccttctctggatttattttgtctcatctatgaaatagagatgattaacattttttacttcaaaatattgttataagaaacaaagaaatggtagacatcttctgattggtccatcattaccagaacagctggttaatttttgacttgcatttatggttcatctatcagaaggcaaaaggaataaatagagtaataactactttgggattaattgttccaaagagagaaaaagtgattgatggcatggaagtttataggaaatttaggagaaagggtcactgtatcatattagaatttagaaccatataaattagtattatgtaatttagaattagaaaaatctaatttagctagaaaaaaatattaaacatagaaaataacttttcaaattttactgtcaatgatcatttggaaactatagaaaatttctgaaaaatttccaggagccagattcaaaataactaaaagtcatgatgcagaaatatcaaaggacacaaaaaactatagattattaagatagatgttaatcgcagggataaatgattaagtagatggctttcaatgacaggtgaaaaagtcaggaacactagactaaagtatgctttcactaagaatatgcccacctaatataatcatactcctttccaataggtcatagaaatgtcagtttcaacatgaaatgtgccataatatttttttaaaaatccttttgagccaaaaccattttataggatcacttatggcccaattaagtatacttaatgttggttgaatagttcatatctacagacaatttagagcatacagcagacctgaattcaaatagatgtcttctgacacctgtgacctaaggcaagctgagtcttgacttttaaatctctaaaactagattaatagttattaattcagtaagttattgtgaagattcaattagtaaacacaacacatatagagaatctagtaaagtttctgacaaaagttggaatataaatatatgggagttgtgatttccaacgcagagttccaagagaagcaaagtgctgataaacatgcatcacatcttgcatcaggtgttatgttttggttaactagtatacttctgtcattttaatattaattaaaaataatttatctatattatgatgtgaatacacacattcattcactcctgaaaaacaggtgttgagtatttaaaaatttccctaagagataattgttaccatcagttaagtatcattagacttttaatcaaaatggacatgatattatggaaatcgaataaaatttattcagtgaattctttaagctaatagaaaagaagttcaagataagtttatgattgcaaccaataatttctagtatagtaaaacaaaaaatcctgttttagagctagatatctttaatactaaacaatgaattttttaaaaaagtctgagtttctgcgtgacttttcaatttatttagtatatctaatcataagatattgtgtaatttgcaaggttgttgagaaaatcatattaaataacttattttaaacattggtctgtggctgtcactgtcacacaataaggagaatttgatatatttttgtttcttaatcaatgtcacatatcaaattatttttcttcagcacttatacacaggactggctgactttcagatgtaataacttaatatcttttttattttttcagacagggtctcactctgtcacccatgctggagtatagtggtgcaattgtggcttactgcagtctgtacttcccaggttcaagcagttctcccacctcagcctctcaggtatctgggactacaggcatgtgccactacacccagctaattttttatttttattttttttgcagagacagtgtctcactatgttacccaggctggtctcgaactactggcctcaagtgatcctcccgccttggcctcccacaatgctgggattacaggcatgagccaccacacctggcctaacttaatacttaaaagtcaaatttagtatttaaagtatgtgtaataagccagagggttcattgttcgtaaaaacaaattattttttatttttttaagataatttttttatttttatctgagatatgcatatgataactaagaaaataataaaaaagtagctcatatttaaagcaatggtcatctgccttatccctctctatcctcttattggtcagaagctgaagattctgatttctagttctgattgctatgatggcccctcccaaaactccatataacataggaagatctgtttctttatttaccaattctagataataatatcttattattccctgatacaaaagatgatgtaacagacacaatccctctcttcaatgtttcagtgttatattatttggggttattctagtgattgcttttgctatacattaatatgtgtacgcctctatttctaattttatcaatgtttgagaattaggtgactggccctttgctgcttttcagccgaggtcccatcccacagtaggtatcctgactaaaatctctgatgaaactgtgactgactggtaggcattgcttttgagtgcatacgtaggaagttaactgtgattcctaggagtgaaaataagcaaaactttttctttgtttattctttatttttttagtgtagaagcaaataccaacatgatcatattctgcagactcttagaacacaactacatttcgctttttcttataatgttgccttagtcgcaccctagaagagcataagctccatgcagtcataggctataatatcgtgtttagcgtgtaacaccttaatttatataaataggctcttgttaaatatctgtaaactcaaaccgaaccaaatcaatttataaagtttgtctattttagaagatagatttttaccatgatttaggattaagtgtatatgttaaatctgaagaaaatgtttttaagagcttaagttggacactgggagattatatttgtcagaagtaaatccaaaatgattgcatcctgtggtaagtcctgttcagtgatgagaaactttgcagtttagctgatgatattgtcatatatattaaataatagcagaacagcatatctgtgcctacaattccttttgtgattaaaaaaatttgtttagaaaataatttcttccctgtttatttttcttactttaaaaagtatcttttaaaactctgtagtaatttacttatatacagtcatactgaataaaagtagaagtcatatatcattcttatccataatctcactcaatattaggtaaaggtaataaaacaaaaatagtgacagattccagattttccccttaatattatttgcttgatttatctgacctaatcatgttgccttgacttattttatctaatggcgcaggtctaaccttatccagagcatctgccgtctcttacctcttttcctctttcctaactagtttttctccttcctttgttctccatatagtatcttccaaacacaatagagtgatctttggagcataattcagattatatcatatttactcaaaatccaccaatggcttcccaaatcagaataaatgccaaagatcttataatccaaagttctacttcatctgctcatacacaccctgacctctttattgtttcctccctctgctacattctttgagtgacaccaggctccttgatatttcctcaaagcactgatcagacttctgccccacatcttttgcacatgctgttctttcagcctggattatttttaccccagctctctggctgtctagctctcttgttttcttcaggcatctaatctcttgtcttcttactagaagaaaattcctatttaccctccccgtgctcctcagagctcccaggacagaatcaatatctattctaaaattgcaactctatatcctgaataaagatttatttgatgtatgtaaagcccaaagtactttcaggacctcataactttcaaatgtaaatcattaaactagagagtactgaccaccgtacaaatgaaatattcttaatcttttccattgttacaacgtacagtgagcatccaattaataggcagttataatatatgaccctaagaataaacatatttagactgttaatgaactactagctcaccaattattccaaagaaaagattatatcatttgttgattccttttagtcaggtgttaaaagtaccattatgcctggtcctgcatttaaaattggggataacaacatgaattcaaccttgtccttgcccttagagagtttataatctgatgagatacagataggtaaagtccattgctagaaataaaaacagtactgtgagcacagcatggatatacatctgatcttgctgtgaagagagatcagggtggcttccttatgaaagtgatatgtaaacagaattttaaaagtataagtaagaagaaactaggtgagccacaggaaataaagagattatgtgtttcacaactagggttcagcatatataaacatgtagaagtaaagagcaaataggaaatgctggtggaatttcaagtaattcagtagaacaagagcataaggaggaggattgttgacagatgacagcttacctgtatcaagctggtaataataatattacatattattttgtgtttcaccataatgccatgaagtagagactattaatattctcattttatagatgaggaaaccaagacacagagagaggttcatccactagttcaaagtcacacatggttagcagtcttcttatgaagccatgatcttaatcactgccctataggtagactggttaattctgcaaaggactttgtattgacctttttatatctccagaaccaaagagtgcctggaatattttaattggtttaatgttttacaaatgatgtatggcactaagaataagtggtgagattgaaatcttcctccaggctaagtatgagaattaagagaatgtaaattcctaccaaaaaaaaaaaaacctgatagaatttttcatcttaaatgcatttttgtatttcatctgaaatacaactctggacagtatacaaaggcctatatagatatacttagccagcgctagctctgttcttttcaatacctttgtttcacatatgctgatataagatctggattatgcaaaaaaaaaaaaaaagatttaagtcactcaatcactgatgacctctaaggtctgtcaaaagtgcctaaacacaaatatgttaagattagacatccagcggtcttctggcaccattctctgttcaacttccaagtatatgtggaatgatacaagcttttaaaagaagagccctcttaccctgttaattaaagagaaagctttgaaacaaaccaaaaaataagaagtcaattttataattacagctttccaactttaaagtcatctctaatttaccaattattcatatgccttacttttaatgaaatcatattgtttgggtatatataattcagaaataaataactacacttttatttcagatattttgtttaaatggcatgacttgtcttgtgctaagatccttatgtcaaatgtccttgaggtttacaaaattttttgggggtgtgaaataagtctagagtctcattccattatcaatgcatatagagattatctaatctaatatactgagccattggcatttgaaatcatttaaatatgtaatataattaaagcatgcagacaaaagattcataaaacaaatgcttagtggtaaattatgtctgtgtatcatcaaatatctgcttttcatcagcagcacacaggaattttgttcacggataaaatacacagattatgtgttggaaaggttttcaatagagaagcgtaatgtattttaatgtattttgcattgcattgggataaaaccaaagcatattttgttttcatacgataggggaaaattattatttaaatggaaacaagaagagatgctaatgttagtgagcacttgctatttttctgacagtcttacatacactctgtctccagttggcctcctggatgctagtctagagaatcattaacattgttataaacaaatccctgctgctatggattctggagcatactatgtggagtagccaatgtaagaagtaatttgcaaatcaatgcctataattcagagtatacaggttgagaatccctaatccacaatgcttggactggagtttttccgatttcagatttttttcggatattggaatatttgcatttatacttaccagttgaacacccctaatctgaaaatcccaaatccaaaatgctccaatgagcattttctttgaacatgaactttgaatatcatgttggtgctcaaaaatttcagattttggagcattttggattttgcgttttgaattagggatgctcaacctgcattttattgttaccattgacttggggttcatatttaaaccatatctccagatggacagtcatatggattctcattgtacgaagatgtgccccattctcaactaccatgtagtctacatttaagtgagacctcaaatgtaccttcctggtgtattgtcagttttactggaccatatatatatatgtgtgtgtgtgtgtgtgtgtgggtgtgttgaatcaacttagtaattatcttcttacaagtgaagaaaataaagtatataacagtaactgttagtagtcatggcaagattcaaatggtattaaggtaatagtaacattaccttatacaccattttgaggtatctgaaacgattataatgcagtataaaaaatctataatttctactggtgacaaagtcccagttaacttttactattcatgtgctttgttgcctacatttgtaattaagagaaatgctaaaattcagttagaaaaaaattcggttaaagtctagagaaaatatagacatttttcttcttcatctaaatttctggaagaaggaaaggagctcctgaatataacggaaaggagaagatgagtcacattctcttctttagaagtctgaggtggaataacagccaatgctactagtagtcttatttcaccccaggcttctagaagataaagagttaaagaaaaatagaggaccacatccaccttgaccttcaacagccaggcagtgacctcaaccattgagaaacagctgaattgacatggcttcctctctttgggatggagtactctgctcttgatccttagagaaaaattaagagaagaaaatacaagccatgaacttctcctagagagtgacagtgctcaaagtaggatcacttaaaggcattcctacctctgtcaagggagcagtttggcaaactactaagaaagtttcttctgctattacctctaagctttgtatcctcctgagattgatgaggttagttcattttcctaaggccttacaaaagcctcattatattgccagcagaagattctggagtagatcagggcagttccctaattcattttcctaaacccacactacataccagatctaacagacacttcctgttccagttcaagtttgtatttccctctgtcctaaggctactcagtcagtaaagactgaagctggaatttaaacctaaacctttctcttatttttctttttttttcgaggtggagtctcactctgttgcctaggttggagtgcagtggcgcaagctcggctcactggaatctctgcctcctggttctcttgcctaagcctcctgagtagctaggattataggcacctgccaccatgcctgactaatttttttgtatttttagtagagatggaattctgccatgttggccagtctggtctcgaactcctgacctcaagtgatccactggactctgcctcccagagctctaggattatgtgcgtgagccaccgcgcccagcctaaacctaaacctgattccaatgtgctgagttttatgttgtactctaccatgctatcctaaatggaaggattttttaaatctatgagttttatactccatgtatttagtcaatagcaagatattaataatttacattttgtcatttttcctaatacagcatatatttattggaaacctattataaaaacaggtactatgctaggctccagagatacaaatagtatgcagaaaagacatggaaactttgatttgacagatcttatagactagagatagatatggacattaatcaaatagccatacaaaataaatacagaattacaaactgcatttactgtcctaaaagtaatggtggtttctgaaaaagtctggaaattagagaaaacattcccaagaaagcaacatttttgaggcgatttggtagaagttaacaaattattaaagagcgcttttccctttaaagtcattttaaactaatatattagttgctttaagtaatttctttaaatagtaaaaggttttcatcattaaaaagcagtaagacatcaactatgtgataaaaagctattttagtttcaaaaactgccaataattcagatcttttaagaaattatcttcccatacagtttcctaaaaagttagctgtttccaggaacttgggggtagtgacaacagcgtgcgactactaatgggtactgaaattattttgggagtgaaggaaatgttctaaaattagaaaatggtgttagttttaaaactcatgaatatgctaaaaagcattcaattgtacactttaaaacagtgaattttatgtatgtaaattatatcccaattttttaattggggtacaaaatgagtcacatagtatcatacattaactgtctatgccctccaaaactattactagtagtagaatttgtatgtggtaacatggaagatctattcaaggatatagctgttcataggactttgtcatagaatgactctttctgtaggatcacactctctgatggagaaaacagctcacagagcactgagggatgaaggtgatggcttcctagccagggaaatctaatgaatgaatccaggcaatcagtgagatgacaggtgtagaagcttacatcctaacatgacttattgagtcattaaaatggtttataagccactgattaccacactgatatggaattttttttttttagtattaaaaagaagtgtgaaatttaaacaaagtcaattcacatgtaatggagcattattggaggcttatcatttaaggcagttaaacaaaatgaattatgtgttgttataggggagacataaaaagacatgaagggaatggctggatagttaggtatttttactaagatcaaatttttgaacaaaagaaacaaacagtagtaattttaattttaaagtcaatactggtaatagtagctgtctgaattcaaattcatatcacagactttaagggttaggaaagccttctcttaaaaaatgctccatgagagatatagctttcaaacatattctatactaggatttatgatttgtgacattcaatcaggctatatcaatgcataagtaatttactagaaatatactagcagttttgtaaggtacagcagttctttcaaactgaaagagtcacaggccacatctagtaaattattgatttaatatatcacattgctcttttgtgacctgcaagaagtcatcacttttaaaagtacctaacttgctttctgtgaataatttatacattatataataattttcattacagagtatatttgataataaattatgcattacacaagtgaagagacagatgtgaaattgcaagtagcttaaggctatgttgcctgtattataatgtctctaagatacctgaacattcaagtagcatttctcccacataaatgttttgaaatttcttctaattcactcagtgataagtttcttcttttcttcttctgctcctcctcctcctccttcttcttttcttcttctattcttctgtcttgctccttcatcccacatacatacccctgctcaaagtggtattttcagtggatgattggataccttaaaacctggtggtgtgatggtctgatttctccagaaatatcacatctgtctactgtatcattgcatacataattcatgggtaaaacaagaatatatgtaatatagttggatcatggacacattttacttatacaaatcaaatgaaacaaattcagccaaaagataatttttttaaattaaacaaatagaagaataaagaacaagaaaactaagaaactgtgtgaataaaacttcactcactaaataagcatattccttagactgataagatattagcatgtgtatttgtctgtttgcattactataaaggagtacctgaaactgggtaatttaggaagaaaagaggtttaattggctcacattctgcaggctgtacaggaaatgtggtctgccatgcttctagtgagggtctcagaaggcttccaatcatggtggaaggtgaagggggattagacacatcacatggcaagagaggaagcaagagagagagggggaaggtgctacatggttaaacaaccatatcttgggagaactcactcactatcgcaaggatagcaccaagccattcatgagggattttcccccatgacccaaacacctcctacctggccccacctccaatattgaggattacattccaacatgagatttgaagtggacaaacatccaaacactatcattctgcccctggcccctcatatcttatatccttctcacattgaaaaatacaatcatcccctgctaatagttctcaaaagtcttaaatcattccagcatgaaatccaaagtcataagttccatctgagactcatgcacttccacccatcagcctataaaatcaaaacaagttatttactcccaagatacaatagtagtgcaggcattgggtaaacattcccattccaaaagtgataaattggcccaaagaaagggtcaatattctccacacaagtctgaaacccaacagagcaatcattaaatcttaaagttccaaaataatcttctttcactccatgtcccacattcttgtgtgaggggtggactcccaaggccttgggcagccccgcctctatggctttgcagggtgcagctcatgtggctgctctcaaaggtttgagttgagtgcttgcagcttttccaggcagaggtgcaagctgctagtgcctctgccattatagggtctggagggtggtggcctacttcccacaactccataaggtagtgccttggtggggactttgtgtgggttctacaatcccacatttccccttggcattgcactagtagagtttctctgtggggctccaaccctatagcaggcttctgcctgggcacccgggattttctatacattctctgacatttaggcagaagttgacaagcgtccttcacacttgcattatgagcatctgcagacctaacaccatgtgaaaactgccaaggattatggcttgcactttacagagctgtggcctgagctgtacctggacccctttgagccaaggctgaagccagagtggctgggatgcagggagcagcctcccaaggcaggcagcagggccatgggcctggtacaggaaactattattttttcctaagcctctgggcctgtgatgatagaggctgcctgaaagatctctgaaataccttcaaaaccttttccccattgtcttggatattagcacttggctcccttttactcattctaatttctctagcaagtgattgctccacaagcctgcttgtatcccactcctgaaaatgcattttttctttcctgccacatggcttggctgtgaatttttcaaacgtttacactctacttcccttctaaatataagctccaactttaagtcatgtctttgctcctgtagctaactatagtgatgtacgatattttcttctccaacactttgaaagccgtgaatctctggccagcgacaccccacctgggcctcactgggccacgctgatgtgtcccagcttgcctttgttatagtttgtactcgcagttggtagttccctagctcttgtactgaacccaagaaggaggatattctggacattgaagggtgaggagggtgaagacgaattttattgagcaacagaacagctctcagtggagaggggatgcaggaggtggtaccccaatctcacagtcgggcagttctctcctctgtgcatagctgggtctggggctttttatggcctcagcataggggaggggcaggctgtaggtactattggaaaaggcagcattcgattgggtaaaagacattatttagaaagaatcaattaggaaagggcaggcgaacaggaacagaagttctcactctgggtcgcgggtttcatccaggaccagcagtctggtctttcagccttcaagctgttttttgcttgaaggtggggtttcaccacggacccacccctatcttcttgggcatttggctgcctcctgccgctctcagtaggttgttagaagtagccaggccacctcttgaacggtttgctgcttagaaatttcttctgccagatacccaaagacatcactcttaactttaagtttgcacagatctctaggacatgtactaggacatgaacacaatgcagccaaattctttgctagagaataatacaggtgacctttgctccaattcccaatgacttcctcatttccatcggagaccttgtcaacttagacttcactgtccatatttctaccagcatttttgtcacaaccatttatgtagtttctaagaaactccaaacttttccttatctttctatcttctgaggcctcaaaactctttgaacctttgcccattacccatttctaaagccatttctacatttccaggtatccttatagtaacaccccactccttgtgtattagcccgttttcacactgctgataaagacatacccaagactgggcaatttacaaaggaaagaggtttattggacttatagttccacatggctgggtaggcctcacgatcatggtggaaggtaaggaggagcaagtcacattttacgtggacggctgcagggctgcaggcaaagagagagagagagctagtgcaggggaacgcctctttttaaaatcatcagatcctgtgagacttattccctatcacaagaacagcacgggaaagccttgaccccatgattcagtgacctcccaccaggttctttttacaccacatgggaatttaagatgagatttggctggggacacagccaaaccatatcagcttgataggaattttctagtcaaattttgctttcaatttgttagtctgtttgtattactataaaggaatattcgagactaggttatttataaagaaaataaatttaattggctcgtggattttcaggatgtacaagaagcatggcttcaccatctgcttctggtgagggcctcagaaagcttgcaatccttgcagaaggcaaagcgggagcaggtatgttacatggcaagatagagaatgagagagagaatggggaggtgccatatacctttaaatgaccagatctcaggagaacacactcactattgctaggacagcaccaagacattcatgagggatctgtccccatgacccaaagacttcccaccagaccccaccaccaacactggagattacatttcaatatgagatttgaggggggcatggcaccaacattcaaactatatcagcatggatttgctactatgggcttggtattagacatgggtttgctattccctcaatagaacccagaatccatatagcagtcatattataagcatcttaccattggatatatttctaatgtttaaagatacatatctttcacatagtattgcccccaaatgtaaagcacagcaatcaagcaaagaacaagcaatttccatcgcagaaagaaaaaaaataggcttatatggatttattgaaagagggtgtatctggattctgtactaaatttaagtaattttttctgagataatttcaaccaaatgaaatgtttatgttatatgctgactacagaacattattttatagtagcctggtcttgcagatatggttcatttaataatccaacagatatttatggagagcctactatgtacagacactgtcctgagaagagaagagaagagaaatatgataagtcttatgttttagaaaaattgctaccagtggtatgaacttgtggtgatgagtggagctgagagtcaaagagcacatgcagaaattgatgggagtctggactgtgacagttatagaggcagaggtgatagagaagctgataaatcacataaggttatgagcaacaaattgattctttgttggacgccaagagtcagggagagcaaatctagaataatggcaatttataagtaggctaagtttgacattttcagtctctaaattattgggttctataggcatacataaaacacagttctttggtacagcaaaattacaattaattattatcaattacataaacattaaaattattaccaaaaaacccccacattttagaatcatcactttggccttttgcaaagtatgttcttaaggaggcaggtcctgtgagatattacatgtaaaaaaatttttcatggtcaaataagtttgtgagaaatagcatgatattccctaaaacttactaaagtctcaagtccttcatttgtatttcccacacttacttaatgatagaaccatgtcttcttaaattcaaatgttctacaaacatgctattaaaaatatagatttaggccgggcgtggtggctcccgcctataatcccagcactctaagaggccaaggcagatgggtaacctgaggtcaggagttcaagaccagcctggctgacatggtaaaaccccatccctactaataatacaaaaattagcttggcgtggtagtgcatggctgtaattccagctactctggaggctgaggtaggagaatctcttgaacctgggaggtggaggttgcagcaagccaagatgatatcattgcactccagcctgggcaacaaaagcaaaacttggtctcaaaaaataaaaataaaaataaattaaaaaatgcaaatatggatttattaactacataagttataatcaggagcagtgggttcttatgtttaatgcattacaaagaatataggcttttaagagaaacaacagccaatttgacaaaaggtccacaggtatatgtggcatatgtcaaatagcaaaaataagaatagaacccaaaggtctgacttgcttttatcttcaaccagttgttaagagccagaaagataaaagctgcccttttctccattagccaataagatgacattaaaacagaaagtaagaatataaaaagcttctggagaccaatattaggagaatctgtgaagttggcctgacttattattccatttatataaatattaggttcgtgcaaaagtaattgcagtttttgccattaacagtaatgcccaaaaccgcaattacttttgcaccaacctaaggtaaaacaaattacaatagatgtgtatctcagagcatagttaattttcccttatttataataacacactgcataattatcactcactataatattctgtgttattgactataaattaggccacgctgtaggcactcatcagaataaacataaaattatgtttacaagtacaaataacagaatctaacataatattaccataaggacatgtgattaaattacaacctcatagtatatttgtagtttaaaagagccttcatatttctaaatatgatttttaataaaagctgtcctaaatgtcagttatacaaaataaaatatgtaaaacaaattctggctgtcagacacgtgttaatgtaggatggcacaatgttcatgactaagttacagaactgaacttgagttagaagtttccatttctatcatacttcccaaatataaaaataagagtttaatagtttttgtcacattcattcaaagtattataattttaattctggagcaccttaaaatcagaaagaaaattaacataagacatactgcccattcttgaatgattctctcatcagtagcattatcagttgaatgaagttatcagtgctgaaataagaataacacctgactgctctaatctcagacaataatgagtgatgagaggggtgcatctttggttattataatcactgtcaatttgttgttttttctagataattctaattttagtgtgtttaattctaactattacctttttatagaacattaaagaaaaaaggcagaatattcatcactcaacgcaatacaacgtactgtttgtgttgtgtgtgttttaactatactgtattgctctattttaaaactttgatcaataattaattacaaatttttactttttcaaactgtcataactcttctggaggtacctaattcatccctgcatgcagtgctctttaaaaggaaaatcaggcattaacttcaataaattcccagtataaaacctacacctatctatttctaatctccttttctcaagtcacagaggtaagccactactgatatctaatgggaatcactccacttttgtttttgatcttatttctaggtcaatgctgattttccttgtgtaatgattccttcctccctattaaatcgacaaagaacactcattcaactttgcatctccaaactactttatacattcccctccaatttatagtcataattcttgttacttttgtatttgtttatataccacttactctccatccatctataatctagcctcccccacttgccccctccccactctagttcgggggttggcaaacttcttctgtaaaggaccagatactattttgggctttgctggccacatatatctttgttgaatattcttctgtagtttttgttttgtttgtaactctttaaaaatataaaaacctttcttggtccacaggctggatttggcctgctggctataacttgcagagagctgctccagttgaaactactctattaatagcaccaaaaaacctccttttggtgtttgaggggaataataaattgtactctgtccttcctgcaaaacttcaaaggaaatcaaacgatcagctttaatactgatgaaatatgagtggcagtgacaacaggcttcctactagctgtcggcaacaggctcagccctaccctcagaaggcgccctaaaaaacctacagtgtagaagagcacaccagacagtgtgctctgcaagaaggatggctcctaatctgaaaaaaggtacaagttcctgtccagggctcaccaatcaggaaactcattctgactccaagggtgaaggagcagggccagatggcaaggtgttaaaaaaaaaaaaaaaaaaaaatccctcttcctgcaaacttacacctggggcagaaaaactccactcttacactccagattgccaagtcaacccagacttcttttgcatttattaatcactttgcaacatttacctctttgaacacttgtttttcattgaaactcttctcccttgacccccaggataataatttctctgtagctacccaatctttatctgattttaaacctttggtgtctcctagaacctcctctttgcccatcttttctcattctacatacttttcagagtgatcttattcgcttaaagaataccagttaccatccgtatgctttcggtactaaatctccatttatctcaggtctctcttgagttctagaactatgaatcctaatgcatcccctgtcttgtgaataacaggacccccatatacagtttatcagaaacattgttttcaccctcatcttttttttaacataccacattgggcctgaggtagccaataagtctgcctcaaggcacaatcaacaactcctgtgatttcaaagtaaattatatatgcagataaagattgatgagaaaatagaatacttagatgagtgggtgaatgtatttgtacagccatccatgtctcacacataatcagtgttgaatctgagtagaattccaaagcctgccagcaagtaaaacaatttcccacttgcatatgtattttatcattattataaaaatgattaatttcacactcatcacaaatgaaaggtgggccaccattatatttctaggtaacaccattataacattatattacatactttgtttctgagaacagtaaatttgaatacttataaagttttgtttgtacacttttttatttttcaaatatttaacactagaggatcttattataagatgcaaataaattatacaccttaaattccattagccatatattttttatatgaagaagataaccatggtatgaattttttaaaacttttttctaaaaatgatatttttgccattttttcctagcgccctgtggaagtcgttcaacaggttcagaaggcactgttctatcaccaaactatccaaaaaattacagtgtgggacataattgtgtttattctatagcagttccaaaggagtttggtaagtaagattcgactcattatgtagtatttcatccagacatgctttatttttcactacatgctattcaaaaattttaaatgaaaatacgtgctatccataaagtattttactatgcaattctttttagatagtgattttgtaataatacaattttgaggtcatcttactcaatctgaatttacagtcaagtacacaggtgaacaacaatacaaaaatgaaaacaggattgtttttaatttttaaaaatgagtatatcagtaaccttgcaagtgccttcatattggaattttataaaatgggaaattaccagagcataaagccaaggctgctctgtaaaatatgtattaagtcaaatattgaactattacaatagtaacaaaagtatttacaaagcaatcatatcaattttatagtttattaacacatttccagaaagaagagtttttggttttaagcatctagtttctggggcagcaataaatataaaaagacagcaaaggacatttcagctcatcttgtcaacctgacaatctgttctgcattggcactaagaagacaatgtgtcctttgctgccttcacatctttctgatcacacgtcttagaagtcacttatctggcttttaaaggttttggttctgagatccagctggagctaacctagattaagttctgttcacagatggataggcaagggaaatttagagagcagtaaagtgtgagagagaggctgaaagttcacagacttctaaaatttagatttacagcattgtgttacatagtaaaggatttgttataactatgaggaatgtctgggcctggatgactcagtatatcagcagaaggacatggattttatcattagagatagctgaatagcatcttgacttaacatttctgctgctgagatataaaataagctgatgcttccagtccaatttcttataaccagatactacctatatatcctccttttcatccttctgaaacaagtccaagatcttcaacttatttgagagtactgtcatcagaaatgtagtactaaaccttttattttaacattgaaatagagtgatgatgccagcattagcaaagtgtctgtttttgtactctacaaagtatttctttcccctaacatattgatcggttgaatcaaaggttaggtctttgatagtgaagaaaacgacagtttagaaagaaaaatatcattcacttaactgtgtttattttttgccttttgagtccttcctttgctagagagttttatgctccccagatgcaaaaaaatgttacatggttgctgacagaatcctaacaatgattatccagaaaacttcatggctctctgagtcctcttcggaagccattaatttatcgtattatactctgttcttgggaggccatgtggccaaatgaatgagaaagaggaaaattagccatttaatgtcctgacaaatagacatgctggtcatcctggagatgtattactgtagcctatgtatgctcaaaaagagaaagaaaaagtactaattgaaataaaagtaaattaacagattcctaaagaatgaaatctatagttttgtagggttaatataagttgaatttaatcctcttaatataaaaaaactgctacgttgagccaataatagttggtttttaaaactgttttttttaaatgaatcttcttgttttttttgtggacaaaacaaagtgtactttgatttattagtaaaaaactaattttattttacaaatgttgcatcattcttcattttaagttacatatatatttaagcacctgtattctaatttcagccttgtcacatgttagctatctgcccttggacaagttacgtaatctctttgagactgcctctttatttgtaaatttggtatcattttgtttatagattagagatgtgagcagtaaatgagatatatatattatatacatatatatacatgtgaagtatgtctaacatacttcatgcttaatatcattgggttaacgaatgccagctttcaagtcagatttctgggttcaggctcaacttaacttacttgctattttcattggacaagtcccattgtcagcctgaaccctacacatctctaaagtagcaatgataaatacctaccttatgtggttattttataataatttgatgtatgtgagtgattggcgtaataacatagtaagtcacatgcatacacaagtacacatatacacattcttctttatgttcacattcatataaaacttcccctatcccctcttccacccccgaaaaaggttaaattaaatgacatgcattattggattgaactaaggtcttaaaaatagcatggttaaaataaaacaattatttgtgttatttagttaaagcatgaaaacaaatattttgggttttatatcccagtgactattcaatcatctaatgatcccgtacaattttctgggagtaggataatggtagtaaacaaatactgactgttgacttcttcgtattaccttcctttacctctttgatgacagatggtcaagcagtagttactggatctctacaaatcagatttctattttgcttctgcttcctctcattctcactttgccataatttttttctgttgccacgttgagctatatttattacttttcagtattacttcatcacatatcacttctcacatttttttctttttctgtcatttatcccaaattatgatcattccttcttctatatgtttcatatacagatgctcttagaacatgacttttacatcgtttagcacagggattcctaacccctgggctatggactggtactggtccttggcctgttaggaactgggccgcacagcaggaagtgagtggcaggtgagctatcattactgcctgagctccacctcctgtcagataagctgtggcgttagattcccataggagtgcaaaccctgttgtgaactgtacatgtgagggatctaggttgtgcgctccttatcagaacctaactaatgcctgatgatctgaagtggatcatcctgaaaccatcccatgggaagattgtctttcacaaaacctgtccctcgtgccaaaaaggttgggaaccactgatttagcacgtctgtcaaatacactcagtgcattcattggattgcattttacataggggttaaggctctaacatccttatgtaaaaagaaaatcacatataaccaacattacacatgaaaataaattaaatcacccatgaaagatcatctacatgattttacatatgccatattgtctctgaaatagtctaacagaacatttttattccttcaatgtaagaacagatgacagttttcagataattccacatgaactacttgtgtttcttacaggtcatgtggtaccaaattacttttttttttttttttttttttgcctggtgtagaattaaatgcctgtaagttatttttgccattacttttaatggcaaaaaccacaattacttttacaccaacctaataaatatgtgcataatattacttcgctttactggttgattgagtaaatactctttgtcagtcaattgccatcttttagtttttataaataagacaaatgtcaattcataatgttttcatgagcatcactgaatttcatttgaattcaggtattggggtcagattttggaaatattcatcctgcaggattctacttgttttattactctcagaaaaataacagttctggatcaattagatagaatttattaatattttactctccttattctacatataagactaatacatttggctttttggatttaaaaaatcctacttatctatcaataaaatatatttaatttttcttcatttttcaatgcttaatcaccagttgttttttcttatggtttagttgcctaagactttatgaattatatttaagtgtcagaaacatggaagaccaattttattttacttttcatttcgtatagataacatgctttagaatgtaagagaactgttaacattgtcagagggaaaattttttgttaatatgtattatacctagagtataggagtccaaataagatttcggggagggaggaattagtaaaatttgggaataaatgtgtagatttctattttaacaatcctggctgagaagaaacataaatatataggatgacagtcaaagtagagtataaatcagcaggtaatgtttggtttttgtttattttctcttactccagcagatactggggtatttattttaaagcccaaagagaaagacacagtagagaagacaaagctgaagatatgaggtggatcaattggtaaaaaaaaaaaaaaaaaaaaaatactttaggcaattggaggagatgaaattttaaaaacagagggaagacctctttataattcagaagaaataatttgcaattagcaacaaaatatctggattaatttcacatgaaatattgaaatattcacatgaaatattgttggaattatcattccttcctattctcccacctctatctctcttcagtcatcctcttcttactttctaggaattatctgtaaaagaggatgtattcatgtcctaaggctactataacaaagtatcacaggcttagtggcttcattttattctctcacagttctagagactggatgcctgaaatcaatgtgtcagtaatgccacacttcctctggcggctctagagaagcatccttcattgcttcttcctagtttctggtgactcccagcaagccttgaggttcctgggcttatagctggtttactccaatctctgacgtcatcttcacaagaccgtttctcctaactgtctgtttctgtgtgtctgtctgttttttcttgctcttataatgacaccacctattggatttagggcccactctactccaatatgatatcatcttgatccttaactaatcacatctgcaaaatccctgtttccagatatggtgacattccgggcttcttggtgaacataaattttggggaacactattcaatccactataaagggtgaactatatatatacataattttatgtagaaaatcttaatataagttgctgtataaagcacgcatcagctgtgtggactgcaaactgacattcagatttcttggaaaattccaacatgtaaaacatcctgaggatatccagtatagtcgatggtgacttaatttcatgtttagcattccagatagctctacctcctagaagacacaccccgaagacatatttgttagtgtacagagcttattctttcccgactagttttcacacttggtatgttcaaaatgggcataaaaaccttacatttgccccagtaatctgccttctcacctatcttttattattggcacagtctcttggttgcatgtttcaaatgtatgaatccctaaatcatctgaagtaattgtcaatctagtctactatgtgcaaatggcacacagagttaccaaacccttttgcatattgctgtaggagaggctttttaaaaaagtagctgccactgccttgaacttcttttctactttaatgtattttgtttatttcttattcacaaccactatctttcttatttctcattgaagtatttttattccagttaatctagaaacatctttccttaggatattactcacattataagattataattttttaaaaaatatagctctattatagtattatgttaaaacagtgataagtagcaactatttcattaatttttattatattcactaaatgtattttattttgggctgatagacttaggtaattacatagtggttattaagtgtgatttgtttttgcaatatcacatctttcacatttctgcataaattgttaacctgtaaatggtaatctgagaatttaggtattcttgtaattcagaagaaaaaagtaaaacaatggattgaaaataagatgcatacatactatctctaaatgtatacatatatgtttttccattgggcatctggacttttaaatacatgctaatgtagttttgacttggatatgtattaatgaattattctcatcttttatgttaaaaataatagcagttcattttgtgtatatttttccttaaaattcacacatatatttgaccatttactctttggtcttatgtctgtgagttttttttaacaattcagcaacacagtctatgttgtggttacctctttttatgcttaattcaatcatttattgccaccaattttctccatattttagggacagattgtttttagattacttttgtttgcttgttcaatcagtaaaccattttattggcattttattttccccagtatgaaattttcagtaatgaatgaatacttaagaagatcaataaaggcttttatgtattttttacttaaagtatatgacacttcactttttaacagtacaattgcattaaaaccaattattactcttttttaaatactgaatttatctaacaatgacacatattcacaatatgtgtgtttattcaaaacttgcgtttactatttgtcattactttttagatttggagcaatcgaaaagaacagggaactctttttttttttttttgagatggtgtctccctctgcttcccaggctgcagtgcagtggtgccatctcggctcactgcaaccttcgcctcctgggttcaagtgattgtcctgcctcagcctcccaagtggctgggattataggcgcccaccaccacatccagctaatttttgtatttttagtagagatgaggtttcaccatgttggccaggctgatctcaaactcctgacctcaggtgatctacccacctgggccttccaacatgctgggattacatgtgtgaaccgccacacccagcctctttttttctaactgatggttgttttaatgtaaattagcagaaattactatgttatttgtgtgcctataagaaaggaaacccctattttttaagcctatcattttagagaagggaaatatgattatcatgtgtgcttatgattatattatttaatttggagggtataatttatataattagatctcaagccatggcttggccatttggttgaacatgatctgcctctcaccccacctacatttcaaagactgttgaaaacccatgggtagcgaggtaaggctgtgggccacagtattctatcccataaaaggcaaaggctgagaggctgttaaaacaggcactaaacagaacatatgattcaaatcagtgataatagaatatttactatctgataattggatggagtcagtaatttcaatagtattgattttgaggcctttaatatgtgagacgacagaatgaaagttgcagtaattcaccacgagggggcattaattttttccaggcttaaaagcagctaaaataggctactaaatggagacacagtggggataatcaccccttctctaaatactttttctaaaatgggttttaatgtttaaaggccctatgttattttacactgggctatattaactaacttttaactgaagataaaagtccatagagtcctaatttgtcaagcctattgtaagtgccaaagactttatttaattttactacctttttggtcagagcttccatgaccactgtgggatatttaggtaaggcaataacgctgatgattaaaatgaggcatacttctttgttcaccattttatatttcatatctcctttagattatagggtgtgccttattgaaatttagtgggatccccaggaataactgtatctgagcctctgtatagattaaggccatgaaggtttgctaagtggtgcatctcagtagatgttgcacttaatttagaacccatattgtagagacataaaaaccaatcagagacatttcatatttttacattataagtttttgtgtaaattttggatttccagttgggtcaaattgtggatccttctcttttaattttgtatttcttcaacctgtatgtagtttattgttgttttcatttctgctttaagggttactatatgtaacttcagaggagggaaggtctccttaccctacttatattaattattaatcataattatttcataattaataaatttcttcctccaaagtatctcaaattagtaacttcaaggttagaaacaatggttgctttataaggtttaagaactctgggtttattttaagttttcatcaactcatcagttgttccacataggtgccatatgtgttttcctctaaagcctgaggattagattctttgttacaacagagacctggatagcaatatcagcaaaggcaattttttttttttttttttttgaaacagagtctcgctctgtcgcccaggctggagtgcagtggcaagatctcggctcactgcaagctctgcctcctgggttcactccattcttctgcctcagcctcctgagtagctgggactacaggtgcctgccaccacgcccacctaattttttttgtatttttagtagagacgaggtttcaccgtgttagccaggatggtctcgatctcctgacctcgtgatctgcccgcctcggcctcccaaagtgctgggattacaggcatgagccacctcgcccagccagcaaaggcattttatagggttttagtgagtcatcttcttttaggaggttagaactcagcacaccatatggtagctcttctttctcacaatccaccatccagtgagcccatgtattgcacagggtatcaatattttccctgggtcttctctagaaaaggggccggtgactgcttgacacacacaaccaatagccacacagtaagagttgtttctctgaacttaacattagtcacagtttttgctggaatcaagatatgtgattcattataaagtacacagataagtccaggctacaacatacaacagggtcactttgatgaggacccaacccttggttctaaatgccagttattaaaagatctgatgtagattggttaaaactgtgataacttggaaaaactcagaaaatgcagcacaaagcagcatagctctaagtgcaagtttgccagcagacagcagagccagttaccaagagaaaacaagagaagaaagacctctagtggttgtagtcatcacttagacatcttcctcattgcattcattgttgtagtcactctgcagttggtttggacttctttttttctctttctttgagacagagtcttactctgttgcccaggctggattgcagtggcatgacctcggctcactgcaacctctgcctcttgggttcaagtgattctcttgtctcagcctgctgagtagctgggattacaggtatgtgccaccacacccagctaatttttgtatttttagtagagatggggtttttccactttgatcaggctagtcttgaactcctgaccttgtgatctgcccaccttggccttggcctcccaaaatgctgggattacaggtgggagccactgcgcccagccctggtttggatttcaagactgataccacacaagcacaaggaagtatgaaaagccgtgttactcacaaaatgagactttctagggagagcaaggcaaactgccaagcagtttcaaaatgcgtgagagagcagagaagggagattgactgtggagttttattgtgattatggagtagcagtggggtgagagtttctgtgtacaggtgagtgcttgcatgatttaaacttaccactggtggcaaagaggcagcactcaggtgacctaatcagcttgcccagatatgaggcagaggggaaggaggagtggtggggcttgaaagttgtcaacagttaaacattaaaaatgattttacatgttttaatataagctgtaatttatacgtgtgtatcatatatatagtcatatatatctttctgttgttattatattatctttccattttaagcaaagttatttcctttcaacttgcaagaatttcactataatatgctctagaatgggattagctgaattttcaaaataactgtcaaataatcgattagattcatatgatggttatctattcacattcattgtgtataagtgccgatgtttatgtttcatatttctgctgctgtaaggcagttatagaaaataagttatgcttaataattcagaagaaagctgaaaaatatagtgcaggaacatgaagctagacattttacaacaatttgtttaaacagtggttatgacatttcaacatattagtactttccccatttatggttgtttttagtttttgcttcattttaccaatgtgataagttctgcagttgtcctgttaggctatttcataccaggtggcataaagctgccgaagattattttgacatgaggttcaatgtcataaagtcaatgatggtaacaattgtaaactgaagagaagattgagcggttactgcgaaatagtgggaaacaaggtgaactggggatccaaaggtctggattgcagtcgtttgcctctaattggccatgtgactttaagcaaattacttaagctttctggtcctcattttcttgatatataaaataaaaacttttgtccccaagggacttcctagtttaaaaaataggtgaaatctacttttgaatttaaagagtatgctactggaagctagagaattaaagtatgggaaagttgcaccaaaaatctgcttacagaagtacatggattcatataatttcattaaattccaaagataactataaatttaacctaaattctgaatcttttattattctgcaaaagtaagattagttatataacaatggcatgctacattcttctctgtaattttctttcttcttttctcttttttaatgcatcggaatatccgtgatggtcagttttaactttctcactcttatcattaaagtgtaataaatacctccaagataactttgcatttttcaattcattacaaatgctagaaaattgactttctactttgtttccctgctggtatttaggcacaaaataattccttgaatgagcctgaatattcatatagagagtaaacatttcttgcaaagtttcactataaaattgttggtcttctctttaagatgttgatatgggaaaatatttgaaataataaaaagaaaaaagttatacatatatattaatatagatgcattactttttctggaaaactttttatggagaagtcattacatacagccttttttagtatttcattattctgtcatgcagaatcacatttgtaatatttcataccatgacagattaaagctagaagataaatgatttataaaagcacacagcatgccacaggcggagtcttttgtaaacaaggaatagtcatcatttctgacactatcccactgatgttttaggatagtataacgatctctaattgtttaacactgcaatgcaatgctgattataattaaaacacacatgtttggtgtttttttctgttttggtgactcatatgatttaattacctactttagacttaacaaaggctaacatttgcattttgaaataatgtatttgaaaactcaataaattatatttcaaataggttagaagattgatagtgcttattttgtgcttggtatacaaacatatggtgcacatcacacactaaaaatctgtgattccagtctctgagttagagggatttgaatagtattctcttataactttataaacccttaacatttcaacctagcggcttttgctgagaagcagaaactcgaacagagatttaactggaatattttccaaattcactgaagctgtggtttatactaaaataccagactaactatcaaagtttcatctattatactgcttattttagcaatattttatataacaaatgtttttcaatcttctataatatttattttattgtaacagagtttgcccattaaaattcaaattaaaatctttcattcaatggtagataacataaatgaaatcaatatctggacagagatcatatgggatggtgggtgcagtggtgaactaaaaaatccatgccttcttgaaggtagtttaattctataacatttaaaacacagtatggactaaataaaactcagctgtagattgaatttgactttcaatctagtatgtttgctgttcttagtgtaggggtatggaaacttcatgctgctttctcttttacttaacccctttgcttctccttactatctctaaatttgtagaaatgtgctataaataattctaacctcattgtgggtaaagatctatattatattgcttgtaagtggcaattattcactaatttgctcaattatttatttacactgtgtgtatacatccagccttgagctagaatctgaatgttcaggttatgtaaacaatggttcctgccctctaggagatcacaggaaaaggaattagaaaattaaacagtttattcaggaagaatgtggaaactgctataaactacgatgtgggaaactaccgtttgtaagcatgctatgggtaaacagaggaggaacagctaaggcaggctggtggctgatttgagaaatggggataaccgtgacagaaacattgatctgatgagatggcacatgacctaagtcttaatgaatgtgtaattgttagctggagaaggacattccagccaaaaagaacaacacaaggaaagatgtagagatatggcatatgttttctgaaagggactatatatttttatctctagttgaagagcaaagtactagtcaggaactaatatgcttgaaactggtaaagaaggcagagaccagattatgaagtgcctggtatgccatgttaaatcaattcaacaaatgcttattgtgttctcactttgcttcagagaattatttgctaggctgaggctacctaatgcccaatgaaacagaaatgcttaattgttcttgttagtatattgtctaattgagtagtcagataacccagggataatattcacctggtacttaagggcacaacaattttcagttgttagaattttgaaacatttacatgtactgacaaatagccacttttccaatctctaaaattgctccataattctctggccgctggcccttccccagcctagcaacacttttgactcttctgtacccacgtcatactgattaaatattttgagaattaccttgtaaacataattgaataaaccccccccccccacacacacacacaacacacacacaattatgagcacaaatttggctagtgagcatgaagggtgaggaaaaaaaacccaaagtataatgagaaaggataacaggaggatcaaatttagattagggagatgagtgaaaactgcagtatgctgaaaatcgaaggatgagaaggaggttgaaatgtatctcctgtaccatagtaactaattaagctattttgcaggggattaacaaaacccgttggacattttagttaatattatttgtggcagggagagagtggttgtttcagaggtatggatgagaaacaatgaggggattaatttaggcagtggagaagggaggaagcattcattgtttgtagaagatagtagggatgagtgagatctgtgtatgtgcctgagtatgtgtgtatgtcaatattctagtgtaattcatggtctctaatgatggcagcaggcacatgagtagaaaggagcaagtgatattacaaagaccttgagaactgctgtcaaagcccttcctgatgtctagacttgagatatgaattcagtgtccaatcaccagctttgcagtttcagaaattcagtgttgtcagctacctcagaaagtattcacacttcaggagacaggttcacattgttttccactcatcaaacccaaagggactgatttataaatcacaataccaatttccaactctttttgtgagagaatatctggcaagcttggcagtcttggccttttgcctagaacgcttcatgttggtggaaataactactccttggacaaaagcatataattactttaaaaattatagtcacaagcttattgacatttaaggataccaggaagtagtgtgatgtactaatgaaaagtttatttcaaactactacagctggaagaaatgttcttatctactctagagacatttctttatttagaattcactaaaccaactttacccaagactttgggagggtaaactaacatatctgggtgagaggacagggacataaagtccagcaaaatttggaaacatggggtttaaaaaatattttaggcttattttctctaaggatgctaagtgtctttaataagccaatatggatattttctctatctctgtttctctgtgtgtgtgtgggtgtgagtgtgtgtgtgtgtacgtatttgaaggggactgtctttacaaagttgcagctcaatgaaaatactgcgctaatatgtcatctctttgtgatcaaaggttgtatttttttattattgaaaaaataaaagagcttgacaattttttgcacattaaaacaaatctcaatatgtatttactgaaaatgcaaacaattgaattaatcaatgaattaagtaatcctttatcctgggtgaggaggacattttctatgtttcttccagatacttatttaccatatttatttaccaaggtattagcttaatcattaaccaaatgtttgcttagttgatcactcctccattcttggaaaaaatgtgggtaagcatcaatcttgacacagtcctaagcatttagacattcatatgcagctgggagaagctagtccaggagttatcttacagccaagataaggagtatggagccacaaactctggactgacactttgagattagaaaggaatgaggaggcctaaatgcttcattttagcctcttcccagttcctcttcacctattccctgctcctaaattcctcaactttactctggcctggcattctctacattttagacatttagataaaactctggataagatgagaaattacatttcttgaacatttaaatttgtgatatgagaactgtatcatttcatataagagctttaaaagacatttctccgtagaattaactgaaatatcattctgcaggaaatatgggtcacagagcatgctgtaggattctagtagcattataccttttaagaattcagtttagactgtaaattcttgataaaattgtacaggcttactatttctgaacaatccagttctctcactcgcctgtgaattctcttcactccattccccatgcagggaaacttctatctagggtgttggtggtacaaaataaatagggcagaggaaaaactccatctgactagccaagcatgtgtccaattattttcaatattaatgcccacacctcccctttgaagcttgaatttgactgtgtcttctcttctgttacttctaaaatgaggtaggggcactagaattagaatcctatccgaagaaggatgcaaagtccaaggttctgtgggtagagggagaaaacattaatgaatgtcacataatattatctcatgacatataaatcagttttgtaaaagagatttatatttgaattttaatttggcctataatttctcaggaacacatccattttataattcatatttgactgataagttaatgtttgtatttatctttaatagctcttttgggtttctttgcatcatgtttgagtttgtaatcatatttcatgagggtttgtgtctagacatgtttgttcaaacctaaaacatgtaccctgcagtaaaaggacaaaatttatagctatataatctagctttcagtattaattatagaccttatgtgtaatctcatgtaagttatttattctttctgacatctcatctataaaaaagagataattatatctgacccaccctaaaccataacatttttgtaagtatcaacaagaaatgtaatagttatagcttttcaatattttgttttcttgttggttaattttaagaaatatgacattttagaaatatgattttaagtatattttgtactactaaacaggtattttttccatttattttctttagataataagcttcccctctcttcagaaagcacatttatgttttcttaatagtatttcatagaactatttatttctactcagtgcttattgcagttaattaatgaaacctgagttccacaaactgctgctactaagtttcctctgtctggtgattgcccttcacacctatttgctaaattctaaaacttaccaagttatctcccttcatttttgctgatttctgctataattttctgtggatttcctgtttgaaaaataaggtccacattcatagttcttacctacttataaagcatataattagatattttctttcagttctctactgctcatttttcttctataatatttcaaacataatccttttccacattttttttccggcttccaaattttgttttacatttactgaggaaattatgtgttgtctggatgtacttccaaataattccagtgtagaactcaggtggtcagagtatagggctagtgtggtttatatgaataaaactagaccattgataaataaaaaattttgctgtgttaattttttaatcagctgaacttccagcagcattttcaaaaatatgagacaaaaaataactataaaatttatgccttcctttttttttaaatcccagcttgcatcatctacagttgattgaggaattgccatgagacagttttcccactgaggcaacatgctgtgtaatctaagagctatgtgaagctctgtgaaactgagcaagtcacttgatgtctttgggtctcagtttcctcatctgtaaaatgagcacgttgaaaaaaaaatgctaggaaaatctttcactgtaaatttccctgacttaggcattgattatgctttgatttatttatttatttatttatttatttatttatttatttacttacttatttttataatttcaactcttattttagatttgggactacatgtgcagatttgttacatgagtatattaagtttgacactgaggcttggggtacaaataaccctgtcagccaggtactaaacataatacccaataggtagtttttcagctctggcttctcttcctctttgttcccatccttctgtccatgtgtacccactgctcaggtccaatttacaagtgagaacatgtggtatttggttttctcctcctacattaaattgcttaggataacggcctacagttgcatctatgttgcttcaaaggacatgatttccttctttttatggctgcatattattacatgatgtgtaagtaatacattttctttatttggtccaccattgatgaccacctaagttattccacatctttgctgttgtgaatagtactgtgatgaacatgaatgcatgtgtctctttggtagaacaatttattttcctttgggtatatacccagtaatgggattcctgggtcaaatggtagttgtgtttattggttggtttttttttttttaatatagggtctcactctgtcactcaggctcgagtgcagtgttgtgaatactgaccactgtagcctcgacctccttggctcaagtcattttcccacttcagcctcttgagtagctgagaccacagtcgtggtcattttaaatattttgtagagacacagtcactacaaaagatgctgagtccagttttttagatttttttttgtagagacagagtctcatcatgttgcccaggctagtctcaaattcctaggctcaagcaatcctcctgccttggcctcccaaagtgttgaaattacaggaatgagccactgtgcctatctaggtatttttaagttctttggaaaatctccaaactgttttccatagtggctgacctaatttacattcccaccaactgtatataggtgttccattttctcaacagcctcatcgatatctgttattttttaactttttaataataaccattctgactaatgtgagatggtatatcattatagtttggatttgcatttccctgatgactagtggtgttgagcattttttaaatattttgagaaatgcctgttcatgttatttgcccatgttttggtggagttattggttatttatttgttgcattatttaatttccttatagattatgagtgttagatctttgctgaatgcacggtttgtgaatattttttcccattctttaggttgtctgtgtactctgttgattgtttgtttgtttattgtctgttttctgtgcagaagctctttagtttaattacgtcttacttgtcaatttttgtttctgttgcaactgcttttgaggacttagtcatagattatttgctaaggccgatgtccagaatggtatttcctacattttcttttaggatttttatagtttgacgtcttacgtttaaatctttaatccatcttgagtgaattcttatatatggtcaaaggcaggagaccaattttattcttgttcaaatggctagccacttatcccagcaccaattattgattagagaattattttcccattgattattattgtcgactttggttgtagaagtacagctttatttctgggttttctattctgctccattggtctatgtgtctgtttttgtaccagtaccatgctgttttggttaccgtagccttataggagagtttgaagtcgggtaatgtgatgactctggctttgttgttttttgcttaggattgctttagctattcatgctcatttttggtttcgtatgaattttagaatattttttctaattctgtgaaaaatgacattggtacttttatgggaatagtgttcaatttgtagattgcttttggcaatatgaccattttaacaatattgacccttccaatctatgagcatggaatatttttccatttgtttgtgtcatctgtgacttatttcagcactattttgtagttctccttgtagagatctttcacccccttagttagattatttctaggtattttatttgttttgtggctattgtaaatgttatttcattcttgatttggctctcagcttgaacgttattggtgtataggaatgctacagatttttgtacattgattttgtatcctgagactttactgaagtcatttatcaggtctaggtacattttggcagagttcttggtgttttgtaggtgtatgatcatattattggcaaagagaggtaagttgacttcttttcctacttggattccttttatttctttctcttgcctgattgctctgactgggactttcagaactgtgttgggtaggggtggtgagaataagcatacttttgacctatggattgtattctgtttctcttgactaatctggaggttagtagaggtggattttcatcccagttctgccatttacttactggtaactttgataaagttacttgttcaagttttttcatttgaggaaataattgtccagcttcttgcctttttaccaagagtcaggaatctgatgagatataatttatttaaagcattgagcacagtacacgccatttgcaaaacgctcaattaattttaaccagtatttgcaataacatcatttaggccattgcttttctcttaactgtagttgatttgttttgtgattcttttcagtgtatttcatagatcagagttcagaaaacagttcagaattctacaaaatatttcaggaagatttttataatttgcagagaaggatggagtgtaggttagctgtgttagaatgtgtaggttagctgtttgagtgctcaattcagtaattaaagaaaaaatgcattatttaaataagcaacagatgagtgatgtaatcaaataatccattgctatgtgaaaactctgaaaacctgttatagagttaaattgtcattgaaaattccttaaaaaggcaataaaatattgtctattcaccagtaggtaggtacttctacatctttgaaaaggaagttacatctcttagattaaatagtcatttccctgtttttaaaagaaattttaaagaaacttaatcacagaactttactagcctagaacacctggtttcatttttgtctactctaaatttttttaatcaacatgtacacattttcagaaataatgtaaactagacatgaaaagttactattgtttttacatcaattattttattattcaattagggatcctcatattttcaggacactgtgtgttggtgtgatgtacatagtttaaatgtgtccccaccaacagcatagtataaactagaatccagtactgaataaaatatgtttcgaaaagtccaaagataggttgttttataactattctgattatttatattcaaggtcaattttgtagtttgctaagatttaaactatataacataaggaagtctgagatagattgtaaaacctcactttcttcctacctgggaatcttgaaggctttatggcagtatggtctggcagactgtatataaacagatcataaatcacagctggggagaatttcagtcactggttcagtggtggaaatgtaaaccaaatgaacagatgttatgggaaacgttagtatctaagcaaaacaataaattatctcaacctttgttttaaaaaaatctaaataataaatatctttacacaaaatgaaataaaacaccattaaatctacatttaaaaatctttggggccaggcgctgtggctcatgcctgtaatcccagcactttgggaggccgaggagggcagatcacctgaggtcaggagttcgagaccagcctgaccaatgtggagaaaacccgtctctactaaatgtacaaaattagccgggcatggtggcacatgcgtgtaatcccaggtacttgggaggctgaggcaggacaatcgcttgaacccgggaggcggaggttgcagtaagctgagaaggtgccattgcactccaccctgggcaacaagagcaaaactctgtctcaaaaaaaaaaaagagaagattatttgtacttataattgttaattttgtttactaacaatattaaaagaccatataatcagactcaaaaaagaaagtacatgtaaaaaaaacttttacttttaaatcatattgaatgcattttaaaaccttcaagaataatgctctattattttttcttttttttcatttcatgtttccatgatacttccataatcttttaaaaacacgtgccatttcctcttattttaaatatttttatgtgtgttctaaaaaatacaaagaattcacttttttaaagtcatttataacttcactatccagagataactactgttaacctttgtgctttttctctctggtattttgtatttaattgtaatgaaatagcaaatataaaatatccatcatttatatttaaatttgtagctacctgtattttaagtatttttgtttgctatcaaatatttttcatcatcatgatttttaatagttccataatatttttttcatcatatatttgtaccaatgtttatttaaccatttctataatgctagacattcaagttgcttcccttttgcaaatatcattgtaataaacatgtttatatatgtatttgatggcatctctgatttgtttctagactagattcctataagaggagtttccagatcagagagcatgcacatttttgaaattcttgatacatattttaaagatactttccagagaggtctagccaatttacaatctcaagaaagtgtaagaaattgcccagattattgactccaactgatcccttgaaacaaagcttatggcatttagatagaaactgaagggcagtctgctataaattcaaagcactttgtacaattaaatttttgagaaaaaagacattccatagaagcctcatgagttgctcatacctggataaactcaccaaggtcacacctcagctctgcgttttccgatgtaaggtttgtactggtctgtagggactcaaactctccaaccacccttagaagatactgatgtatgaatcagatgacatgttgttaatttacatactacatgtgccaagtaggtcataatactaattttagcaagcaaatgcattctctttttgactggaaagtcttcttagaaaactaacatctgaagatttttaaaacccctattttctggtggatcaaactatttgtgatatacaccattctgtatattaattacaatgtaagaaaatgcaattagttgtgcatttttcagaaatcatattaacctttgatagtatggttcttaaatttatacacagcctactttgaaaatctgacttccaatctcaagtatgacattggacaagtctcccaaactctctatgcctcaaattcctcatttgtaagatgaagtgaataatcttatagacttattgagaggattgtcaatataaataattaaacacaaatgcccagaatgtaggaaatattcaataattcttaactatgatcagttttattactgtgtaataggaatgattggccaggcacggtggttcatgcctgtaatcccagaactttgggagtctgaggcgggtggataagctgaggtcaggagttcaagaccagcctggccaacatggcaaagccccatctctactaaaaatatgaaaaattagccaggcgtggtggcgggtgcctgtaagcccagctactcgggaggctgaggcaggagaatcacttgagcccaggaggcggaggatgcagtgagccgagatcgtgccactgcactccagcctgtaaccaaatggtacatccgtagaacattcctattagaactttagaacaaaacaatgatgaccgagcactattatttaatcttatattagaaataccataagatatgagacaggtgtgtgaatattggaagaaagtagcaaaatgttgtacatgatatgattgcacattagaaaattcaaaggaataaaattgggatttgcaaagggcacaggcgtcaggtgattctgtatccacagataaaaccatagcactcggcgcatattctctgtctctgcactcagcttttcttagggttagcttcatcatcaggctcctgtcaatgctccttaccctgcccccaacctcactcccagacaccacaactcaacgctcttctattttggcggtaaaatggtgttgatgctagatctcatgaatttataccacaccattagaagagcgagggttgcttctagttttgttttgttttgttttaaacacaaaaacaaaataaatcttttttcctttctcatgaattacctcaaaatatttcctatgctaagatggggttacattttaatcatccttgaactgccttctaaagctagtgaatggggaatattgattcacttaagccaattcaggttactgctggcttggatatagaaccattctcacccaaatcgtgtagattgagaatgaggtttgtaatgcaaacaaacaaacaacaaaacaaagaaaaaccctgaaagtaccctttaattgaagaaatataatcagaactagagtagcaaacaaaacaacatgtatccattccatgtatagattccagatctcaagatccctttcagttcctatcaaagaacagcttgaatatccaccctcaactttctagcactttggcctgttttgaagagcggtaaaggattaacctgaattcctttctgtctcccaatgtaatgctgtaagaaaccaattaatcctagaactccagtagaggtttttggtttttttttttttttttttttttaatagattgtactcccaaagtatttgactcatatggattgtttcttagggctggtgtaacaaattaccacaaattgggcaacttaacacagaaatgtaatctctcacagttttgaaggctgaaagttcaaaatcaatgtatcatctggaccatgctccctctgaaggctgtagagaagaatctgtttcttgtctcttcctagtttctggtgcttgctggctgtccttagcattccttagcttgtagctgtatcactttaattactgcctctgttttcacatgaacatctttcctctgttgtatgtgtgtacgtgtgcaaatcttcctttccttataaagacaccagccattggatttagggctcaccctgctatgagtgggaattgtgtccacccagtttcatatgtggaagctctaatcccccatggaactgggggatagggcctttaaagaggtgattaaggtttaatgaggccataaaggtggggccctgatccaatagaactggtgctcttatgaaaagaggaagaggcatcaatgttctctctctactgtgtgaggacacagcaagaaggcagtagtctaacaagctgggaagaaagcccttatgagagcctagccatgcttgtccccgatctcagatgtttagcctccaaaactgtgaggaaagattggtgctgtttgaacaacccagtctatggcattttgtatggcagcctgagctaactaatacacagcctggtctagtatggcctcatctaaacttgattacatttgtaaaaatcctacttccaaataaggtgacatacacaggtatgctgggtgggacttcaacttacactttggggggacacaattcactccagaagattatattattgtttaaatctttctaagaaatttgtgttatgacaatgtgtttctgttaaaaaagagacattccaggctttcaatttattaacaccttagtatgtggtagcaaaagataagtcctaaataaattcaatacatttcaaactttgggcaacagttatttttgtgcacaaatggtattttgcatgtatttttgcatgtatatattaaatcaaagactgaattttgtaagattataccaagtaatagcctatttccagatagctaggtccacagagcctaaaacaaatatccaaaaggagcacttagagagactgccaaagaatctatatacttcttatgattgtattgtcatcatagagccaaaatctaagtttattatatgaaggttaaaaagggcactgagtttcaggaactacagtgatcttatttgtgggataggagttattaaagagacttattaaaatattttagatgtgatctttgaaacaccaagggatgtggtcatagataaagcaaaataggccatgaattaaaaattgctgaagctgggtaatggctacatgagtttcattttatttattctgttctttatttttcttacatgtataaacttttccattataaaaatttaaaaatataagacttcagaaaataataaagcagaaaaatacctgacatatcacttagtttgaatatttatccaaaggctcaaagagatttttatcttgttagacttatcttaatttctaaaaaatacattactgacataaaatttgataaatttgctactatattttatttttaaaatgatcagtagggagatataatgagtattacactctttaaaataattggttcccacattttcatcctttatctaattacaataactatgaacaacaacctcaatcaatagaactgaaaacagaaatatctgaaagaccaataaatacttacattatgatggaagaagtagcagccaaatgataagaactagcccaagggaatgtcaaggagacctgtaacaggaggctatcaaaactgaaacccggcccattgcccagtctccacagagaaaacatgattttcataatctggttttcgaaagcaaaaagcctccagtaaaccctgaaagcaaactatattgaagtcattttatgcaaatttaatatatgcaattataaacttgtgctatatgaacatattgaaaagaccaaaagtgtacaaaaataatgaaaaacctaaaaactacaaaaatcagcaaacctatttcattctgaagccttcatgccataggtagaaatcagatgagcaactgctccagtatgttgtaaataggactgaatgctaatctattcttgcatgtaaattttaaaatgcctttagcagtatgtcttaaagtgtgaactgctttcataagaattacttggctgcctatttaaagtaaaaattcttatgtgcatttaagtttgagagtcagctgatttataaatcctatataatgtgattgattattgtcaccctcaagttttggcaatatcagcatgccactgtgctagagttagtgccatatttaacaatatttttgatgctttggaaaaggatttatacagtgcttgtttaagtaagacagtttgtcactgggcatgcaatcaggggacacattgtagtcaaggggcacaagatagtttaatggattaagagtacaagctgtgtttctagactacagaattttgaattctgctcccaatgcttcttagctatgtgttatcatggatgttcattgatctctctgagtctcagttgactcaagaataaaatatagaaaatattaaattctaagttttgtaaaatattcttgaagaaaagatatgtgtttacctctttctagaattatttaagaaaaagttttaataatatatgctctgtttacaaaagaactaacaaatgctgaaattagttccttctctgtgatttaaaattttgattctttaagtgcatttttgtggtatacagaaggaattaaaatagtaggcactagattatgaaatatacacttggcttgggacttgatttcataaaaattgtatcctgttaaagtcagttagttgcttttaggctgtaccacatatatctcatcacagaaaaatgactcagtgtatttctctgtgttgtggtttggatgttttgtccccttcaaatctcatgttgaaatgtgatccttgatgttggaagtggggcctggtgggaggtgattaggtcatggaagcagatcccttataaatggcttagtgccatctccttggtgttaagtgagttctcgttctgagttcatgtgatagctggttgtctaaaagaatgtggcaccttcccccaccaagctcccactctcactgtcaccatgacacaccttctcaccctttgccctccgtcatgattggaagcttccagaggcagtcaccagaagcagatgccagcgccatgtatcctgtacagcctgcagaaccatgagccaattgaatctattttctttataaatgacccagcctcaagtagtccttcatagcaacaaaaatggagcaaaaatttctccctttcttattaacaatgtccaggttttgttttttgtttttttgagtctccacactccactctgtcaacgaggctggagtgcggtggtgcaatcttggctcactgcaacctccgtctcccaggttcaagggattctcgtgtctcagcctctcgagtagctgggattacaggcacacatcaccacacccagctaatttttgtattattaggagagaaggggtttcaccatgttgcccagactggtcttgaacttctgacctcaagtgatctgcccccttcggcctcccaaagtgctaggtttataggcatgagtcaccacaattggcctgctatgtcttttgttgaacatttttctttgttaaaacgaatcttactattttaagcttctttttcatttcaatcatacatttttagatatcatttacatgtaatgaaatacagtgatcttaagtgtacagctcagtgacttatgacaagtgtgtacactcttataaccatcactcagatcaatacaaagagcatttctgttatttccaaaagtttcctgtgccccattgccatcagcttccccaactctcccttctattccttgggaagcacagttgtgattttattctgctaaattagtttgatgttttcctgaatgccacacaagtgaaatattactgtatgcactattttgtttgccttatgtttttgctatcataaaatttttgagattcattcatgttattgtgtgcatcaggagtttgctctactttttaaatttctgggtaatatcccattgtatgcaccatagggcatttatctattgtccttgtgatagacatttgagttatttccagtctgagcctatattgaaccacatcactgtgaacactgttgtttaaatctttttgttgtcatttctctttatttctcttcagtcaatacctacgaatgaaattgctgggtcacagggaaggtgtatgttaaacttcataaaaattgccaaatagtttcccaaagtggttaaccattttacacacttgctaacagtgtgtgaatttgatttgctccacatgctcattaatattatcagtctttttaatttcagccattctgtttggtaaaccagatgttacctgtccttacacttcattttgaagccttttcccatatgctccttttacatacataaaagaataattcaattgagtgaatccaaaaaataatgtggaacttatgcattcaaaaatagttactcagttctactacattgtaatacaatatgaatttgagaaaattactgaaactctttgttttcatttttcttttctgcaaaatgagaatagatattgtacctactttatagggctgttatgaggattaaatgtgtcaacataatgatgcagggtctgacacataataaacaatcaatgagcaatattagtactattaattcattaataataaattaaattaataaatagcattgtaactattattaatattaagggccaggcattttgccatcctttgagagaaaaattattaagccagatattacctgtccttaatgaagctcattctcaatgaaatcaatatggctgactttaacaaaaagatagacatttaatataaagataactagggcattttctctactcattttacttttttcccttcttttataaacaaatgaaccaaaaaaacataaaaagaaattataaaactatatgtttaacatctttgaccaagaaattgtataggctgcacccctgtacagtgtaaagataaatattttactcttttcttgtggacattttcagaactgttgagatagattttttgtatgaatatattttgcaaatttgattttgttgaaatatagtcttttatctataaaaattcatatttctcagctcttaatgtatcattcattctttcttcctatttggactttggccaaattatactcaaataaccatgagataagtcatttcaaaataaccgtttgctactgtatgttttattacctgtaaggttcacgaatcagagttaggccttattcattgtatgtctcctgtgtgtcactatagttcttggcatttagtgagggaagaacagcattcacttaacactagtgtcttaaacactccactttgcactttacataagtttctaaccaaatccatacctaagttcctggcaccagggaggcactcaagaaataacattagaatgagaaggacaaagaaaaaggaaaaaggggattatattattaggatagagactaagaaagtacaccctagagacccccaaaaacagtgggttaaacaaaacagaagtttatttttctcttgtataacagttccatagtagacaggtgctacagggattattctgctctgacatcccttaggccaggctgttggccttgtctgcatgtttgaatctgactcacttgtatcacatctgcattcctgtttgtgggaaaggtgaaatgaatgaaacaaagtaaagtccttttcttttaagaatgggacacggaagttttaccaatcatttctgctcatatttttttgatgagagctgagtcagagaaacacgttaggctgcagggagttgagttcagagaatggattctcgagctggatgatcatttgccctacttaaaactaaaaagacaaaggggagaatggatattgtgggacattaagttgtctcagttataaggaaaaaggaaaagaagtaaaagtaaaagaaaaatatctttgtgatacagaggtaaaaatcatgtaattttaagatggagatatcaaggattagagaaatttgcctatgatcctacagctagtaagtgctagagtttggatgtaaattcaatattgcaaggctgatgataatgatgattatgtccctaaaccttgtagtttttctactacacttcatgctgatatagtttggatatttgtctccttcaaatctcatgttgaaaggtgattcccaatattggaggtggggtatagtaggaggtgtttgggtcatggggatggatccctcatgaaagtcttggtgccctcctcagtaatgaatgagttatttctccattagttcacactcgacatggttgtttaaaacagtgtggcacctctacctcctctctcttgctccttctcttgccatgtggcatacctattcttcttttgccttctgccatgattataagcttcctgaagttctaacctacagatccatgagccaaataaacttcttttctttataaattacccagtctcaggtattcctttatagcaatgcaaatggaataatacacatttcttcataaacggtactcaaatgtttaccaaaaaaaatctgatatggtctggctctgtgtccccaccaaatttcatcttgaattgtaatctgaattgtaatacccacaggttggtagagggacatcatgggaagtaattgaatcatggtgggtggtggggggtccccctggctgttctcaggatagtgagttctcatgacatctgatggttttgtaagggccttttcccccttcactctgaacttctctcattcttctccttcttactatcttgtgaagaaggatgtatttgcttctgccatgattgtaaatttcccaaagcttcccaagccatgctgaactgtgagtcaattaagcctctttcctttgtaaattacccagtgtttgctttatagcagcatgagaatggactaatacagtaaattggtactacaaagagtggtgtgctgctggaaagacatccaaaaatgtggaagtgactttggaactggataacaagcagagtttggaacagtttggagggctcggaagaagacaggacaatgtgggaaagtttggaacttcttagaaactgggaaggctcagaatacagaaagatgtgggaaagtatggaacttcttagagacttgtagctttgaccaaaacgctgacagtgatatggacaatgaagtccaggctgcggtggtctcagatggagatgagaaacttgttgggaacgggagcaaaggtgactcttgctatgctttatcaaagagactggtggcattttacccctgccctagagatctgtggaactttgaacttgagagagatgatatatggtatctggtggaagaatttgcaaagcagcaaagcattcaaggggaagcagagcataagagtttggaaaattttcagcctggcaattaagtaaaaagaaaaagtcattttctggtgagaaattcaagccagctaaagaaatctgcataagttacaaagaggtgaaggttaatcaccaaggcaatggggaaaatatcaccagggcccatcagagacgttcatggcagcctctcccatcacaggcctggatgtctaggagggaaaaatggttgcatgggccaggcccagggcctccctactatatgcagccttggggcatcatgacctgcatcccagctgcttcagctccagccacagccaaaagggcccaaggtatagcctgggccattgcttcagagggtgcaagtcccaaaccttggcagcttccacatggcgttggacctgtgggtacacaaaaatcaagaattgaggtttgggaacctctgcctcgatttcagaggatgtgtgggaacacctgatcgtctggcagaagtttgctgcaggggtggagccctcttggagaaactctgttagggcagtatggaagggaattgtgggatctgagcaccgacacagagtatccactggggcactacctagtggagctgtgagaagacgaccatcctgcagatcccacaatggtagatccattgacagcttgagcggtgggcctggagaagccatggacactcaacaccaagtcatgaaagcagccaggaggggtggctataccctgcagatctacagaggcagagctgcccagggatatgggaatccaacccttgcatcagtataacctggatgtgagacatggagtcaatggagatcattttgaaactctaaagtttaataactgccctattggattttgaacttgcatggggcctgtagtccctttgttctgaccaatttctcccatttggaactgatacatttactaaatgcctgtaacccgattgtatttaggaagtaactaatttgcttttgattttacaggctcttagatagaagggacttgccttgattcagatgagactttgaacttggccttttgggttaatgctggactgagttaagactgtgggtgactgttggaaaggtatgattgttattccaaatgtgaggacatgagatttgggaggggccagggtcagacttgaatgatatggtctggctttgtgtatttacccaaatctcatcttgaattgtaatctgattgtaatcttcacatgttggcggggggggacctagtggcaggtgactgaatcatgggggcagttctcctgtacttttatcatgatagtgagtgagttctcataagagctgatggtttggtgagggaccttttccccctttgctctgcacttctttcattcttcttcttcctgacattatgtgaagaaagatgtgtttgctttctcctgccatgattgtaagttttctgaggcttccccagccatgaggaactgtgagtcaattaagcctctttcctttataaattacgtagtgtcaggcagttctttataacagtgtgagaatggactagtacaaaattaattgtatttttgtatacaaaggtatatataaatatataaagtcctacagattatatgcctttatgctatcattattaagttcctgttctccaaaatggaattattattttaaaagtatgtcacggtggctcacacctataatcccagcactttgggaggccaaggcaggcagatcatgaggtcaggagattgagaccatcctggctaacacagtgaaaccctgtctctacaaaaatacaaaaaattagccaggcatggtggtgggcacctgtagtcccagctacttgggagggtgaggcaggagaatggcgtgaacccagaaggcagaacttgaagtgagatgagatcgtgccactgcactctagcctgggcaacagagcgagactccatctcaaacaaaacaaacaaaacaaaagtatatcacactgcattatatttttcaaagtgcttacaggtacagaatctcatgttattatcataatatatctgtgaagcatgcagaggaagtatgattggtacaatttacctatgagaaaatttaagcagggaggttcaacagcttgtaaaattagcaagagtacaagacaatgactaagggctaaaacctattctcattcttccttcctcagaattcagtgcctactttggaaaagattcagaaagagtattaataaactcattagaaatgtggtgtaaaagcttattacacaattatactgaatttggtagtagctatatggggttataattattttttcatttatttaaccaaatgctaactacccttttatgagtctttcctgttgagcactagctatatctagatggataacatgattcatgaccctgttggccaatttaacattgtctagagaaaattagaggttctctttgatttatatggtagatcttttataaaagatttttttgaaagccagtagagttttttctcttggtttactattttttttaaagtaactattgctctgccatacccagttgcttcatatttcaaatagcaaatccaagacaaagtcagaaaattttgttaaaagagatgctgaaattagtactaatgtcagcattttgaaaatttaggacattatgagacatcaatgagattaatttagtcatttaaatagagaagttgacagtgaactcaaaataccaccttagtgactccagcagaattctgaactgtcagcattctgtcacatgttagagtttataaccagaaatcaaaatttatctccaagaagttctacctcctgatcaactgttttcagcaacagtcacctcttaaaatggcaacaactagtctcaggctcttacatttaaatgggtaaattttcacttgccttctttttgttgtttgtttcctgtcactgaaatgctatgaaaatttcaaggtgaatggaatgaaaaaggcagaagcaagaaacatatcagagataattattttggtcctggtaattgcttgggcatagttggagaggttagatatgatggagaattgtgagggaagttcatgtttctgcccttcgagggttaataatgtggggtagatgagactcagcaaatagaaaactttaaataaaactgtatcctcaagtgctaggtaatatagaatggaccacaaataaagtgggagggaaaggagagagacatcgctgacgtataagttaattgaaggtagaggagctctcttgggctttcatgtagccatacgagcttgaaacattcgctatttttgctctgaataatgctactgaattcaccatacttgtgacatttttgtaagaattaacattaaaaattactggaaagctaccaattgtactattgtttttcaagagcactaaaatctgacaaaagaaaaaaagagtatattttgttataaaagaaaagctttcaatatccaaattatattgttcatataattcagatctgtgtatatatatatacatacacacacacatatatatatggctccaaagagaggaaaatatggtcacatggaattcccatgctttattgacatatttgtttatgaatccagagattccttagttcatccatttagtgaatacatattccgtcgtgacaaaggctatgtaagttgtctgcaatttcgtcttctgaaagagcatattcaaatcataaactttttctgtaaataagtatacattgaactactgttttactcttactttttatgacatttaaaatcaatgaaatgtaacaaaatgtgtttgcttgttggaaatgatattaaattgatagaaacatgtggaacatgttggaaataattaaacctagtgatttacatctgaaacatctaaaacagtgaaatacaactgctttcaactgttgattttactccaaaagctattcctttttaacattagaatgttgatatatctcttcatatcccttttggtttaggcactaaatcttatataaatccagtgaatttcattagggtatggtaaaaacataacttaatcagtctctagctgtgctcaaataagaacccgtcttttagccaagtttaaagtccacattggataaagactaaatacaaaatgatgaggatttcccactgagcatccacagttgacttctcacaatggcattcacattcattcaaatgccatatgtctctgcattgtgtgcatttgtaacacatttccttttattgatagactgatttcatttccaataatatatttgaaatgtcagcatttcagtagactcctactacgctaacataaaatttatatagaacctagaaataaacaattactactgaataacaatgcaagtaggagggaaatgtgtgtgtgtatatctgtatatgtatacacagttgttgtatatgcatatctttgtatatgtatttgtgtatatttttttatatgtatacacaaatatgtatacatgcatacacttttttgtatacatatatatacataaaaatctagcttatcctccaaattttgttctttaagcagaaaaactactatagctgggagaaatttattgtacttagcagtataggatgtagtatatagtactatcaatatttttctgttttatgattttaaaatgactttaattcatataatcatggataaaagaaggggaccttttcctgtatacctcatgtctttgtcctagtaactctctttctaaatggaaactgaatatgctgattatttttaatcagaataaggcatagaaaaatatcttttataactttattatatttactttaatatacatttatatggaaattagttgcacacatgtctttttcattagatcagtttctcaagataggataagccatttaggaatcagaggagcaattaaaatttagatttcttaggttctagttcaattttgtaactaatcttctctggggacagctccctcacaaatattaaaagcatccaagatgattctcatatgcactctatttgacaatcattatgttagactggaagtcatttgggagagtgtgtcatgtctgatttatctttatcctctggtatttagggcattgccacaaattatgttcaaatttaatggtgtaaatataattttcatgcctatagtaaatgcattatggtcataaatacaaaaaaatgaaaacatcttttcagagtttttgagaaataatcaagattgtatctctaccaattagcagtgacaactcagtgaaaaaatacagagaggaaaaatgcacattgttttcagagcatagtatatcagacacagtttttaaatctaagacgtaaatcattttttaagttatcttgaaagtatacaagttaaaaaatgtgccccatctgtgtttttgtcttagtaggcattccactaactgctgtgaaaaatgattacttaccaaaaaacattttaagttattgcatcatacccaagttcattagtttccagagcctgggtctgacttcattgaaatgtacctgagaaaattaatcttagaaatgagctcatgatgaattctacttttaaaagccagtattttcagttttggcatacatcatatacagtgtgatataatggttaaaatttagactagcttctagtactagcttgtctcttactagctgtgcagccatgtgcaaattacttaattctaagtgtcaattgtctcatgtatgaaacaagaatgttaatacctgccacacagagttgttcagagataatggttatagagcactttgccttattcttgttgtttttgtaaagtattgttattataattggcatacttgagaattcaatgctatctacccgcacaaaaaggtattctctattttcaagaaaaataactacttttctacatttttccataccttatttttctggaatcacatctatgcttatttcaaaaacattgtcccaaaggtaacagtgtctgtggtttcttttcccctgcaaaatcttcagtgctattttgattgccaactctgagtgtagctgctctaccatgcttaagaatagataaaacaaagtgcaccttgctttttgctgaaagtatgcagtcagtcaagatgtaccatggactgaagatctactctggtgaactcgtcattgaattcgtttaaaaacattaggtcaaagattttcaagtatgaggcaactttacaaatagatgagctttttcattgagttcatgtccagaggtgagaatggatacaagttttgtgtgtactaaagcttattacttggggagccctcattaagaaaaagaatttgttaaagtgtttttttgcaaattttataaaacaatgtatccttgtgaacacattgatggttcctttctagggtcttagaaggagcctgtgcgaggtaggagctttgttaacttcacagtaaatttacgtctgccaagtggaattacgtgattttgttttcttctctcttctggaagactttacaatcttattctgggaaaaagcaaagtacaaatattaataacaatacagcattttagatggtattatgtggcatagattataagtactgaagagttcataaaggagaaaaaaatgctggtagacttttggaggaaagttaaaggaagatgctttgcagagtgcttacaacagcaatgatgatgatagcaaattagcatagtagactgaaatttccatttataaatcaaacaaccaatttggtataaatgccaactctgcctcgtaaattgtataaaaacaaatgtgattatgaacttatgccaggcattatgccaggggtttgcattatcttatttaatatttatatcaattgaataaggtagtcttatttcattaacttgtccaaagttactttgttagggaatcttagtggtgagtttgcagctcacatctgtcagattttactcccaagtaccacttcacactgtctggaataacttttcaaaaatgcttgggcacaggtaaacacctccaagtttgttttggaagcaaatgaatgtgttctggagttagtatatttgaaaacctacccaattccttgacaacttaaacccacatatcccactgaaaaaacaaaatagctattataccatatgcacacactaatggaattttgcaaataaattcaacaataaccataaaggagattcatacaataaataaaagaagtaattgattctaacaaaaaaaaacttagcactaaaatagatggctttctatgctttttaactcactaaatacaaaagttaataattattagcttgattaaaaagtctgctgtagtcatttgtaaagcaaacagttatgattatttttcaaataggtttgttgtaggtttttttcttcttcttttcttttttctttctttctttcttttttttttttttttttgacaggttctctcagtgttgcttaggctgaagtgcaatggcatgatcctgactcactgcagcctggaccacccaggtttaagtgatcccactacctcaacactctgagtagttgggaccacaagcatgcgtcaccatatcagctaatttcattttacttttggtagagacagggtcttactatgttgcccaggctggtcttgaactcctgacctcaaaggatcctcctggattggtctcacaaagtactgggattacaggcatgagccacctgccctgctgtgtttttttttttaaaggtaacaattagacctaaatatgtccccagacatctcttcccacaagaacagatattctgtcccacacaactgataaaatacataaaagaagtattatttctttgttatttctgcccttgaaaggtagctgtttgcaatgctaagttattctgtcttttcagaatatgagcctactgtatacatttatttctaaataaacaatgatagcattgctttcatacaaacttctgtttgaactgattagcctgtacttttggaattataatttaattgaagtcacagtttcttttctgttcctgtaattcatgccaaaaatgtaatttgatctcagttaatagttacaaaaaaagttaacatattcttcagaattaagttgtaactgtttggaaattaatagtttagcacctgatatcattataaaaattcaaactctttttttttttttttccagtggagccttgctacgtttcccaggctggtcttgaactcctgggctcaagacatcctcttacctcagcctcccaaactactgggattgcaggcatgagccaccacctatggccaaatatccaaacttttcaactgagacccacattaaaaaatgtgttttgcttcccaaaccggttcatacttactttctctttctttctgagatgtcctatgttctgttctgtcctatcctataccttactagtctaattcattaaaaatgcaatgcatgtcctgatctaatacattgattctggctgggtgcagtggcccacatctttaatcccaacactttgggtggacaaggcaggaggaaaacttgagcccaggagtttgagaccagcctgagtaacatagtgagactctatatttagataaaataaaataaaataataaattatttgtgtgtggtggctcacacctgtggtctcagtcacttaggaggctgaggcaggagaatcacgtgagccctggcattcaaagctgcagtgagatatgatggcaccactgcactccagactgggcaacaaagcaagaccctaaaataaagtaaaataagttgaataaattttataacttattaaggaatcttgaccttcagtttgtgcaatcttccgtgtttagtgaagaacaatacaacatgacataggcatgaatctccaactcttgcattacaggaaaatatttattaacatatggaatagtcttagctttaccctctgccttgctttgggttgttgctttgctcactcattttttttttcacctgtaggaggtatttgttagttctcaaatgattcagtgggattgtgtaatgtagaatcaaaagatgagagaatgggagacaaaactagagaggtgaaaggaaagtaaaaaccttcaaagtgtcaaagtttatgactggggcctaggagaggtagattctccaagagagaggagagaaaagattttcaagctgtgcatagaggtgtggaaattagtatgaaaataaagaaaaaagttactaagctttgtctattgtctatcccatttttggtatatttgtgcttgtggtgaatatgactcaatatgtagaacttcatgaacaattgccacagaggcagtcaatcctcaaaaaggagtatgtagctgtaaagtacagcaagtttcacattcagggtgacaagcatgggtcagctaaaaataatttcactttgtagagagagtagatttcacagctcaaggtggccttcatatatttattgagtagtgcactatacagaattcatccatcatttcgctgttcaagctcgacctctctaaagaaattgaacagtagacacgcaccatacctcatcaccattcatttttcctattgcccttttctctaagtcattactagcaatctgcaacttttagtgtactgtatgttttatgtataaaatacatatacagtgagaaaattaccttttagaaaattattcttaaaaaaatcacctattttttatcacctattttttatattgccagtcagcttaaaacaaaaatattcacctattttttatattgccagtcagcttaaaacaaaaataaaattcaaaaagtataattgatttttggtaaacttaaaaattaatttttatatttagtagtagaatctgactttcaggttaaccttttaaacattaaaaccaaaaggagacatcaatgtcaatatccagaggtagtttaagcttctttcagtttcatttcttccttttgttatttcaatagcctatagtctaatgaagttaacctaaatatctgtgagggcagggaatgacttgacaacaataattctaaagttatcttcagagccacattttggggctggcagagcttgcacaactagtcagagcattaaatcacagaaataaaaattgatcctatcctcatctagaatccttcattacctcaagtgaaagtaaacacacacacacacacacacacacatatacacacaaacacccgtaacaactaaattaaatcccttttccctctgttgacctgtctctcttgagtacatttaggacaggctaatgtggctccatattacattttatagtccgcaccatcaatctctagaccagtgaactgagtattatccaaaatcagcagttgccatcagttgaaattctgaaacttactaatgcttggcataggctttttccaagtgatttatgtgaccagtttactatacctcttaatatatttaccttctagttcataagtgttcttttatgaattgatattcatataataaatcccatatcctaaacataaaatatatatatataatttttattactgaaaaagcagtttcttcctgatcccagttagtaattaaatagtattgatttgaaaaggcaacaaattatcagctagttgaggattcgcacatgcttcaggcctgccgtcagtatctggcatatatagtgattattataactgattacctaaatgagtgaatttaatcatgtaacattttcttacatgagataatgtatctatctttgggaagagttatggggaagtttctgggggttggtaataactgctttcttttttcccacttaatctgtttttttgtcactcttcatttgagtctctttatggctaatttcttggatttgtttgggaaagagagtaataatagggaaaatatggaagcggagttagaaaactggttgtagacgcttcctacctgatgttcctcgtacaagtatttgattcaaaaacaggtttgcttttctcccagccttggatgtgtaggacaaaattaaatacattctaagaggtctttgtaagaaagttttatgcaagaagtattagagataataccaccagacactactgttttttaatcccacctgttgctaaaatacagaaactttgacctcaatttcttcttatcattataaagtccacaggatagtggcttctctgtgaatgttgtttactgaaaaatcactgataatttttaaactttaagtttttattaaaaaaagaaaaaaaatttctgatgatctattccagcagaggttacacactttcatgtttgtaaatgagtttgttgcttttaatattttaatcataagcattttaaattatcaattgtctgcatattagtaaagttcaatgtgactttaggctatgtgtcacacagtttttaatgatgaccaaaattattttcaaactctctgcctaattgaaatccaggtaggaggagccatttaaagtcattcttacagcttttcatactagtaataacaaaaatatgttagttgtacctttatgttgtcctgccacactctggggtcatagcactcatttcatatgtctatgttttgatatttaatggctgtctttcatgctagaccacagtttcatgaaaccttgaactatatatatatatcttttttgcttgtgtccccaatgccacatgcaacatgaagcacagagtttctccatcagacatcacctttaaataagaacaacaaggatgaacttgaaagatattatgttaagtgaaattacccaagcacagaaaaaccaatattgtatgatctgtcatatgtgggatctaaaaacgtcaatttcacagaattagagagtagaatgatggttaacaggggttgaggtatttagtggggtgggaaggtggggagatgttggtcaaaggatacaaaattttagttctataataagaataaattctagagatacattatacagcatggtgactatagttaaagatatattggattcttgaaaaaattctgagagtggttgtaaaatgtgctcaccacaaaaatgacaactttgtgaggtgatgcatatgctagttgactgggttcaacaattccacaattcatgtaaacttcagaatattatgttgtacacaataaatatccacatacaattgtatctatcaattcaaaaaaatttaattaaaaagaaaaaactaaagacaacacatgcagatcagaatgggtggtgccagtattaatgcccattaagttcaagtgatttatgaacatggtagggtggaataatgagaattcagggaggatccacggaacagatgagccttattctctgctggcaaagtgatacatgtcatatatgtagaggggaagagaaaagtcattctaagtaaagagtcacatgaatggaacaccaagaaaagaatttccaccactgaatttagcatacagggtggtaagtatttgctaatgtattggactcctccactagcctgtgaaatttttgaaggcaggagctgtatattctcagctccaggaatattcatttacactgtacattatcagttctcaataaatatttgttgaataattggatattaacctggtttctaatgtggttgcaaatttgagatcaagttttcaggttttcttgtttttttccccagatcatatctcccatggttgtttggtatatccaagtttttaccctctgtgatgaaattattttctctatgttaagaatacatctttaacatatctctgttttgagaatatatttttttgtacttacatttgtatactctgttttagcttggtccaaatcccttttccagaaactaaattacagataaagactgaaattgtaaaacagttgttgcttaacaagcattaataaaacactaatagaatttaataacctagagtttacatcagaaaattaaaaagcatacatgaatccttttctaaatagtagttgcagtgatggtgccaggattctagatagactttagaaattaaatgccaaggaaatagctgggggaaatgtgaaaatatcaaactattgatgcagcccatctgctcaattccacagcaaaactgccttatatagggaagtgacatgatcatatttgcattttagattaatcacttccataaaagtgtggagaataaattggatttggacaggatttgtacacaggaactttacttacgaggctagagatggtgtgggcctgcattgaagatgtaatgaagggaatcatgagaatgtggtagatgagaatcaagacacatttagaagatacaaagtaatgacctgaatgcttctatgtatgaagctgatggaaagatatactgtaggatgaagctccatgaagctgaccctgcatctcacagcctagcatagaaacacagtaggtcatcataaatgttgatgaatgaatttggtgacaagacatatgtattagtttgttctcatgttgctgtaaggaaatacccaagacttggtaatttataaatgtaagaggtttaattgactcacagttcctcaggactggggaggcctcaggacacttacaatcatggcagaaggggaagcaaacatgtctttcctcacgtggtggcagcataggagaaatgcagtgtgaaggagaggggcagtaaaccccttatgaaaacatcagatctcgtgagaactcactgtcatgagaacagcatggaggtaaccacctccatgattcagttacctcacactgggtccctcccatgacacatgggtattatggaaactacaattcaagatgagatttgggtggggacacaaccaaaccatatcagcatatatcttttatcaagtcaggaaagacttgggagacaaagatgagtttagttgtagacaggcagcttgtttgtatttgacttgtagcactctgtgttgcctccttcaagacaggaagccatcaatcacaagtgaactgaactaaatatcctcatttttgttatttctttaaagtaacttgtggtagctcaatttatatttaaggaagctctgtcagatatgattgatatttgcttaaataatattgactacttgtgggtaaaaacaaataaaatgaaaaaggagagccatgctgacacaatacttttgaacacctggtatttgaaatgattgcaaggtatcacgattacctgaaaagagtgaaaacattgtcttagcatttctgattttattttttgtacataattggagtttccacattcattgcacaaaggtgttgttagtgccagggaagtagttactggaatacacgaataatctaaagtagtgaaggaaaaatatatgtaagtcagaatttcaaaatagtgcaataatttatatgaccagaataagcagtgcatacaatggaaaagtatttgagcaaaccttaatcagataaattctgaggtaatgatagtatctggtgatagctcaccagagctgagtcttcaaagatgaatagacattagctaagaagatcagatagtctagcataagcaaagtcagagaagtgggagaaaaatcacaattaggagatgctcttgggggtatcaatctgtgaagtctggcttcatgggtttcaggaagaagagtcacagagtggccaggcattccttaccaaatggaataattcagttgtttcagcttttcttacttaacagtaaaataattaaacatgactatgtttatatttagttgctttgatgaaatgaattgtttccaaaaaatatagaaggttcacaatcaataccaactacctattaaaatgtgcttaaaaaaaagttttcaccctcactccccaccccctgcacacacactcaaattcaccaatggaattttatcttattttatttgttgtccttgacacactagaattaagctaaacaatcattttcagagtaaagttttaatgatttgaaactattgcagctcactttttttatgtctccagctccattttactatgtatttgtgcattcagacagtatatgatggaacagtaattgtaagacaaagaaatagaacttgacttatttcagtgatggaattctatgtaaccacttgtattttttgtttctgcttaaaatttagaagactaaaatagagtccaaacttcagtgtgtgtttcttcccattaaaaaaatacacttatgtaacgaatgtatgacttcatcttttttttggtactttaatatttgttttcttattttgagatttttttactactattttaacacacacacagagtttaataatagaaaattttcacagtctatatttattttctggccagtattattaattcatttgtgattattcatgaaaatagttttaccacagtggggaatgttaaaaaattatctaatctgactgtcaatatgcttggtatggaattgtttataacagtgcttgaaagtgagtagctattaattcaagaggcactggatatgaatgttagcagcataagtctcccttggggtagctgggggcctgtttcctcatcctcaaaatatgcataagaatacctactactcaagttattacaagtaaaatctgagacaatacagattaaactcctcacagataagtgagtacagcaaatatagccatgcaagaaagacaataggcttcctttagatttgttcttaagactccttctcaccctccactgactttgagttgctgaatctataaattaagtccaaattaacatgaaaaaaattggggttcacaatttgaagtcagaatatttaccatttaaaattagaatataaccttctagatatctttcaaaacattagttagccacatgactctttcacaaagcttttcaggatgtcttatctattttggaatatcatagtatgtaaaataaatgataatgatcctatttacatgaggctttttgattaatggttattactagttgggttccagcatcatttaactgtaaagaatttttaacaactaacaactgagaagtaaaatgtagttacttattcagaataactgatatttaagaaacatttaaacaacattcttactaaataaaaaataggtcaagcgcggtggctcatgcctgtaatcccagcactttgagaggctgaggtgggcagaccgcaaggtcgagagatagagaccctcctggccaacatggtgaaaccccgtctctactgaaaatacaaaaattagctgggcattgtggcacatgcctgtggtcccagctactcgggaggttgaggcaggagaactgcttgaacctggtaggtggaggttgcagtgagccgagatcacgccactgtactccagcctagtgacagagtgagactccgcctcaaataaataaataaataaataagtaagtaaaataaaataaaatagaagaatgggaacatgaaaagaagaaaaaatgttctgatcctaatttggatcaagctatgacatagttagggaaactgaataattttagggaattacctatcttattcttggtctctagtgagagtcttaacaaaccttgagaataaggtttaattcattgttttaaaaagatccatttgtgttttgaagtgagttaccatggctttgtaaaccattgaagaccaaaacataatacaaagtaagtcacatgtgcaaataatttatgttctttatagtttcttttactgataatgataatgtgagtctgctttaaaattaatttttaaatatttgtttagaacttactattaattcttcttgcctttggtatggtaactaggaaccaattagtaaatagataaggttgttgttgttttttgcaatcatatcttaaaactatttttttcctctattggccgtcgatctgggctttgaatcgttaattattcctgcaagtaggttgggaggagtggaggtgatgctattttagctccttttgcattcagatacaaaatcattaattttcaaccattttccctttgaatagaatccaaaacatttttcacacagcttcttttaaaggctaaatgctttatagaattctatgaataaaatttgcgtgtataagtatgaaactttgttaaaatgtaatatgagaaacttccattggaattatagcatattaagtaatttaaaacgattccatacttcacagcttctgccaggcctagacaacgcatggaacttgaatacttacatatgtatatatatataaaagctttgggacaagaggtagaggctcaaacattaataggctcattgcttgtcagctagtaatactaatccaaattagttttacatgtgcaccaagtaaagaaaaaagtctcaactttctttcagcatattagtatacctaaatgattttcttgtcaaaagtatctttagcctgagcccagaagttcgagtccagcctgggcaacatggtgaaactctgtctctacaaaagaatacaaaacttagccaggcatggtggcatatggtcccagctactagggaggctgacatgggtggattgcttgagcccaggaggttaaggctgcagtgagccaggatcacaccactgcactctagcctgaaatatatcaatgtttatgatatctagaatttccatttgtaagtttcttagcaattagtgcagtgctttgcacataccaaatagtaactaatttaataaaaatgtggctgtttggaatgaaattacaggtgactcttatgtgcttttgatgatgatgacaataatgttgccaaaaatcagtgatgaagatgacaacagtgatagcaaagattgaaatagccacggtgagatgtgttactttggttgtatttagaagtgttcaccttcccaggttagcataaattattatatttttgctctttttggttatggatgatattgtttaagactgtttctgaaaagaaaaaaaaaataactatcaaaggaaagtctttgggcgaactgaaacaatacataagaccatttgtctgctagtgcaaatcaatgtgttccttcagcaatacacattctgtagatttatttcaataactcctttatgttccattctgtgtctatgtactctctggagaaggttaagtaactaaaggaatatgtatagcatctgagaaattggaccaaatgactgataaaacctcttcccacattgatattctatcatccttatctgtttccagggttaagttttcttatttgtttctattaaggttacttgtttttgctgttgatcattgtctttgacagagttaaacaataagtggttaatttgatttatttataaaatcaatattaattttgaatttgtaagataacagactagaaatgccacagaatatggtgtatttgttgggagtgtacatgtgagtgacattttctgtttcgtctacctactgggcaagatgctttacagattaatctttacaacaatccaaaggagtgggtattattttgcagattaggaaaacaattcagaaaagtttagtagcatgttcaagggcacacaccaggaagtagcaaagcttgtcaaatctgggtttgtagaaatgcaaatccccaactctctatgactaacgttttactttgtaacaattgtgaaaataaaagttactcaatagattctgctactcctgtgaattctaaaatctattcctgaaagtactaaaagtctgcagaatatgtcaccttatttattcagaacacattttatataaatgatgtgtgtatttttaagataatagaaatctattcctctattattcatgatgactaaataataatttggccatttaggatgaatgtatttataaataaattataaaatatttcccccatcttttcagcaaaatatccttaaaataattcactcttttctttcagttctgcttctttatcatgtgtcttaattgttgtgtttgaccttaagttttctcagtagtttttaatgtgacctgtccaccagtacactccatgatgccatgctctataggataatggctaagagaccaggcttaagataaattcatattctatgaattcaaatcttagttctttccctttttagcttactaattttttgatagttgtcttgtttgtttttttatctgcaaaacagagatgatagtgcctacctcaaaggtctttgtgaggatcaatgaagctgatatgtataaagaactttgcacagtccattacatatagtaagggtttaatgaatgataactagttaatattataccttttaaaaatgttttttattcatttaaaattgttttttattcattttctcaatttctaccaggagcaaattctctcactttcattggaaatttttaatagactttggtctggcaatatatatatataggtatacatatatatgtaatatatataacatattacatatatacatatattattacatatatgtgtacatatgtatatatacatatattattatatgtaatatatattataaatatattacatatatataacatatatatatatcttttacagggggtcctcctctatcaccgaggctggagtgcagtggcacaatcttggctcactacaacctgtggctcccgggttccagtaattctcctgcctcagcctcccaagtagctgggactacaggcacgtgccaccactcttacctaattttttgtatttttagtagagatggggtttcatcatgttggccaggctggtctcgaactcctgacctaaagtgatcctcccacctaggcctctcaaaatgctgggattacaggtgtgaatcactgcgcccagcctagtctggcaaaataagtgccaaagaatggtagcattttatagtgagaataagtaagcttggaattccttctgttaaaaaaaaaatgtgcaaacatgactctcaacataaagctagagcccaagttaaagagatgactggtgatgattttttttgcaaagttaagaaccttttttaaaatgttgacatatggtgtacccctccacctgttattctgaaatagctgtacattctgccaatgaaagagcccttagtaaatggaactttgaaagttgaggggttgagggtactttgcctgcagaaaaggcatggcagagtgtgcgtaggaggcaacatgcagagtggagttaaagaattcaatgaaagcaagagcttgaatctgggcataatgctaaattgtgtgtcaaagtcccacacataaagcggagagaaacaaaacttctctaactgaagtaggagctaggggggccaggaactatatccacatagtatctctctcacctctagaggtaacctacaaattgaattacattctttaataaccttataaaattaactctcaccaacagctagatgccagtaaaattttgttcaattgagttttatcctattttagtctctctgctttaaaagactcattttttttcacaaatatatgtcattaaaaataagatgtgggttatagattttatatattaaaagtaacattagcaacacatcaatcgaatgaaatgtatggactttgaattcagatttgattaaactaactataaaaagactatttttgggtaaaatcagggaaatcggaacaagaaatagttatttgatgaaataaagaaattatcattaaatttgttagatctggtaattatattgtggctattttttaaagtttttatctgttagagacaaataccaaagcatttatggaaaaagaatatgatgttggggagttgcttaaaagtactccaggttggggatacaggtcggataggaagagacacatgaaacaagattggcataatgttgataagtgttgaagttgggtgatggtttcatgggtgtttactattatgtctacttggtatatgtttgaaattttacataataaaataaatcccagtaatttaatttatagtccataggagaatgtttttctggctttaatctttctgacctaattgggatttggcagacatgttctacaaaatgtgtaaaaaaaaatatgaaaggtgattaaataaaagcacacattcaaattgaaaatggttcaaaacaaaagtgctaataacatatttgaacactttaaactttttatttggcttttctgttttaattcttttaaacatacaatggaatcgcttattgtgtttttctttatttcgtttgcttttaaacaccaaattaattctcaacttctgggaaatgttacaactgccaaattgcagataaacttctggcttgcagtggaatagatatttgctcctggaacaattaaagaaaattaaactatatttgcttataagatggttttttaatgtctatacatttaaaatatgtcaaataggcagttttgaaattttgacagtaggcaaatggtcacaatacagacagaaatctagctttagagaaatctgaaagtagatattatggatttagtcagcaaacctagtttatgggttgacaaaagtatcacacaaagaaattgttaacagaaagataaattacgaccccatttattgttgttaagttcaaagcaaacctagattcctggagctaccaaattactggataattgggtaccatagtcaaatcattgaattttttaataacatattgtatttcctaattactacaaaatagcaatacatattaagattttcacatatttatttttcagagccagaatggtctcattatactctgtgagttgctgacttagcactccagacttttttgctcaaaggcaggattggccccagcattctagggtggagccatgcttctgcatggagattttaaaatgctaaatcagcataacgcagctcactgtgagttagtatgtttactgctattgtactatgataataaccataagtgcctggaatctaactgatatgtagaaaatataaaagttttcaaactattaataaaagtttcacttgatagtacagtcaagtatccctaatcatcccttatgcatgagactagaagtgtcttagatgtccaattattttggattttgaaatgttcgcttatacataatgagatattggggaatgggacacacatctgaacacaaaatttatttatgtttcatatacttcttatatgcataacctaaggtaattttatacaatattttaaataatatttgtgaccgtcacatgacattgggtgtgaaattttccacttgtgaagtcatttcagcaccaaaaaatatttggagtttgaggcgtttttgatttgggattttgggattagggatatttaattcattaatcaattaatgtaacttctatctaaacttgtccattgctagatgatagttttaaaaaacagtagctcattgatttgatttggtactgatttttaagattctggctttctgatgcttttgaaagtaaattttcataatactacacttttatttatttgtttttcataaaattgaagttttaattgcacatcttgtaataatctttaaatgataaagcctttaaaatcatgatatacaagtggtataatgatcccaaaatgcaaatttgtagctatttatacaataagtactttcacagttcagagtatacagtatggagggcaaacagttctgcacagtgtatgttactgatttaaaagggaagcattttgcattcatgaaaatgtctaatattttgtcttaaaatattcatatgagatgaaaatacgacacatgtatacatatgtaacaaacctgcacgttgtgcacatgtaccctaaaacttaaagtataataataataaaaaagaaaatacgagtcagaaattcacataaaagtagccaaacattataagagcttgtgttaccaacagtaattttttatgatttcacacatagtgaaatatagtactctacccatctttgatttgaatccttctttatttctgttctgtcagtactgtggatgcacatgtgcattttcatctgtgctgtgttggtaataaaatgaaaattgagcaaaacaggggtgatacaatttttaacaaagtggcaaaccagctcagttcctaatataggcatcaaaataaaccctgaaatacaaaacaatgtgtagattttgcaaaaggagtagtaagcatgttgagaatcaaacatagatctaataggaatttatgatattttctaatttccttttctgcaccgacttccttctatgtggaactatttcttttgtgatgaagttgaaacagaaggaattaagattgagggagtaaacaaaaacaaaggtagaatgcactctcaccttgctccccttttcttagccccaaaagaaagctgataattacattttcctttttcatccaaaaggatagaatgtaaaatcaagtagacagagaagtgcatagccatcttgaagtcttaagacaaactaagcttgattaaaatagctggagtactcatctcacccaggcagttctatcttttttactaaatactgatgtatagaaagcagacaatgaaagaggatatgctcacataaaagttcaattaaattttgcctatcagtaagttttctgactgaattaggaacatatatatttacaaagctgagttactagtaatggtgactaacatttattactgcttcaggtgctgtttaaaatgttttacaagtattaatttatgtgctattcacatcaatcctaggaggtcaggtacttttattatccctattttacagatgaggaaactgaggctttcccatgtggttaatcctggattaagtccttgagagtctgattccagaaattgaatgcttaactctttattaagcaattttatgaaataccttaatatcacaggacatttcagacacataagttggtcatttgaaaacattaatcttcctaaatctgctcagctataagtgctgataatctttaggttgcttcatccattcttctatgcaacaaagagggcttgtcatttggcaagctttgattggcactgtcattgtcaccattcattaatttggcactatccttctgactactagagttgcttccagagagacctgctgcccttactccaccaaatttgaagacttttatatcaaaacaggtttacaggtttaaaccaaagctgaattcactacaacctcttacgtattttaattttaactctccatcaccttctacataggatttgaatctcttcccttaaccatgccccagtctaagtctcagttttttttttctgacactgtcatgccattaggatactcagagaattattcccctctgagaaaaaaatgacaaacaaattgaaatattaatttacataaattcaattttcatttttaattcaataactccaatcctgatcattgaattatggtaatcatgtccatatttgtttcattatcctcgtttcaagttaattaattgctaaatcagtgaacctctatataatgtaacagctagttattttgatggctcaaaaattaaaagtgacttccaaaagtttctggtttgcttaggcagttttaaaaagaaatcattcgtgtacttgttaaacaatagaagaatagtgtattggtccattctcatgctactgtgcagaaatatccaagactgggtaatttataaaggaaagaggttttattgattcacagtcctgaatagcttgagaaacctcaggaaacttacaatcatggtagaaagcaaaggagaagcaggcactttcttcacagggtggcaggatgaagtgagagccagaagcggaaataccagacacttataaaaccatcatatctcataagaactcactcactatcatgacaacagctatggggaaaccaccctcatgattcagttacctctcactgggtccttcccagtacacatggaaattatgggaactacaattcaagatgagatttggatgaggacacagcccatggtcccttccaatctcatgccctcacatttcaaaacacaatcatacctttccaacagttctccaaagtcttcattcattccagcattaacccaaaagtacaagttcaaagtctcatctgaaacaaggcaagtcccttctacctataagcctgtaaaagcaaaagcaagttagttatctcctagatacaatgggggtacaggcatttggcaaatacaccagttccaaatgagagaaattggccaaaacaaaagggctacaggccccatacaagtccaaaatccaatagagcagtcattaagccttaaaattccaaaatgatcttctttgacttcatgtctcacatccaggtcacgctgatgcaagaagtgggctctgtcagccttgggcaactccacctctgtggcattgcagggtaaaacccccatcctggctgctttcatagactggcattgagcatctgtgacttttcctggtgcacgatacaagctgtcagtgaatctaccatctggatctggaggacggtggccctcttctcatagctccactaggcagtgccccagtgggtactctgtgtgggagctctgatcccgtatttcccttccacagtgccctagcagaagttcttcatgatggctccaccctgcagcaaacttctgcctggacatccagacatttccatacatcttctgaaatctaggtagaggttcccaaacctcagttcttgacttctgtgcacccacaggctcaacaccgtgtgaaagctgccaaggcttgggacttgcaccctttgaagtaatggctcaagctgtaccttggttccttttagccacagctagagccgaagcagctgggtgcagggcaccatgtcctgaggctgcacagagcaggggagccctgagccagcccaggaaaccatttttccctcctaagcctttgggcctttgatgggaggggcttccatgaaggtctctgacatgctctggagacattttccctattgtcctggggattaatatctggctcctcattacttatgcaaatttctgcagctggcttgaatttctccccagaaaataggtttttattttctatcacatggtcaggctgcaaattctccaaacttttatgctctgcttccacttgaatgctttgcagcttagtaatgtcttctgccagataccttaaatcatctctctcaagttcaaagtaagttccacacatctctagcacaggggcaaaatgccaccagtctctttactaaagcagagaaagaatcacctttattctagttctcaacaagtttctcatctccatctgagaaaacctcagtctggacttcgttgtccatatcactatcagcattttggtcaaagccattcaacaaatctttagggagttccaaactttcccacatctccctgtcttctgagccctcaaaactttctaacttttgcctcttacctagttccaaagttgcttccacattttcaggtatctttgtagcagcaccccactcctggtaccaatttactgtattagcctgttctcacactgctatgaagaaatacccaagattaggtaatttataaaggaaaaaggtttaattgattcacagttctacattgctgaggaggcctcgggaaatttacaatcatggcagaaggcaacgggagaagcaggcaccttcttcatgtggcagcaggacacagggtgagccagcagggggaatgccagatgcttataaagccatcatatttcatgagaactcattcactatcatgagaacaacaaagggaaaacaacctccatgattcaattacctctcagggggacatagggattattgggattacaattcaagatgagatttgggtgaagatgaagccaaactgtatcaaatagactattcagaagtatcaagataggcatatgaactactctgatgggtttcgcagtagagaagagagattgagccaacttcaaatatagcaagaaaaagtgggaatttatagacaagaagcaggatggaggtcagtagatggaaaattattaagaggaaacatcagggatgagggggattctggccaaaccaccctaacagtactgttggtgaaagcaaaccagggtgaacagatatcacctgggggatggtggaggtgagagggtaatcagacattgagggaagggggttttggctaaaccagctcattaggattcttgttaaagttggacaatgcaaagacagacacagaagtaaaatagtcagggcctagttgggaagaggattcagaagagcctgattaaacattgttcgaggagagactgctagcagtggtagaacgtttcaaccatattgcagattagagtttagtggaaaagggagctttaaattcttgttgttctatttattcatgttctaagcaaaggccctcccctgtgagcactaacccattttagtgcattatgacatattccaggcacccactatactgtttccacagtgatgctttcagggtaactgttggtctgtagtgagaattctgccagttatctatgctaatgctcaagagtttctttatgccatcttacacactgtcatcatttattgatttacatttgggatggcttaattaagcaaattggatgaagtctcaggtattaaatgaatgtgaccaaaggaaaaaggattcgacagggtttgatagagaatagaaaacaaatgcttattgaaacagttaaatgaaaatttatgttatgcaaactttctcagtcaatggaaccctacctctcaatcttatttggatggatacttcaaaaattagatgtcaaataaagcttgctttgtctacaagaaagagtagatagatacactgccttgtctcattctgaatttattcatgggggagaaaatgaactaggaaaatactttaaaattgggataaaggttatagcaatgtgatataaattagttttcctctaagtgatttctccagacttttaaagtgatttttttaaaatctaagttatagatttattaaaaatgtggtcgagaactccacgaatgttgccattagagattagtaggtgctttgctttgaagaatggatttaattgatcagtatagcaatactcttcatggaaatatgtacccaaagttccctattgttggtttataattaattggccagcctaacatcttttcatgggtggaataaagaaaagctgccacatcaataaacagaaatataattaatagagttaaagagcagggaccctatctgtactggtcactttcttaaccctagcatttaacccagttcctggcacatcatagaatcaactaatgctggtggaattaataaactctattctaaaatacaatgtatgaaaatataataggctcagatatagtttcaggcataaaaactagataatttttatgtttgcttttatcttactggtttcctttttctagcttactacagtatatataccactataaaaattgattttttcaacaaaagagataaaaacattttctttaacatctattatgtttaaagaagaaaaaaaatgagtagtgtttcccttaagaaatagcttgatgtatacagcttactcttgtatcttgagagcaaaatcgttttgaaatctatatgcttaagaaaacagaaaagaagcttggagctgagatgcagggaattctgtatgtgcttggaaatgaagaaacagaccaccacggagcttgttaatcatgcaaaaggcataatcagcacagacttggggttaattgtagtcctagaaataaaagggtgttctacccattggattgaggcaccagcatcaggtcagtgttaagaggtaatttttaaaaagagcataattatgactctcatataaatataaaggatatttaaatcaaaaattttatttaactcccagttaaataatgagaaacccagtaagatgttacagtggttcaaaggagaattcaaataaccaaataatagatggttaatagataaattagatagatctgtagataagatagataatcaggaatgttaaaatgaatttacaaacaaatagatgcatagagacaaaataaatctgttcactgggcaataatccattgcattataccacagtctccatttaacacaagtaacccaatttgctggacaactttctttcaaaaaaacaataaccagtaatcttttgagccactttaaaatctcttacacattttccttgcatcactttcaaccaggcaaatacctttggctattcagaacattttagaatcagaagacctactgctgtttgcaccttaaaaaactaaataaattaagacatttacagacagaatggagaagcaaatctgagagtcatcacttagttcttaagacttctgactgggagtattaggttcattattataatatatcagtttaatgagacaatagctaatatgataatgtgtgggaaatcagatcactatgttagtgttcttcattgttcatactacaaaataacttactaggcatgtactttaaaattttgtctttactatagtgattccatatcctctcagagtaactttttttctggtgaaagctacttttaatttaaaatttcaattgcccatattaatgcagagttgattgcttttaaagaaaagtggcttgctcattgcttaataaggcaagattcagcactgtactcccccactcctagctttctcaactctcccaaccgagttaataactacaacaaattacaagcacaaattattaacacttaaaagagcatgccctacagttttctatacttaatatgatacaaaaatgtggggttaatggctgcattattaacagttatagtctcaacatattcagtttagaggtaatgcaaaactgttttatctgcatacaaacaataattgagaagaggcctaaaggcaaaaaaaaaaaaaaaaagatgaatttttttttctttttcctcagaaaaagctcttggatacctgtgtattttagttgttttaaatgtttgtaaatatagtggtttgcaaggaaattgggcatgttttctaatagaaagaaagagttaaaggatgcggtattgtacttttccttaatgatttcccaaaaagctaagagaaagaataaattacatgccaagagcctttttgggcagtgtgcttgatgtaacaaaattcccgtgattagactaaaataccattttttttcttttttccggctactttgtaaggcaatggcaatctgctttatataatagaaacttcttaagacatatttgagaacaggatcatccaaacactaatctaatgcaaaaacagaaaacaaaacctttcctatatatatacatatatatatatacacatatatatatacatatatatatacacatatatatatacatatatatacacatatatatatacatatatatacacatatatatacatatatatatacacatatatatatacatatgtatgtatatacatagtacaattcagcatcctttaactctttctttccattagaaaacaaatatacatatatatatatatatatatatatttggagtattttggaagtagcttgggatttggtggaacaaatttgggatcttttaaaaaggtctgaattcaaaatgtttgtatgacttgtaaaccattaaaataattcacggcatgtgtctggttaggtggaaacataaatttgtattcatgacttctaggaaatattttaaggaggattattgacaaattttagcacagccaatgttcagaaacgttcaaagaaacatcgctgtatctgttaatattttcattttcttttactccacaaagaactggactgagatcaccagcttatttttacaggcctaaaaactacatatagctttgtttgccatattatgtgtatacctgaattcatatgcaaaagtaaccatgtttcaagtgaattagcctgttagtaaaaggaccaccagaggatgtccatagccttcatttgaggtatacaatttgaatcagcatttgaaaaatatatttgtatatactcatggaatgaacaatttaaattcatgtgatttcaaatttataaaagtgaccttgctttggcattattaaattttcattaaaattatactcttttaaaccccacaattttaccaatgaaatattttaaggataagttttgttactgattttatttaagaaaaaaaaacacaaagcaaactgatttctgttcttgaaacaggttctttatagttttagtttgggtaaattctgcatgtaagtttagtatgtaattaaaggataagtaaaaatggaggaaaaagacacatctataaagctctgttggtatgtacttcagaactgtacttaccatggaagagcaattattttgcaaaattttatgatatctcaattgctgaggaatcataaataatatttctttattttggcagaagattaacaataaatgtttaggaatcatttaaaacttagaatataaattaaacactatatctgaaaagaatctcgctaatctttttctaatgaaattattactcataatggaataacatttttaaggacaacttaaaaaatcccctgaattaaaactgtgtctatcttatctaaaggaggaggtaaaaaattagaaaaagagaagagagtcacaaagtgaaaagaatcaaaccaccattgagaaaagccaaaagtagttactataaagtattaatcatcaattttatgatttctgatccaaattaaatgctatgctcatttatatttttaagaattgttgtcttaatattttattgctttaggtcatggtcacttcttttatgacctgaagtacatgtgtcagtaatatcaaccaattggcacctatcctcttttaggtagaaaaaaaatgactattatattgtaatactttgttctctctctcctcctctttctatttttttgttttttgttttcgtttttggatggttggtgatttgtttgcttctccgggttcctgttgatcagtggtgtttggccagtttgtatttttccagacatcactccacgatgttgttgaggtgtatgatgggccaactcagcaatcttctctgttatcttccctctcaggatcccattcaggtatcctttaatagaactgccatgcatcagttactgattaaagactgactttgattagtattgtagtgaaagttgagatttatatcatcaatataagaaataaagcaaactgaaaatagtgtcaccttttttttttctaaagaatagaaacaaaattaactcagaaggttgagaaaaatacaaccaactattctctgggattgtaaccaagtaaataatatatttaatcacttagtctctggtgtttaatgtaatataaaatatttaagaattctttgaagaatgaggcaatatgtataaaaatgtaattaaagctttctgagaaaaagattgcaatacaagttgaacccaaaggaaatatattggtagttgtaggatattttaaagtaatttgatagaacatagattgacattttcaaatgacagtgtaagattataatataatttgttaggtttactgaatgaaaattatttatgatatcttagtgtttgttttgttgagtaggagaatcacttccactgagttcaggtaatcagatcacaattcgatttacttcagttggaccaataacagctaagggatttcactttgtttaccaaggtaagtgaccctgtagtctagaaacacactaaggaatgatataattttcccatgatgtattcagagtttttgaatgatgaaatcctctagataaaagtgtttttaagcagttttattttgtcccctccaccatcactagatcactgtcaccttgaccaaagtaaacaaaatctattgcttccatcatcattctcagtttaaatgtctgattttccttccttcccacatattattttcaaaacatctacttttttttcctgacaatcctttactatctacattttctattttctaacagtctagcactctagactatttagtctaatttagtttagcactcgaaattaaagatataaaaattttggtgctgatgtacttaaacatgccaaggaaatcagtgttccattctaaaattatagtttctcattctctcaggagaattaaaactttcttcagttattaggacttttgtgcaattagaagtttgtttacacattttatttcttgcctgtggtagacaaccttctacgttatcattaaaccaagttaagagccattatttgaaatattgtctttgaaatatatatggtcatatagtagttaatctcaaatgtatcttgcactttattactaagaaatgtataaacatttgtgatttgttattcctattaaaccttcttaccccatttatcagttgactataatcctgtactcttttatgttaagtagtacttccccctggaaacaatgtgtggtattacgactgcaaaaaggcactataatgaatggaattatatttactcaagtcgcataagaagaattaatctatttagaattcatcatatcattttttgggctattgtcaatctctttaatcacatttgttatgtgttttaaaaagaaaaaacatcctgttatcattctattttactaaaccaaaaaaaaggcacaattaaagggcatacctataaaatctaaaagcaatttcaaatctgatattgtatgattattaaagtaaaaacttttattgttgttaatctgtctgacatatattctacctagtccaaatgtagttatctttctcaatagcaaatgtgtttgaaattaagtttgtgaaattttatgaaactaataaagtactgtttgcctttataaaatctgtttttaattaagaaccaaatactgaaaaaaatgtaaaattatttgatataacctgacacatattttttgaacttggtattctaagtttaaaaagaaaaaaaactttcagttttcatcccacaaattacaaaaatatctaactaaaactattttgtaatattaatgagttcggtaaaacaaaaatcgttgatgtttaaagaatcaaaagtaaaacttttctaataaaaaaccttgatgacaataacaatatttattttaaattatattttattctgtctgaaatttaaaactttaagaatgtattcaaattgttaattcaagttctgataaaaagtgatgatttctcaaaaatgtgtttaaacagttacattttgaaatctgtatttgtctaccatataaaattaaaataaatataatatttctacacagctgttcctagaacaagttctacacaatgcagttctgtgcctgaaccaagattcggaagaagaattggcaatgaatttgcagtcggttcatcggttctttttgattgtaatccaggatatattctccatggatccatagcaattaggtgtgaaacagtgcccaattctttggcccagtggaatgattccttacctacttgtattggtgagtatataaatttgtatgatctgtgattatacatagtttatataaaaattggttacatctttcaattttttaaatttcagatctaataattatgtacttaattttaaataatttaataagtatgctttatataaatatgaaaaatcagtggagatttgttgcaattgtcttggtgatgaaatcaataaaaaaatttgtgttgaattagctaaataatttcctcatttactgatttatatggatttatgtggatgtaagtaaatatatatatttccaggaacatagaatctgctgctactaatgtgggattatgaaggactactatccttttattttatttttttaattgttgtgggtacacagtaggtgtatatattaatggagtacatgagattttttttacaagcaggcaatgtgaaataagcacattatgaagaatgggatatccatctcctctagtttttattcattgtgttgcgacaatccaattatactctttaagttatttccaaatgtacagttaagttgttattgactgtagtcacactgttgtgctatcaaatggcagatcttatacactctgtgtttttgtccactacagttctcagactctggtagtcatcctttgaaataaatattattttttatttttaaaagtttgtgcaaagatttctgggccaatatgtaaagaattcagagatcttttaagaatccaaaagctgacttttctggaaatattttgcttggtcatcaaaagaattagaaaatatgaattaattttttcttactctattagttacagatatgtataaaaatataaaattataaattttttcagtctttcacaaatattggtggtaacattttgaatgagtaaaatgcataaggttagccaaaaatcttattgtttcgaagttgtttttgcaatagtatatctaacttgcattggtaaatagaatgtatactatctaaaattatggatatcttaatagtttagaattttatagtatttcagggtaattataatgacgcttggcttttgtagagttccatagacatagaaaatatagaaagtagggaaattactctcttttctgcccgaagaacatatctgggaatttttattattttttaaattacataatattaaattcaaaaaagagtggtaagacttaatctcaggttataaaataattctaatgacttgagttgtttctcattaaagttatattagtatgtgatgttaaaaataagatatgtgtatatatatatgtatatatatatatatatatatatatatatatatgggggttttttttttttttttttttttttttgagagagagtcttgctgtgtcgctcaggctggaaggccgtggcatgattacagctcccttgcaacttccgcctcccaggttaaagcctcctgcctcagcatagagagtagctgggattacaggcgtgcactaccatgcccagctaatttttgtatttttacaaaatacaaaagggaccaggtctcaccatgttgtctaggctggtatcaaactcctagcctcaagtaatccacccccctcggcctcccagaatgctgggattacaggtgtgatctaccgcacccagctgaaaataatactttttaaaataaaagataagcaaaatttttgttttatttttgttttaattttaataatcttaatagtccactctccatagggaggaatgagtgtgtatattgacacataatagacaatcataaatatataaaattactttttaataacacattttgccatatgaaaataaattatatttgccattcttatttttacctttttaaaatacatttgttcacatgtcagttcataggtcattagaataaaaaataattttaaattatgaaataacatagaaggtacattcatttctactgagaagagatcaaagataaatctgttgatatgcattcacaggatatgtaattttttttttttttatggagtctcaccctgtcactcaggctggagtgcaatggcatgatcttggctcactcaaccttgcctcccaggttcaagtgattctcctgcctcagcctcccaagtatctgggattacaggcacccaccaccatgctcggctaattttttctatcttttagtagagacggggtttcaccatgttggtcaggctggtcttgaactcctgacatcgtgatccacccgcctcggcctcccaaagtgctgggattataggtgcgagccaccgcacccagccaggttatgtaatttttatagaatatatttgctttaagtaaaatatattttttttaccatttaaatcaggacattgtcaacaattgtgctaggataatggtataaactaggctctcacaaataactaggaaggatggttggtcatttgatttctctaggaatttgatatcgccactcccaccccaaccccaaaaatatacctagcatatttcacagtgcatttttttcttaaaacaaatattttattttttccgtgacaatagatggaatctgaactattcttgtattattctgttatttgttgaatgaacacttacaaaaaataatttaaaacactagaagactgtaaatgactctccaattttcttatcttttagctaaataaccacgatttctgatttctgatatttataattttcttaatgccactgtttgccaatcctatcgtctgaatatttattctctccctcaccccaccgccccccaacaacacacacagattcttatgttgaaacctaatcccccatgtgggggtattaagaagtggggcctttggaaggtgactaggtctcgggggctctaccctcagtaatgagatttgtgcctttataaaagaagtctgaggaagcatattcagccttccaccatgtgaggacacagaggcactgtctatgaagcaccgagcaagccctcaccaaacactacatctgctggcaccttgatcttagacttcccaatctttagaactctaagaaatacatttctgttgttgaaaacttacctaatctatggtattttgttatagcagcctgaattgtctaaaagagcccgattccatgctaagtaatttaaatacatatttgttgcaatcctctgacaaatctatggaactgttacttttggaatgtacagatgaataaactgagtctgaaagaggtaaaatagttctctttaaagtggcagagcatagtaagggttagagtggaggcaggatttaaaactaagtttttctacctttgaaccctaaattaattgatagattactgcttctctttatgttctgacttataagctatttcccaattacatttctgcctcatttattgtgcagaattgctgactctattaaaatacatttttgacagtccacaaatacaggagataaatcagctggacttaatgttccgcctatcttgtgcctaccagagagctggggttaatatggcagagagatcctccccttaggtacttgcactctcataaagacaaaacaaataatgtcctcttttctgaaccacaatacatacaacacaatacattgacttcatactcatgaaatgttataaataacatttataacattctgaactaaaggaatcatgagctaaaagaaatgtttctatatgtctgtgaaaattagtcatgcaatatgcataaattggaaattacattgcttgaaatcagtttaataattgaagacagacacataataataactctcttcaaaactcacagtagatttttaaatctttttctgtaattactaagaatcattatttctgcctcactttccccagtaattatttacataatttctgtgtcacttttaatatatttatgtaggtattgacagaaaatatcaatgctgtaaaaatagaaggacttagataagtagttctcttcatttagtttcatataatctactgtaaaaacagagtaatataatgacatggaaattcataaactagttcattaatctttaaatatcatcaaaaacccttttattcctttagttagagtgttcaaagaacctacatatgccaagaactgaaatgtaaatgtatgaattaatccttaaaggttctgtttgtatatctatcatgttaatgtgctaattaacgtgaaaggttgtaaagaattatgtaaaattgagtgaaatcatcagagctgggaattgtactaaattatcagcacaagagtcgtgggtgaatgtcttcgctttgtccgcatgactgaattgaagtgagttacaataagatcctggaaaatttacataatctctgatcttcaaatcccataccaataaaacaagaaaataagaaaacttcttcataggttcattatggctaaatgactaaaagccttggcttagttcttggaacctaataagcactaaagaaaataggttgtttttgtttttgtcaaataagccaccacaaaatcaagagagaagattccaattctaaaagtattcgatgcagaatataggacttaatatgcagtactgatcaagtgtttgatactattgattttaatttgttgacattttatttttaaaacaatttaaagttattatatggaaaatgtgccttccacagaagatttttgcattttggaaaaggctgaaagcattgagtactgtcattctttccaactctaatttaggattccttgaatgtttgacttctatttgcatttaaaatttatatgaaagtttaggaaaaatgtgttgattttattgaaaatactagtaaatctttattaaaatataccatttaggaggacagtgaaatttccaccaattaatgcattccaggtcaaatggttgaggagtgtacttaaagaaatagacattttggtttgttttcattgttggcaaattttttaacataaaataaaaacaaagttaaaataattattactacaattttaataggccttgcaagtatatatttaaccaatgtttatgctctgcttttcttcttaccctaaaaatttaaacatcacattatccaaagaaataaatattcttatatccatgaagacatgcagatgagacagagttagaaagaggcaagatatagatgggagaaatgatctgtcacattaaacagagagagaaaaggaaaaattaaaaaaaaatagcaaaatagcaagcgaagagaagtgagtgaagaaagtgaacatttgaagagaatatttgtgaaacatagaatagagaatatgagactataaattttattttgtttttatttttattctttttgaaatggagtcttgcactgtcacccaggctagagtgcagtggtgcgatctcctgcaacctctgcctcctgagttcaaacaatcctcccacctcagcctcccaagcagctaggattacaggcatgcactaccatgcctggctaatttttttgtatttttactggagacagggtttcaccttattggctaggctggtcttgaactgctgaccttaggtgatctatctgcctcggcctcccaaagtactgggattacaggtgtgagccaccgggcctggcccaagactataaattttaaaccattaaccatttgtgtctgaaactgaagagggcccctattctacatgattattgcaaagtgtttttgtatttcaaatgtatcaattgattaatcccagcattttagccatcaaaaataaaaatctatataaaaagagtaaggtgatgctatccaactaaggatttatcttagcaagtacagtagctaacaccaggaactaaagcctatgaaaggctttaggctgttacctagtctattactgatattccacttcaggagtgaatgctagtttactgttctcaacctagattcagccagaactcacttcctacttttagggcaaaagatgtgggtacccaggaacccacaccatctctctgtcagagatccagcagtctgtatttcctgggctttttgagaatccttacactgcatccatcaggagtctttagataaagaacagactacttttgattttgcattgattcttgctatggtttaaatatttgttttccccaattttttatgtaaaaattctaacccctaaggtgattgtattgggaggtggggccattaggagatgaccaatgggattagtgtcctcataaaagcaacaccagggatattttcacctgttctaccatgtgaggacacagcaagaaaatagctgtctatgaaccaagaaaagggccctcatcagatactgaatctgccaatgctttagaaaactttgatttcccagcctttacaactataagaaatacatttctattgtttataagccacctagtctatgtttttttgttatagtagcctgaacagactaagatggaaaattggtaccaggagtggggtgctactgtaacaaaaacctaaatacgtggcagcagctttggaactgggtaacaggtgtaggctggaagagtttgaggtgcatgctagaaaaagcctacattgttgtgaaagaactgtaacgggaaattctgatgagggctcagaagaaaaggaggaaagctctagagaaaggcaacatctttttactaaaatatctaagtggttatgaacagaatattagtagaaatgtggatagtaaaggtaattctgatgaatccttagatggaaatgaggaacaagttgttgaacaatagaggaaagaatattcttgttataatgtggcaaagattatgccactttataacaaaagtggctgattgtgttcatgttctggagttttctagaaggtaaaactttaaacaatgaaattgaatatttggctgagaaaatatctaagcaaagtgttaatggttcagcttggcttctcttgactgccaatgatttaaacatggaattgttaattgattggaaatcgggaccaggcacagtggctcacaactgtaatcccagtactttgggaggccgagctgagcagatcacaaggtcaggagttcgaagccagtctggccaatgggaaatctgtctctactaaaaatacaaaaattaactgggtgtggtggcacacacctatagtcttaactactctggaggccgaagcaggagaatcgcttgaacccaggaggcagaggttgcagtgagccaagaatacaccattgcactccagcctggctgacagagcaagactctgtctaaaaaaaaaaaaaatttggaatcaaaacttctatattttaaaaactttcaacctacctgtattgggaaaatgggaagacctattcaaaagagaactttaagagtttagccgaggcgggtggatcacgtgaagtcaagaatttgagaccagccctggccagcgtggtgaaacctggtctctactaaaaatacaaaaattagctgggcgtggtggcacatgcctgtaattccagctactcaggaggctgaggcaggagaattgattgaacctgggaggcagaggttgcagtgagccgagatcgtaccactgcactccagcccaggcaacagagcgagattctgtcttaaaaaaaaaaaaaagagtttaatcaagtaacgtttgataagaagattagtatgaactcacaatctcagtagaagctagaagctattcatcaatacaatgagagcattagttagccatctaaacagaagccaggacctattgtccaaaacaaaggaagaatgaacctgagtgcattttagagatcatccaggctacccatccagtcacaagcccatagtgcaagggccttggagtcagatttcaaaggaagggccttaaacctcaggctctgattcatgcagtctgtcacacagctgcttggctacatagggatagttcctgtgggtctggctcaccatgctcggtacccaataaagctatggagatgtggttgcctttgtgtagatttcaaagggtgtcctggaaagcctctctgcccaggcaaagaactgccataggggtcatgtggatagccccacacctttagcattgccttgtggaaaaatgtccagtggagctacagaggtggggccaccaatatgatcatgaaacagtagagccactggtgtgtgatgttagtcagggagaaccacaggcatgcaactctaacctgtgagagctgtagtatgtattatgcccagcaaacctacagaagtaagactataacctccagtaggtccagaatgtgggaccttccctgcagcgtgtctgggtggagacctccaacctgtgagtctaggaggtgagaccataggcccagtgggactgaagaacagagcattgaatcaaagagattcttcttgaattttaaggttttggtcctgcttaagatctgttacccctttcttctgccctgtttttcttttttaagaatggaaatatctgtcccgtgcctgtctcatcattgtgttttgaaagtagatagtttgtttgattttacagactcatagccggaggtgagtttgcctcaggatgaatcatatcttaaagtgtcacccatatgtgattgacatgatatttagatgagactttgaacattagacttatggttgatgctggaacaaattataacttgtggggctatagggatggaatgaatgtattttgcatgtgaggacattaattttgggggccagcagcagaatgctgtagtctgaatgtttgaatcccccaaattcatatgttagaatcctaacccataagatgatagtattgggggcagggattggaaggtagttatgagggcagagctctcatgaatgggattaatgctcttatgaaagagaccccagagagatctctagccagttttaccatgtgaggacacagccagaagacggtcgtatataatccaggaaaggggccctcagcagacatcaaatctaccagtgctgacttcccagcttccagaactgtgagaaataaatttctgttgtttataagccacccattctatggtattttgctatggcctgaatagaatgaggcagtttaaaagtgcatatccagagatagaaaattgtgtcatatgacttgtattttctgccaagatcacatgaaaaagacatattaccttataccgttttaaaaatattcttccttgtggaacaggtgtaaatccataaagttgacaatatgacagatggatatatggggtctatgtgacagaagaaatagaaaggtgatgattctaaatgacattcagaagatagacaagtttaagttttaccatttggtgcaactactaatctttacataaatgaaaatatagtttgcatttctatttttaactataaatatttttagcttcaaaatgttctgaataaaaatggtcatgtcttaaaatatttttaagatagaaaaagctcagtgtcttaaatattcaaatgtgagagtcaagtacagagctatcttacgttaatatcaaagtgttctctttaatttgtgctccttttcaacctctgttaactgcataaaacatctgccccaaggtctttgaatttcttatttcctctgattagaacagatagctttttatctcactacatcatttcattgaagtctcctatttttcttggccatcctatctaaaataattttctgccacccatcaaccgtttactctttataccattacctttacagcaaccatcgaactgtattatgtataatttttggttgtaaaacatttcttaatctgtcttaattgtccctctttccattgtcactatattggttttgggctcaatcaaaagaggacttggcacacaacaggtgttcagcaaacttttattcagtgagtggattttagtaaattactgtatcaatttcctgaatatttgtagagggtctgacaacccttaccaacttcccaagtccaaggtccatactttttccatttcagtattccaccacatggtgatactcttgcatagtttccttgcttaaaccttcacaaatctgaggtttcaaactcttctgacatctgcaggaaagatatgtatgttggtaaaacacaagcaaaagatttacatattatatggggagttttattctgagagagagcaaattctccatttaccctttacagtttagatataatctttgacagcctatttacagggttttatacatgatgattgtttttctgtcttagttcaatgaatgctcagttaataacttaagccaagtcagcatccaattgaaagcaaaacaatactgctttctacattcctaatgatttccctctcaattgtatcatttcagtttcacagttcttattattactgtcaacactgtttttttttctgtcacagtaaagcacaagaaaatgttcattaattttgcacacactgacatactaaaactaaactgttgattggaaagcagccccataagacatgatatgtgagttgtgcttatagttaaaatggtcaaatactaaattagaagattcacaaactttaacaaccagtttttaaacaatatttaataatcttgtacaaagctgtagttccaagcctttcttaattacaataaaatacaataaaattttacttaaaaaaattagacttgagaccaatgaaaaactgaaaaataaaacttatgctgaagactgagtttttatcttccaaatttgaccttgttacatttcacatttcttaaactatgcagtctcctaaacccccaggctttcctcccttttagactctgtgattcaaataaccccctgcagccactaatagctttgacaatatatgaccttaggcataagtacttctgttagtgggaggtcttttttgaaaagccctggaagctgccacctactccccttaggcaaagagtctttaattagctgcttatctgatcatgcttatctggttctgttttttcaagttctttagagacccagaaagaactacttttacttgaaagtctccatggcaacacctgtctacttcatcttttcttagaatgggaaaaaaagttcatgaagaaatatatacaaactctccatctcattcatttatccatttattcatctatccattcatccatgaaaaagttattaaatacaataataaatagcaatttttggcatttgaatgaagcactattaagcattatctcatttaatattgatatcaactttggaaggtagatataattatctctattttacagatagtaaaacctcttggtttagataaaaaggcagaattggatttgaacttaggctgcttgatttgaaagcctgctctattaatccacatattatattgaatactgatcagaacagaaatttatcatatatcttttaaaaaacaggatgcaaatgttagattgtggtattgcgtatctgctaatttttctatagcatattttgttggtaaataaataaatatgattgcagtagaattagacaaatatggcttgtttagaaaaatactgggagacaggaatgatgcaggaatgataaagaggtaatttgaaagcacaagatatgtacagatacacaatcagttcttcagtgatttattcagcaataatttattgagtgcttactgcatgccaacactattctaagcactggtgacatagttttgaataagaatataagatctttgtccttacattttgcatttacattttacattttactggaggaggacaaaagtcatcaagaaatatattcttttcttttggggagtgagaatgctgtagaaaaaaataaagcaggagctggagttgcaacaagacacccagagcatgctgccattttaaacctgaataaaatgaacagagggagggatgaataaaagtctttcttgttggtgagcaagtgtatggactgttgagggagagagatcttgacgtgttcaagccacagtgtctggaacacagtaaatgatagcaaagagtgataggagatgagtttagagaggcagagcagagggccaagtcacatggatccttgaagaccacggtgagtttgaaattttcctaactagtatgggaatatattgagctggggagtgatatgatcttaatcagtttctaataaatcactgtagttagtgtagggagatgtggagtagaaccaatatgactgattagaagcctatcaaggtaatggaggggaaaagtagtgtgatttggataggaagattatggtcacagtgatgagaattagtaagctttgggatatatttttaaggtggagccattactgatagattgagaatagatgtaaatgtaaacttgactgcaagaaagataaatcaagatgaatcttaggtttatggcctaagaactgagtgaatggtggtgacaatccctaagatgaaagagagtgtggatgaagaagaatttcaaagttattattttggacatatccattttgagatacttgttagacatatgattgcaaaactcacagaaatcacagctagagataaacatctggtagtcagagtatatagaagacatggaaggggggacagtgattagaaagagaatatggcctaagacaaagttacaaagaggagaatgagttaaaaaaaaaaaatctgagtgcagccaataatagagaagaaaaccaggagagtatggtgttctgatgttcaagcaaacaaaggctcaagacagatggagtgatcaacagtgagagctaattattcatagattgagtaaaatgcaagttaaggattgatcatatcacaacattaatattctggtgactttgacatggttatttcaccagagtagtgaggacaaaagtctgatgcaatgcatgaaagagaggatggaggaagaggagatagcttgtcactgtagcagcatggaagaaaatttataatgcaaagaagaagagttagaatcttgataaacagagtttcaggcaaaagggtgaccttgtctgctcagacttgagtctgtttcaagagactaacataaaaataatacggaagcatagtatgataaaattgtacaggaaaacatttggtgctatggtaaactacaggacacttaacacagggaaattccaaagggttgaagcggtaacattcacactgaaagtccatagatgggtaggtgttagctaggtgagagaaggggacaaatcaagtgacagcaataagaaagcatattagtttagaaggctggactgggttgggggattaagatgatgaggacttgggaaattatagttacatacaagcctggagatgaaatcagagactaatacaattaactatatttatctgtaggccgggcacagtggctcgtgcctataatcctagcactttaggaggctgaggcggcattgtttgaggctggtgattcaagaccagcctgagcaacacagatcctgtctctacaaattagctatataaaaattagctgaatatctgtacacaaattagctgggtgtgatggcacacacctgtagtcctagctactctgtaggctgaggtgggaggattgcttgagcctaggaatttgaggctgcagtgagctataatcacaccactgcactccagcctaggcgacaaagccagagcttgtttcaaaaaaaaaaaaaaaaaaagaaaaaaaagaaactatctgtgagctgtgaattcagacaatggggaaatttttgaaggattttcaccagagaagcaacatgtcatattttaatttagaaaaataattttgacagtattttgaaaaatatagtgcatggaaaacataccagccatagggaggccacttatttgattaatgtagtaactcagaaaaaaaaaaagtacgtatgaggaaaagttgtggcggtggcgatggagaggaagagcatctataaagtatttttttttcatcagcaggatcaacacttcatcaattacgtttttgttctattttttgggtgaatattttaaatttcttcctctgtcttttgcatgtcattctcaaatcatgcaaaactgctggttttctatttaaattagctaaattaattttgactaatttaaacagaatttgtatataacccatttacagagctttgtaagaaaacacgactaagtgagtttctttaaaaatatattgtcacactattttaaaaagtttgcaacatctttttttttttttttttttttgagtaattgccctggtttttgcgtttgtctttggaagtggcacaaaactgtaattcacttttaaaataaattattattacaaaagatatgttctttgtatctcatcatttatagccatactaggacaaattccccaggagcacagtacaattgggacctaaaataatatttgtagcaaaaggaaatataatttattgatttctaactgttttccaaggtgtgtgcttgtttcttatgtacattctagcttctttgtatttttcacaaaagccttttagaaacaatagagttaccattccacagataagatatctgtgtttcagagattgtaaagaacaggtcaaagtcacacagaatttaagagttatgagttaggtcatggccagaatcaaggtgattctattaatggcatgagaattttactttcagactagtaccttctaaaaatgatagaagcctttattgacttctgagtaggtctgcatacatattctttcttgtagtagttagactggcaataactaaactgggaccacttcaagtatcttcagttccatctaaggacatggactctggcttcaactgccaggattcagatctcagcttcatctttttttttttttgagatggagtcttatcctgtctcctaggctggagtgcagtggcgcaatctcagctcattgcaacctctgcctcctgggttcaagcaattctcctgcctcagcctccagagtagctgggactacaggcgcccaccatcacgtctggctaatttttgtatttttagtagagacggggtttcaccatattggccaggctggtctcgaactcccgacctggtgagcctcctcagcctcccaaagtggtaggattacaggcgtgagccactgcacctggccagcttcatctcttcatatgtgatcttgggcaagacaatctcttaatgactccatttgattgcctcagctgtagaatgtggagagtacttagtcatctcattagttgttggaaggcttaaatgagttaaaatatgtaaagtacttagaagggtgcctcgcatatagtaggctctatataaatgttatgatcataatataattgttatcatcatcctcattactttccagtggatgctgttactcctcaaagaatgcatgaaggagaaagtaccaaataattttttaaaaattcgagacaatttttatctaaaaatgaactatttttaaggcaaatttagtcaatgcgtgttttagtaatataatacaaatactatgctgttattgagttaattgtagtgtgatttttagatatgccattcaaaggtcatccattaatgctgtctaattatttgttatcgtttccatggtatacaaaaacttcattttcattgcttttatcagttttgaaaaaagtatgatttgatttgcaagtctagtatctgtctaagatgttatctctgacctttactcttattttaatcctttgcattagaattaactccctctcttggactgctttattttcagtgccctgtggtggaattttaactaagcgcaaagggactattttgtcacctggataccctgagccttatgacaacaatctgaattgtgtgtggaagatcacagtgccagagggagctggcattcaagtaagaatatttaagtttttcttcttttcattgtatgtgtgtagttaatcttttcagagatgacagaatgaacattatttctaaaagtttagcaagtggttttgactgacatggttgaaatgaatagaaagatatttgttattaatttttttcacgtagaattaacagaaagccaattcaagatggcataagcaatacaaaaaaaatgtgttaaccccatataacatggaatcttgaggtaagcagattttaaacattatttcaggggttcagtgtgtctttcctcacccacgttatttccatctctctgttctgccatgctcagcctgttggttttagttcttagacaccttctcctgaggtcttgaggtggctgcaaaagctctaggcgtaacagccctacatagcaatggccagcagctaaaacagaatgtccctatgttatgtaccatttcagtggttaagaaaacttttcaggaaacctgccagcagactttccctcctgttttattgaccaagattgcaatcatatccgttccaaacctatgcaatgggcaacaaccaaagatttactatgatttggctcaaataaaactatattacgtatcaggagtaagcaataagtgcagcctcctattatgcacacatctctcacttaattgaactaagccagatctgtgttagcaaggaaggaagatgctctttaaaaataggtaatcaacagtgactgtcctgttatttgaattatggctattttgggggctgctatttgaccagttattctgttttacataaagatatatattttttctggatgaattgataatattttactgcagaatcagtatatatatcctatgaaaggtaattatgcttcataaatattatctagccttcacagatataacttgattacttctctaattgatttgtagagtttttctttagaaacttgagacatataagagttgtggaaaaattagccaagatgccatgcattaataatgaaattagattgaagcataatttttagtaaaaaaaatcagcttcatggatttataattgttcagacgttttaaaaattacttgacaggtgttgggagtaaaatatgccagcaaaccaatgacaaaacaaaaagcatgtacattttcagagttttaaggccatccaaagattatagatgcatacttacattcttgctagtttatagacaatttgtcaaatttgaagataacgaatcaatcctatcttattatagtagaataataaggattttgggattgcccatgctccagcttgtatagaggatctgaaatgatatgatacctttagaatcttcatagaacttttaccacatcatctggttataatcttctcaaggttattcaagagcatctatatattaaatcagcttacttatttccatctaatcttaaaattttgaaaaccctgacatgttttctttagttatcatcttctctttttgacccactgcaatgtggcttcagcaactaatactctaatagagccagtctcatagtgaagatctaaatatgattaaatccattgtgtggttcatctttcttgctctgtcagcagctctctatcttgctgttcctcccctgactcctaatagactatttttttctccttagatcctaggacaccaatattttcttggattttgttttgttttctcttctacatctgtagctcctacttctatatctactacatggtctcctcttgcaattcaatccattgttcaaatattagtgtttatgagattctgtggcctttgttcatttcactttactctctctgggaccttgtctaattccatggcttcagctacttttatgtgttagagatgtcgaggacgtaaatcataatagataatcagaaaacatatttttgaatgagggactgaataaatgatgacatgcagacctaaatatctaactcagacctctcacctaagctgcaaaacatatgtccgactgcccactggacattttcagctaaacttcttgatggcttgtcaaattcaacctctaaaactgacttcatagaattttctcaaaactatagaactttctcagtgttctctttctcagaacaacttcctcatccattaagttacacaagtcagaaattttgattcttttctgactcttactcggtacaatgaaattcgtcaggtttgtctttcataaatctcttaaacaaatctatatctctccattcacacttttactacccgagatcagatagcatcacccttgtcccaggttcttattctcctgcagtctattccctgtacgtccagtagagtaaccatctgaaagtaaaaatctaatactatcattttcttgtatctaatacctcagttgtctccaatctccttatctcttttgacactgtcgattatgccgttgtgctctgttctcattttgtaactattctatctgcactatttcagctccttataaaaacctagcttcattttgcctctggaccctttgtgcatgttgttctttctgtgagcactctctatgatctccttttatgttgcttattcttacttaacatttctgtctcaacttaaatacattttctgtggaagaccttccatgaacttgagacaaggttaagttctccatcatatttcaatgttactactaattatctgtaagctcatgaggacagtgccaagtccattctgacaactagtacagtggaagtacatgctgcacagtgcttggcagtgtattctcagtaaatatttttagaacgaatcaatgaatacttgcacaagtggagttttgactattttagagttagcaggcataacgaactactaagatgtttgcagaaaaactgtgttatatatcacttatcctaggcaaacactattcaaaactggacacatatgaataacactaaaatctttcactgaggaaggactttgtttattgactgtactttagaaaacaaaatttgagtttagcagcacgtttagcaaacatatagtgtgtaaagcatttggggcttttaattttaaacacgctaaaaaaaaactatcaaggacctttttctaattaaccatttacatggatgctagttttagacatatcactgagtcatagaaacttgtaacacacacacacacacacacacacacacacacacacacataatatatgacttacatttgaaacttcattaaatttacctaaaagctatctggctactaccctaggtttaaagcaatgtttaatatttttctctgttgggccaaatatgtgtgtgaataaagaattgtatgaatattcaataaatcatatatgagataaagtgggataatcattcttgaaaagaggagaaaagaagaaacatatggaatgctgaaaaattacaataatatagaataattgaacattctttgggaattacctgaacaaacaatttgttaatattacatgagaatttcccactctttgtggcaaagagtggattcatttgtttgtttgtttattttagcagggtctattggagaattccagtgcagctacattcaaaattagcagtgatagccatcaagaaaagggaaatatttatgtaataagccatgggggaaaatatgttggctacattattgtatcaatttacagcatgattatcgtgattttatataatctaaagtaaaatgtaatttgaacagttatatgatagatgcctagttttaatgattggaaattcattacctcatgaagctattccattaccatgatggacaactatatctaacgcaaagttactctgaacactgaatcagtatttacctcttttaaaatctttagttgggccgggcgcggtggctcacgcctgtaatcccagcactttggggggccgaggcgggcggatcacgaggtcaggagatagcgaccatcctggctaacatagtgaaaccccgtctctactaaaaatacaaaaaattagccgggcgtggtggcgggcgcctgtagtcccagctactcgggaggctgaggcaggagaatgacgtgaacccgggaggcagaggttgcagtgagctaagatcgcgccactgcactccatcctgggcgacagagcgagactctgtctaaaaaagaaaaaaaaaatctttggttggctttcatgtgtcttctgtcatagtgagtactcgatcatgtatttgagtcccttaacaaatctcatagcattgtctgccagttcttctggccaaattctgcttctacactctttatatttttattatgccaaactacattcacaatgtacctcgaatcccagtggcaaattatattacatctctctggctgctgtaacaaattaccatgagttttatagttacaaacaacagattttatttttttcctcatagcgctggaagcaagaagtccaaaatcagctttactgcactgaaattgagatgctggcagaacctctcctccctcgtccctgcccacttcagggtctcaggaatgacagcatctcttccttggttttttccagcttctagtggctgctggcatttggattctggccacatcactccaatttctgcctccgtgttcacatcgtcttctcttctatgaatgtcgaatctcctttggcctcttttcccctttctcaagattcttaaattaagctcatctgaaagacccttttccatatacggtagtatttagaggttccagagatcagaacctgatatctccagaagccattattcagctatatacactagacacatgtatccagaagtaaactgactttctttctcccacctaggcaatagattttcttggagatgtctacatttttgctcttgctaccccactactctcaataacagaaaagaaaataaattattctcaaatttttcctttcacttcctcccctattcaaatcacacaaaatttaataacttcctctacagcaacacatgtgacgtctgggttcccatttttactactcctgcctccaatacacttgagtctctcattgttttttactgcaatacatattgaaatattactgaaatagatattgaaattgtctttcacttttactttcttcacccaatgcagtgctgtacttagagcactgtcttaatcatgttcttcctccgacttctgaaaccttcattggaaaactgaagatatcaccacgtcttgaagtgcatagttgctatgctggggtttagttttttattgagtttctcccctgatcttcctcttagctaagctttattgagtctttactacatgcagggtgccttatatgaattaactaatttaatttttacaatgaatttatgaatttgatacccttatgacaataatttatgtaaataatctgaggtacagaaagatgaacaactttccttgaatgatatgcccatgaggagagggagccaggaagttgcaaacctagcctctttgattctaagttctcttgtatttagctactgtactctactcttttgaacttttttattctttctcgaacttttcatgtatatttattcttatgtaaataccccccactgtagctaaagaagattactcatggtccactaaatctagcttatggtttgactccttttacattgttagacactcaataatttccttcagtggaataactcaatatcttcagcttagcccaaatgtcaactcctgcgtgaatcttcacattttttaaaaagctgaatgcagtattttcttcctctgaattgaaggaaagggaaatttagatatgaagagggaattgataattgtttaaggaggtggcggttatactacaatcatacggctttacttctggtcttattcctatcttagaacactgccattgggtctgatgccaatcatacaggcagggtatctattgccatgtggcactcacccctggaaacaggcaccagcattcacttgcatggaagaataatgatgggctattttgcagataataaatttttaatgagtgaaattgttgtaattatttagtgaatgagtgcagtgcatacatttttaacagattttagcttaaaaaacttttaataaagttattcctttccttcctctaaaaccacaaaaaatttaataaagaaatagcaaaataggtagcatccgtagttgtgagggtcctgtgggttcttgcaaaagctcaagctgtgccaagtgatgtgcaataaagtaacacatgcatctttctctaaataaactgtaatagacaggagagaattaaacctccccagtattttccttctcaactttaaggaccttcactgtgacgtagttactataactctattcattaaaataaatttttaaaaattcatttgaattaattacaaaatatcatttttttgtgtcatccatactgaaacttattaaaaatatgcgtgttaaaaatttttaaataaaaggaagagaagaaattgagcaaagtttatgcaaggaaaggataaattaaaagtatccagaaataaacctggttttaaaaaggtatattataaggtcctacaggcttgtagaccacagatctggtttttcctaatagctacaagcaaattagaaaactcaaatcagtacatatacataaaaattcaccgattgttttgaacatgcattgagattcctggcactgagtcattagattagctcaaatcttttgaaaagagaatgttctgagatagtgacagacattgctctggttatacccacaatgaacattggtcggtgcttcaaaggcttttctatataaaaatcagctcgtgtaagccagtgcaataatggaaaaaatcagttctgttaaaaacccttctatgaagggtcacaattatgtggttcaggatttgaactctcttttccaagggggattggtggactatagttatgtgtatctggttagaaatgtgtattcttacctgtaattattatttcacaggtgcaagttgttagctttgctacagaacataattgggattctctggacttttatgatgggggagacaacaatgctccaagacttggaagctattcaggtaaataagagagctgagcttaattaaaatacagatataattaggaatataaaaaaaattaaagagctatctacaactcttacttggtagttttaatttgctttttacaaactatacacaaagatacaaggactgaagtttaaaagatttaaagatgatatcaatattgatatttaaaaccttattacattcttaccaattcttcctatatttgtgtaattatttattgatggttttatgttactggtaatattttcagctgagttagggttcaggaatagtatgtacgctcttttccttaaaagaaaaggatgagcaataataattaaaaattagactgtgctttgaattgtgtgctatgaagtcatgaaaataaccaggtaaatgctacaaggtactgttaaatgagaataaagagaatacagaattatttctatgaaatgaataaaattatataaaattagtgtatacatgtttaacaagaccagaaataaataaaatagaagtcttatatttttatgtaagatgttgacttgtttttaaaatctgttagatttattaaggtttttattttttgagatgtagtctcgctctgtctcccaggctggagtgcagtggtgagatctcagctcactgcaacctctgcctcctgggtccaagcgattctcctgcctcagcctccagagtagctgggattacagacatgcgtcactacgcccagctaagttttgtattttttggtagagatggggtttcgctatgttggcgaggcgggtcgtgaacttctgacttcaggtgatccacctgccttggcctcccaaagtgctgagattacaggtgtgaaccacaacacccagccagatttattgaggtttaaaaggtagtttatgcaataatttaaaagcttcttttgacatatagaagttaaaataaaaagttttactttgttaattttttactattatactttttaaactctagaaatataaatatagctaacatattaacttactcaattcagatatgctgaaataaatttgaatggctttaagcttttaagagatttttaaatggacttgtggaaccaattacttatcatcaccaatgaggaaaagaaagaaatatctggagcaagagtgatttgatttaaacatgaacaatatagatttagatagaaatcttagaaaaatcgcacacaattttagcacacttttatttgtaataggttaggggtaatactttattagtagtattattaattttttttttttttttgcattttagagacagggtctggctctattgcccagactttggtgcagtggtgcaatcatagctcactgcagccttgaattcttgggctcaagtaatccatctgtttcagcttcctgagtagctgggactgcagtcacataccacaaccccaattaatttttattttattttattttttagagctgaggtctcgctatgttgcctaggctggtttccaactcatggcctcaagagatcctcctgtcttacagcctcctgattagctgggattgtaatcccatgattattacatgagccaccatacccatctgtaatacttttaaaataataatgtaatgataatatgagtgataaataacagctgttgattactaagtgctagctctgtgtgacatttgccatgcatttccttatttgatctttctagcagacctggtaggtaattgaggcttagagagattaagttgcctgaggttgtacaactaatgttagaatgagattgggacccacctggtgtgactccagaattagagctcttaatcaataacatcctgtaagagacttaaggcaggtgaaatgaccttttaagtttctgtttatccctgtcttcagtggttgctgttatcacactatggccagaaaagaagcaagtgtgtgctgtgtaataaattctttctgttcttccatagaagacatcaggggtgaggtccacaaagttgcgcaaagcaaatgtaaagaaagtagttacttataaagaaatgtttgtaatgacctcaactcatatgcttgttgaactatgtcttaagatgtagaattagcgcttgtttattttcatgcttgccatttgaaactgctagaggtggagtcaaagatcttaaactctttgctcaatagcaaagtcaagaaataattgattcaagcagatactttatattttcaagctcaataacttaataaaataaatttgatctccttcagaagtccagaaaaatatcattataatgcatttgctgaaagacaagagtaacagtagttcataattggaatttttttgaaagctgactaccagctttgctgtcagggtataagaaacattgaggcacttgacctggtatagaataatctatctatctagctgtctaactttaattcattattaaaaggaaatcaatgactatattatctgactcataaaaagttgttactttgcaaagttcaaaattaagcttattatttattcttttttagtttgcaaactgtgttttattcatattttgtgtttctttttagttagttcaccaatctggtacatacaggcagttaaaactggttatcactttgacaatcagaagcctctggtataacacagtcttcaaaaaaacatattggaaaacagagagaatacagagtaataatctctttgaaagcaatcattgcaaacattcatgtttctaacagaatataactttacatatatatgtatttattgtttattattagcttgtgcacggaatactgaaatccacatgaaattcaacatttatttttggtgaacatgtcaaacgtatagctttaactttcacaagctctttttgctcctacctatttttaggaagcaatctaaagccatctcaggtggtctgtcttcttggaaacaggaatagtatattgaaagaggattgtgagaaaaatatttctattaaattttttttgaaaaacaacttgaataatgcatatttttagtggtattctattggctgattagtaaacttacttaattttattatagtacttattatgtggtcattgtcttgccttctcatatatcatttcaggaacaacaataccccatcttttgaatagtacgtctaataatctgtatctaaattttcaatcagacatcagtgtttctgctgcaggatttcatcttgaatacacaggtaaaaataatatcatgtgccattcaaaaaggttaagaacaagtttatattaattaaaaatatttttgttgatatgtacatattatagcaactttctcaaagaaaacattgtcttattttcttgaaagtttgaactattacttcagttcaattgcaaaattacatgaataaagttttaatggtttcacaagaatttacaagtttttttgttgttgagtaagaataattaatgtgaaatctaccctctcaacaaatgtttaagtgtgcaatattgtattaactataagtccaatattatgcaacagatctctaaagcttactcattttgcatgactgaaactttatacccattgaaccacagctcttcatttccccctctccctatcccctgacaaccactgttctactccattttgggtctgactattttagatttcccatggaagtggaatcatgaagtatttatcctcctgtgattggtttattttactgtgtaatgtcctccaggttcatctggatgtcctttggtctgtatatctgtttttatccggtactacactgttttggtaaccgtatctttgtaatatataatcaagaattgtgaccccaacagttttgttcttcttgctccagaattctttggctattcaagatcttttgtggttccatatgcatcttagtactttttttatttttggaaaaacttgtcagagattttgataagcatctagttgaatctgtaggttgctttgtgtagtatggacattttaacattattaaatattccaatccataaaatgggatgtatttctatttatttgtgtcttttgtatcttttctcgtcactatttagtagcttttcaggttttttggtttttgtttgagacggagtttcactcttgttgcccaggctagaatggaatggcatgatcttggctcactgcaacctccgcctcctgggttcaagcgattcttttgcctcagcctcccaagtagctgggattacttgtgcccgacaccactcccagctaattttatatttttagtagagacagggtttcaccatgttggtcaggctggtatcgaactcctgacctcaggtgatccacccaccttgacttcccaaagttttgggattacaggcgtgagccaccacgtcccgcctactattttgtagtttttagagtgcaagtctttcacctccttggttaagtttattctaaagtattttattatttttcatgctattgtagatggtattatttccttaatttccttttaggatagtttatttttagtatatagaaattacaactgattctttgcatgttaattttgtatcttgcaactttactgattcatttattagttctaacagttttttttaatggaatctcttcaacattactgatacataataattattcatatttctgggatacatgtgatgtttttgtacatgtatacaatgtgtagtgattaaatcagggtaattgtattatcattcataacctcaattatttatcatttatttatgttgggaacatttcaaatctttcttctcattattttaaagtatacaataaattaccattaactctagtcaccctgcttatcaaacatcagaatttattatttctatctaactgtatttttgaacccattaaccaacctctcttcatccctgccttccaagtcagcctctggtaatcatcattctactctacctccatgagatcaacttttttagcttccacctatgcgtgagaatatgcaatatcccttttctatgcctggctcatttcacttaacgtaacatcctctaattccactcatgttgctgcaagtaacaggatttcaattttatggatgaatagtactccattgtcatgtataccacattttccttatccattcatccattgatggacacaggttgattccgtgtcttcgctattgtgaatactgctgcaataaacatgggagtggaggtatctctttgatatactgattttgtcttttggatatatccggcagtgagatttttggatcttatatagttctattttccgttttttttttcttttttttaatgaaacctccctactattgtttataataccttgactaattttcattctcgccaacaacgtataagagttcccttttctccacatttttttttgtgtgtttgataatatccactttaactggggcaagatgacacctcagtgtggtccgtggagtcatcatgttgttctgcatttaggatcttatcatctgcagacagggacaattttaattcttcctttttcacttggatgccttttatttctatttcttgtctaattcctctggctaggacttccagtagtattttgattagaagtggagagagtggatatctttaccttgttcctgattataaagaaaaagctttttgttttttaccattgagtatgatgttagttatgggcttttcatatatggtctttattatgttgaggtaaatttcttatatacctagttttttgagagtttttaataatgaaatggtgtcacatacattcaaatactttttttgcattcattgatacaattatgtgccttgtattcttcactctgttaatgtaatatatcacatttattgatttctatacatttggccattgttgcatcccaggaataaattcctcttagttgtggtatatgatgtttttaaacatgctgctagatttggcttactatcatgttgttgaggatttttgcatccatattcaaaagggatattggattatacttttcttttcttgtggtgtctttggctttggtattagggcagggctgactgcaataaacaagtttggacatattttcccctcttcaattttttttgaagagtttgagaaggattgatgttaattctttaagtgtaaggtagaattcaccagtgtagccatctggtgctgtgcctttctttgttgggaggattttgttaactgattcaatcttttcactagttatgggtccatgtagattttatgtttccttaaaatttagtcttggtaacttttatatttctaggaattttttcatttttctgggttattcaatttttcggtgtgtaattgttcatagtagtctcttattcttttaatttctgtgacatcaattgtaatgcctacttttttattataagtgtttttaaattgcgaaaaagcaactagatgctgtagaaattttaaaactggaattaaagtggctactcttgacatagaaaatgtacattcatctcccaaattcctgcaaaacttttcatcataaaaatagattagttctcctgttaaacaactatatgaaacattgtgtcatttcacacataaaattatcacaaatgtaattaggtgagtgtttgggtaactgtggtttttcttacactctacttaaaatgcaaactccagaagacaaaaatctttcatagcagtttaccatatcctttagagtgtttttgtgtctttaacactgagtatagatcctgaaacttaccaaacaattaaaatatacttgttgaatgagtaaatgaataaatggacatagcacctagaggtagaagataatggacatataatgttggtatatatatcattaacattagtatacctacactgatgctggtgtccataatggggtttagaatctaggtgtgcatatgttttgtaattgtgctggcttctgcttcccactgagtattagctcctcaacatcacctcattcaggccacttagttcctcactgaaacaccattacctaaactggaagttttgaatgacgtgaaactctcagtgggagcgaacaacagctgcaattgataagcatgtgcaagtaattaattttttacttgttttggttctataatgaagtttacttttcagttattgctaacttcagatacaataaatgtattactgtaatgcaaatacatgtcaaatccataagacaaaatttattcattcattctttgttcaaccagcaaatattttgaacacctaccatatgtcaggcactatgctcgacatagaaaatgtgaagatagacatgtcacagtatttttctttgaagagtctagtagaagattcagaaagataaagcaatattacagtgctttgaatacagtaatagatatatttgtggtagatcacccaaaagcaataaataatcagctacatttaggaaattcagggaatacttcaaacaggaggtgacacttggggtgagtcttaaaatataagtaggagttttacagttaagcaagacggggtggatagattcagcagaggaaacttcatgttcagacagagctatgaaatatgccacattagggaaaattcaaactatttcagtcgggttggtatataagatttgagggcatggcagtaactaaggctgcttatataagcatgactactcctgaaaggtataggatgtcgtaatgagaaatttgactttgttataggtgccacagatcaaaagcagcatatgttttgatagtcattcataatacagaccattaaattataataaaccacaagtaaattgatgaaactttaaaaagattcttgtgtacaacttttacatttctaaaatatattgctgaatgcaaaaatcctttatttgtataagatatgatcattaatatttaacaagatgatttagttatatataatattttttaaactgttcttttagttagaaattcttatttttaataaatgagaaaaattgagctatatcctaattaacacataataggtgctaataatacatagtatcttgccttttagaacagagaattgcaagtttgactgctcttcctgagggaaatcaataactagtcacattaaatctcacaattttaggtcttggaaaccaacatctttgacgggaaagacatactagttgtaatttaagcatttaaaatcatgatctttaatgtagaaagtaatgttgagtgcctatgtgaaggacactctgcttagaactgtaggggaattgggagatgaatgagacaaatctcttttctaattgagtgaaaactttattacatggaatatgtttttccctgtagtgtatttgtgactgtttacccaattaagttacaacttgttatttctataaaacaagcaatcaaagaaagccactgtcctctaaattaattatctgaatcaaactaaaaaatgtaagaaagaatttactattggtaatgaatgagcataagaacaaatgatacattggtgtgttttatgtgcagttgctttaaataataacactaccaactctcctaatggtccagaggctattcaaagtgaatggcgtttaatctgttagtttgaattcacataatctaaatgttcgcaaagcgatgctttgggttcaaaatgatccctagacacttcttaagagtcgttagctatctagattcttcacctaagagaaaaataaacaaacaaaacatagagcaggatatttatgcaatctgtgaaatgtgttaactgtatttttcaaaaaccacaaggtggcaacctattagaagacgatattataatcagcaactttttaaagcattgtgttgataggccttaactaagacatcaaagcatttgctgaatgcttccttttaaatggaacattattatttgaaaacttcctgaattaaagtaaatataattaaaaataccagcactacaaaaagcctttaaagatatagaaaaataataattttatcaaatcataatttagcagaagttaactctccatgtagacaaagacctttcttttttgaagaaatttaataaataccttactaaatggtacacttgactacactggtgacataaaaatactacagtggcaggtgctatttttaaacaaagtcagtggccctaaattaaaattataattgtaaatagaaaactgaaaggatacagataaatagatgtgaaaaagagagttacaggatatggaaaaagagaggtaataggggagagggactgataaagagagatgagaaaaagatacattttgttgatagtggggagatctgtgccaaaggataactaacattcttttaatcattttttaaaattttataatatgtttcttgtttgcaaatctactgtctaatcagtaaggacattaacataatatttgctaagtattgagtttaaattcgggagaatggtgggagatcgaacaagaaaatttaaagactaagtattgccttacagaattaaaaatactaataaattctgccctggtctttaaggacaaacgtataaaacaagccacggcagcatttttggctgcattgctaagaacaggttgaataacagttaaaatctgtttggtggatcaagtgctacatagagcagctgtggtttagaacaatatccagcagggcaatcagaaaggctgaccattcactcagttgcacactggagactattactcccagaaactccagcgaatacagtgccctctacccaagcaccacatcgattcccgcccgcccaataatctattttgcttatgaaaagggcatcataatttctgtcaagtttcaaaaaaggtaggcttctcttggtagagaaacatctctttttgtgacaattcaagaatctgttcatttgttaaggcagattttaataactagatacagaaattctgaagaactccttatgtattttaaggtgcctcaaaatgctggttgagatatacagcctctggaagagaaaactgtgtttttaatgcatgtaaataaggactaagtggatttttttttaaatacctaattttaggtacttgagataagcaaaatacttaaacaactgggtactgggaaaaaatgatattgcgtgtgagtggtgtgtgtgtgtaaacagggtgggcatattaactttttcctatcaaggagacacctatgtcactgcacatttttgggtatttcatttgtgacagtctctaagataaaagttctgcccactgagtaacataagggaagaatcacagtggggaaatcacagtctataatcacactatgaataccagcaacagatgcagaacactttaaggttttctataaaaaaggatagtgtttatttttttcatccaagaaagtagactcttactatattcctaaaggagtattttaaatagtgaaggtttcaggaaacatggcaggtgttctttcttagtaaatggaaatttggctgagattcctcccagcaagtgagtgttttcgccatctgatttttctactcatgagaaaaaaaatatatatatatatatatttttatatataaaatataaatatatatatatatattttttctgctggcagagttactacacagacatgccctgctttttatttacctaaaaggtaaatgctggcggataggctgatttatttttatttatttatttatctttttttttctatttttggagacatagtctcgctctgtcacccaggctggagtgcaatggcactatctcggctcactgcaagctccgcctctcagggtcaagcaattctcctgcctcagcctcctgagtagctgggactacatgtcacactgccatgcccagctaattttttgtattttactagagacagggtttcaccatgttgcccactctggtctcgaactcctgtgctcaggcaatccgccctcctcggcctcccaaagtgctaagattacaggcatgagccaccgcgcccgccagataggctgatttttatcattatagttatcttttctttgttgaacctgagataatggcattttaactttagaatgcctgatctttcataatactattatcactatcaattatatcagataaacctaatgttccttccactcaaccctttctacaccttggtcttattaatatttccagatatttggtcatttcatatcattaccttcctatctactaaataaaggcaacattctttagcctcttattccaacactgatttcttaatgtttcatttttcacacatgaattttgtaatattcccccacttaatcaaattaagcatttgttttaaaatgtaacatgcctttcctctctctactcctttcacgattcatttcctccacttgacatgctctacttctcttcttttttctggctataagactcaactctgaattgtgtgtgtgtgcatatgtgtgtgtgtatggattatttttatttgtgaacttttttatcccatcagtgttcatgttttttgttttagcctgtgtttgtttttgtattttgttatcaagtagtcttcattcttcctttcttccaccttgttcactgcagattaatttgtctttggaactgtcatttgtgagtgtgtgtgtatttttgttttgttttgttttttgtttttttggtttttttttgagacagagtctcactctgtcgctcaggctggagtgcaatggtgcgtgatctcagctcactgcaaccaccacctcccgggttcaagtgattctcctgcctcagcctcctgagtagctgggattacaggcatgcaccaccatgcccggctaatttttgtatttttagtagagacagggtttcaccatgtaggtcaggctgttctcgaactcctgacctcgtaatacgcccgcctcggcctcccaaagtcctgggattacacgtgtgacccactgtgcccatcctttgtcatttgtttttatcttacacctcacagatgtagtaagagagaaaacataattcctattttacttaagactgggggctggaagtcaggttagcaaggagatgggggagacatttaggagggagtgtaattcctggagtgtaggggatgccacagtgctaggtgccacaagctccttgtgccactccccagtactcattggttctcaggaccttatgtgctgcttctcatgaaacacctgcacacaaatattgccaagggctgaggaactgtttgagatgtcgtattctgtatgggaattgtttcaaaggaaatcaatgatctctgcattctaacaatattttaaggagaaaaagagaaggagaccagcaaggagtcttgcttcagaggagcagtatatgtgcagccatttctctgcccagcagcgtgtgccccatatccatgtgggctaggccctcacctctgcccacttcctctcatgggctggagaacagcagtgagatccccagtaggaggccaggggaaatctgggcagctgcatgttttctgagcatcttctccatccttgctccttttctaccctaaattttaacttcattgatcaaatcaacccagcccagaagtggtctcttccttctctgaattctggtatcatttcctttttacctgtctcaatgcctatatcttcattcattcaacaaatatttactgaactctgtgtgtcaggcattgttcccattagtcaaccaaagaggcaatatacttttgcccccttggattttacattctatcaggtgaagacagataaaaggtgaaaatataataaaggagtaatctatataacattttagaaaatgatgtgtcatagaaaaaaatagatggagagttgagggatcaggagtgctagggataaaaagaaggatgttatggtggtcagggcagaccttatggagactgtgacatttgagcaagtagtggaaggtggtgcaggaataaaccttactggtaagtgaagatactgctttagggaacagctagagccaataccacgaaacagaagtatgaagaacaaaaaagtgaggtagtaggaaattaaatgagagaggaaaagtaagtggggcttataagccattgtaaggactttatttttcctctaattgaaatggaaatcattagggagatttgagcagaggaatgacatgctctgatttacaaggtattaccatgttctgcagttctaatgcttaggtaataattgtaattagcattcttgaattatctctgtgcatgaatattaaactacttttgggtagtgtgttgcacattatttatttccaataagacacaagatgatgttttgctgtttttatgtcctcaatgaatatttgctggaaaagtgaaaaacaaaacaaaacaatgattatgtttatctgatgaagatgatcactttgtatgactatgggctatgccttggctattatcactgagtatacaaatacctgactactactactactactacttcttcttcttcttcttcttcttcttcttcttcttcttcttcttcttcttcttcttcttcctcttcttcttcctcttcctcttcttcttcctcttcctctttctcttcttcttcttcttcctcctcctcctccccctcttcttcttcttcttgcaatagcaaattgtgatttatttatttaatttttatttatttttagtttttcttttactttaagttctgggatacatgtgcagaacgtgcaggtttgttacataggtatacatgtgctatggtggtttgctgcacctatcaaactgtaatccaggttttaagccccgcatgcattaggtatttgtcctaatgctctccctgcccttgcaccccaactcccaacaggccctggtatgtgatgttcccctccctgtgtccatgtgttctcactgttcagctcccacctatgagtgagaacatgtggggttttgttgtctgttcctgtgttagtttgctgaggatgatggtttccagcttcatccatgtccctgcaaatgacatgaactcattcttttttatgactacatagtattccatggtgtatatgtgttacattttctttatccagtctattattgatggtcaccaaatacctgacttctaacaagctacttgcaccaaatgtgctagtttgtaatatgttcttttgttaattgcttattaaagaaggggaactaaatttcaaaaattatattttttagagtaagaaaaatcttgcttttgggtttttgtaaattttttattcctttcaagcattaaacaaatctaaaagtttatatttttaaataaagttttctatatagctgcgttaaatgttttcatatatttttccttttaaaataataaaagcaaagaaaactatttaataatatgaaaagaaccaatatttgaggctcacattgacttgtctatgactactttcaaagtgtggtagatccacattgtaaatagccatttgtaccagagtattatgaactgtaagcatttgaatgactgcttagattcttcgaaactagctaatgatacctccactgtcattattataattataataaagaaggttatacaacattatgctattatcattatatgtttaaaaagctaacattttcaagtactcagtatatgtcaagcacattgctaaatgtttcatagaggtatttttgttttatttttttaaattactgtgaggcagatacatttttaaccctattttacaaatggaaaattatagaaaataatctcagagcttaggtacttttaagttagtaagttgtagagtagacctcagataattttattccaaagcaattagtcctaactcctgtattatatccctacttataacctcctcccataatttttcatcttcatattgcttttcaaatctgagaacaaacccattcatttattcatcaagtatttattgagtacttgttaaatgcaaggtacattttctaggtgtaggtgctgcaaatttgtgtaacatctagccttaaaatatttttagactaattaagagtaaggacatgtaaacaagtagagcaattgcaaaatggtgtaagcactattaatatgtttatgtaagttagtacttctcagataattgtgcattgcaatcatcttgaagtcttttagaaactccagatgacaaggctaccaacccagaatgtcaagtcagtttatctgagattcactcaagtatttgcatttttaccaaggtcccaaagtgactctcacaatggccaaagtatgaaaatatcttgtataatttaggtgatgaacagagaaggtggagatcatttgtattaggggttactggtggtagagtcagggaaaacctcatcaaaagtcaaaagaattccttctggcaaataagaatttaaagatagatatgagaatggcttggcatttgaagggacctcctggaatgcagatagatataagagcatttactctggagtcagactcaggtttctatcttgacgctgccatttgatggccatgtgacactcagaaaatttttgaggttccctaaaaaccaagttatctcacccataatacatagttctaatttgaaagattgctttataattaaataaataaagtgcttattgcagtgccagttatatagtaaacccttaataaatgctaccctttatagctgatgagataaacccacatagctggagtagtcaaatggtatagatttaaaatgtggcataggcttttttcttggagaaagagtagcctcattgaaggacttggatttttagagtaacaaaagttttgaattttaaagaggactttttattttggaaagtgaagtatgcattacatggtgagaataagcccaaggaaagaaatttaagaggaggctgttgcattggttcacaagggaaactctgaaggcagtagttgtggttgtgtagatgaaatggcagcagattcaagagatattaataagatataattgaaaagctttatggccaattagatgttggggatgagagagaaaaaggagtagaggatgattctcaggtttctggtcttctgttttgtttttcactttagataatatcacttcttacatgataacagttttgctttaattaattggagagctggcctttcaactccctagacttttttgttttcagcatctaggtattgatttaattatatcaaggtcagcataagtgcttttatttaactgtagtaattggatctcatatgtttctgtggaatctaggaaccaaaagtatttcctaatttctaatgataatgacaagatagatgtattcttcaaagagtaaaacttgtatggacggtgaatatagtgctacttgtaaagtaagaaaaaattgtaatgtgatagcacatttattatatacatatattttaaatatttatagtcatgctgctcaaactatactattttggaggttatagatatgccacaaataaattgaattggtgcagtttttctaagttacagacatacaaagcaaggtaataaatatgaagggactacaaaaggtttagagaaaaattgaattatagaaaaattgaatgtatataaaaagggaattaaaaatggaattaaaatataaatttaaaaatatgaactctatttctcaacaaagctctatcaagttcaagacacttttgtaagcaatgataccagccattttgtccatctctaaggagggtcctgggaatttaaccatgtcaatgccatcttttttacattattaacttaagaaaaatgagtgccctgtaaagagttttttaagattacaaaagaaaaggaagtcaaaaggagccaaatcaggactataaggtgaatgcctggctgggtgtggtggctcacacctgtaatcccagcactttgggaggccaaggcgggcaaatcacctgaggtcaggaggttgagacgaacctggccaacatggtgaaaccctatctctaccaaaaatacaaaaattagccaggcatactgtcatgcacttgtaatcccaactactcaggaggctgaggcaagagaatcccttgaacccgggaggcagaggttgcagtgcgccgagattgtgccattgcactccagcctgagtgacaagagcaaaactccatttcaaaacaacacaaaacaaaaaaccatgaatgcctaatgatttcccactgaaactttcaaatttacccttgtttgatgagaggaatgagcaggagcattgttgcagtagaaaggactctctggtgaagctttcctgcaaaagctttggttaactgtctcaaaaccctcttataataagcagtattttccttggtttctccagaaagtcaaccagcagaatgccttgaacttcccaaaaaactgttgccatgacctttgctcttgaccagtctgtttttgctttgactgaaccacttccaccttttggtagccattgctttggttgtgctttgtcttcaggattgtactggtaaagccatgtttcatctcctgttatagttcttcaaagaaatgcttcagggtcttgatcctacttgtttaaaatttccattgaaattgaaagctttgttctcgtctgcagctgatctgggcacaaaagttttggcatcccttgagtggaattgtgtaagctgaatcagttgagatgtctaggcaattagctattgtttcttctgttaaacattgatcctcttcaattagagcacaaacgagatgatatttttcctcacaaattgatgtgaatggtgtgcttttgcaggcttcatcttcttctctcattccttcttaaaatgagttatccatttgtaaactcctgattgtttgggtgcgttgttcccatacactttttgtaaagcatcaatgaatttcaccattcttccacccaaacctcaccataagtttgatgtttgttcttcatgtaatttttgcagaattcatgttgctctgataggggaattttttcaaactagtattttatccttcttggtgcatgaaagtagattctattcaaacatgttataagaagatggtagaagtccatttggtaaaaaaaaaaaaaaaaaaaaaaaaggaaatctatgcgtaattttttttcataatatacatttttacaaactttttgaagtctccttgtataaatttctcaatttgtgtcttcaccctaattgttttttcttaaactttgatgtcttctactgattttgtgctaacaaaaattacctaacatataaataagtttcaaatattaatggaaaggttgagaaaaagagccaattttgctttctgttaataacaaaggggattgaatattgaagaggaaggaggcaggcagaattcaagaaaatctatttgcttggcaactttgggagacataggaaaattaaggcaaacataccagatattggtggacacatttctctctattcattagagagaagtttaaacattatttagtggaggctgattactattttggtattttatgatataggctatcataaatccaaataaagctacatcattacttgtattaggaacatatattggttacatagtcttgtgaacaaatgtagctgtgctgaattcatagaatttaccccaaatttttctcacatgaagtattcaagttttctttttcctgatccacattagcactggaatatgggaatcaattcttaaactgacaatttttgctttctggtgtgtttgttttttcaaatatatttgctcctgtttgtaattttatatcatgcataatcatttttattgctagggaaaatgatcctagctcatggaatatcattaaatatattgattgttggtaggcttccactaagagaacttgtactttccagttgtcctgccacttggattttagtgaagcctcagcattaatagtcttggattagactctttgcctgattgtaatatgaatatgtcctttccatctcatttctttaaatttgtagagacacatgttaaaatctcactaatggcaaatcctagagggaccttgcagcatatgtaaatcaatgagcagaattacattttgaacttataaaatatacatgtttttaaaagagaaggctgcatgaagtaatggtagtttcaaggtcctttgaagatctttagaggtcttcaaaaatctcaggacgtagtccctgaggaaggcaaaggtacatgttaccataatgaatagattttctcttcccctacacctaagagcactcatgattataattttcagtaaaatcctaggaaaaactggaatatctgaaagcatctttctatcccttgtagtagttgtaaaaagcataaaattagtctcaaaataataaatgcccagaaatgtatccatttgactctatcttataaatagcaaaagattcaattcagcataactgttattatttttactgcttcccatcctcgagcaatatgcttaagagataatgcattagttcttaatgagtttacttttataatcactaaaaatggtcttctcccttgagctaattatataattgattatttgggaaaaacagggattttaagattaactgtatttttacttacactaattttcttgttttaactagtttatgcacatcaacattcataaatgtaataaatattaattgtagaaatacctcctgcccaaattaaattattagtatttgtcatttctaatttcaattgccattaactcagaatacattgcatgcaaataagtgtaattgatctttataaacacattgcacttcttaaccctataaagcccttacagatttatcacagtttgcttccttttatttccatcatattttatttcctgattatctcactgatttttcacccctttgtgatgatgacgtagagatagttttagcctaatctaggtttctgaattttgtaaacattgtgtttttgtcttcatacatttctctagttatatcatgagctagggacactggtcctggtacccagggttttcttgcagtgaaggtaataatcttttagctgcatatagaagaagcctctcatgttgagtcagttgaaagactcaggatgcttaaatttgtggtgctttatataaatatttatatattttttgtattaatactactagagcacacatgtgaaatctcttgatcttaaacagaaatatacccttcgtgacaagaagaaaagtatactttttatctaaaatacaaatggacatcctcacttcagtgcctgaaacacttcaacaatagttaacatttgttaggcacttccaatattcctggcactactctaagtattatgcatgcacttctttaagtatcataatatgactgtgaagtcactatttactcatcccattttataggtgaggaaactgaggcatagaaaacatctcagactttaaaacaaaccaaccagcatgcaactagaggagccaggatgcacacaaaaggttgtggtcttaactctgaattctccctgcattaaacacagaaagttcaaatacctgtgttggttaagatttcaggactgttcacagtctatattctgccttccatttcagcttcatttcttgctgccttccacagaacactacaatgtgtttttgagaaaaacacttccctcctttccaaaaaagaaagaaaaatctctaagaactccattcgtttaatatgttactttctgtgtcagaacaccatacacaactacccctcaggataatgaattggtaaaatatataatttttcagtactcatatgggttacttctatggagcaattatctaattaaacaaaggatgaccttcatttattgcaattgttccaccgcgctctaatcatcatctgtcaaatcaaactcctctcctgttccgtcaagagtctctttagagcatggttgcttatgttgctgattgatctctgcatttctggaatgtaacatgatacagagcacgcaataggtactcaccaacagcttattgaatgaatgaataatacctacacgtcgtgattctatttaactttttgttcatttaacttagtattattctatagactaaaatttgataagtagtgtgtattactgagtattcatttacttatacagagtaattctaagttaaatatcagttacagtaagcacagataaagtaaataaagtattaaggatcaaggtaaatgttaatgtagcctgtgctacatgttcccaaagcattgctgcccatcagtgatgatagtcagaattattgcttccaaaaaagtttatccacaaacattcatgaagttacttgttacatgattaggtatttgacaaaatatttgtttagtagattaatcaattgattctgaggtaccttaagccagaaaaatatctgcatgtttaccaaagcagttttctacaagtcttcaaactattaatagtacaccaactcatattgggttcaccgtttgattaccacaaatgtctacattattcttgaactcttatctttataatgatagatgtggaatgtgaaatgataattttggtatatctttttaaaacccttaaaggtagtatcaacataaacataatagttgtcttgtatccacaatttagagaaaagatgaaaatcaaagacatgcaacatatttggaataaaaagatctttactatcactaaataccacctttagtgcaaagacacatgatttaacttttgtttctttctcacataaatgcaaaaccaatatttttggtctgcattttcaataaatagatacataggttgtcatgtcaaatttatgaatgagtttttcctttaacaaaacaatgttactgggtgtcttagcagtaattaaacattttcccctccatgtcttcgtatctcaatgcgttaatcactcatttgaaatcaatttggaatactaggacatatatatatatatatatatatatatatatatatatatatatatatatgtatgtgtatatatatacatacacacttttatttacacacacacattcagaattaccaactatatatgatatgattaacaacatttctgatacagattgattgattgctttgtgaacagaattggaaataatacgttttgattataaataaatattagtaatgtgaagcagtaaggatttaatattttcagccagggtaactgcctgcaatcatttgacagcagacagacataactgtgtgcaattttttgtatggattggtccctggattcatttctgatttttcttttttttggctacaacagcagattaattgatccaatcccattaaaaaatatttaatcagagagcagctttggttgccaacggcataattttacaaaatttatactcatgaaccttaaaatgactcaatgttttgatgtcttttgttaagcaggaaactagccttggttaagcagaagagaagccttttccacatttctacaaaaaaattctcttattgattcctacaaataacttattgattttgtcacttataaagaggtgaaaaataattcccaaagatattttagagttaatatttaaccacttggagatttatttgtgtaaatttaaaaaatggctgcaaaattcaaactgtaggactttcatgtatttttgtttcattttctttactgcacatgaaaaagaaactgctgcaaaaaaatgaatgaagccatcagcatatgacttatctgattatatcattattttcttccctaacacaaatcagttgctgattgatctcttcaaatgaacttagctagcccaattcaatatcatctagaaaaattgaagggaatatgttcctgtacttctaaattttctgctagtactaattcatctaggttataagttattttattatatacaaaaataatttatgttattatagaaactctggagatgcaggaaaatacaaggaatgacatacaaatcaccagtaatcttataatcaagaattacaaccaccatttggcatatttacatttggttatttatctctgtgattatatacatataagaatttgttttaacttacaaaattgcttttacctagtttatagagttttgtgtcattttttaaaaagttaaaacaccttcacaaacattttattttgtttatgtatattatgtaaaatcttgtttaaaaatgagcatctcagtattcagctacctcactaacatagttttatttattctcctcttggagaaggaaactgtcgctactggattttgatagttttttatatatatgaccctgaatagagtatttgattagaaaggaagagaaatgaatgtgtacaaaatttggccttctcagtgagaatgattgcaagaatgtccttactggtgaagagtaataaatttactgttcaggactcccaagaaactaaaattgtaccaaaggaaggtgaaattgtatagacaaagcatacatgtttatatcatagttcactatttttgtattcggtagtttctgatgaagactctatgaaatcagatgaatttgatgtgtgaggcttatcaacgggtattaagtaagattaatacacagggaaggcaatttctatctcttcttagattccaaaatctagttggagaagaaagttgtaaacccttaaacatttaaaattaggtcacaatttaatagtaaccaagttttcctaggtccataaattcaatactacaaaaaggaatagaacatgatgcatgcttggagacctaactaattaaggcactgggcattgggattgcaatgtacagactctccttatctaattcaagactgcctcaaatgtattcccaaatgaccactttactcctgatctttactgcctgactttctaatctaatcataactctatcaagtcactgcttttatggcattttctattgttaaatgtcatccagtttggcatgatttaagctactctaaccattgtgttattagatagctttcctttgcataattaggcattaatatttattaagaaataatctagatatagggatacactctctttcttatattattcattcattcacacaagtaatgtttactgagtgcctcctcaagacactgttctctaacggcccttctggagctttcattctcagatgggagataaatattgaacaattaattgcacaattatttatatattatcagattgtgttaagtatccaaaaagaatgtagagggtggtgctacaagaatatctatcagagagaaataatctggcacaggaatgaaggaatacatataaagcattatcattctttagggtttagttttcaatgctttttaaaaatgaaatccgtatgtatacagtataatgctgctggagtggtgacctctttttctaacccatttaaatatgcattagattagcctgaaaatgtaattacaacaaaatgaataataaacaatggcttttaatgaagatgaaaagtttttaataataatagttgcatatttgaaaaatgttttggcaaaaaagcaaacattttgttaaggctttcaatgaatcattttcagaaaaccatttacttttactatgtttttagtttattttgaaaaataaactcttttttaaaaaaacataattttaacttttattttagatttaggggatatgtgggtatgtttattacataggtttactgcatgatgctgaggtttggggtatgaataatctcatcacctcggtagtcagcatagcaattgtattagtctggtttcatgcttctgataaagacataccagagactgggcaatttacaaagtaagaggtttaactggacttacagttccacagggctggtgaagcctcacaatcatggcagaaggcaaagtacagcaagtcacgtcttacatagatgatagcaggcaaagagagggaacttgtgcaggggaattcctcttttaaagaccgtcagatcttgtgagacttattcactgtcacaagaacagcatgggaaagacttgctccatgattcaattacctgccactgggttcctcccacaatacatgggaattcaagatgagatgtgggtggggacacagccaaaccatatcattccacccccggcctctcccaaatcccacatcttcacatttcaaaaccaatcatgccttcccaacagtccccaaaagtcttaactaatttcagcattaactcagtagttcacagtccaaagtctaattcaagacaaggcaagtcccttccatctatgagccagtaaaatcaaaagcagtttacttccgagatacagtgggggtacaggcattgggtaaatacagccattcaaaatgggagaaattggccaaaacaaaggtgctacaggccccatgcaagttcaaaatcaaatggggcagtcatatcttaaagtgccaaaatgatctcctttgactccatgtctcacatccaggtcatcctgatgtaagaggtaggttccctcttaggaagctccaccctcgtggctctgcagggtacagcctcactcctgtctgctaacattgagtgtctgcagcttttgtaggtgcatgattcaagctgtcagtggatcaaccattctggggtctggaggatggtggccttcttttcatagctccactaggcagtgccccagtagggactctgtgtaggggctctaaccccacatttcccttccacactaccctatcagatgttctccatgagagccctgcctctgcagcaaacttctacctggaaatccaggcatttctatacatcttctgaaatctaggcagaggttcccaaacctcaattcttgacttctgtgtactctcaggctcaacaccacgtggaagctgccaaggcttgaggctgggatgaaggtcatcaagtccctaggctgcacacagcatggggaccctgggcctggcccatgaaaccactttttcctcctaggcctctaggcctgtgatgggaggggctgccatgaagacctctgacatgccctggaaacattttccccattgtcttggggattaacattcgactcctcattgcttatgcaaatttatgcagctggcttgaatttctcctcagaaaatgggattttcttttctatcacattgtcagactgcacatttttcaaacttttatactctgcttcccttataaaactgaatgcttttaacagcacccaattcatgtcttgaatgctttgccccttagaaatgtcttcctccagataacctaaatcatctctctcaagttcaaagttccacaaatctctagggcaggggcaaaatgctgccagtctctttgctaaaacataacaagagtcacctttgcttcagttcccaacaagttcctcatctctgtctgagaccacctcagactggaacttacccttcatatcactatcagcatttttgtcaaagccatgcaacaagtctctaggaagttccaaactttcccatcttttcctgtcttcttctgagccctccaaactgttccaacttctgtcagttatccagttccaaagtggctgccacatttttgagtatcttttcagtaacaccccactctactggtaccaatttacgatattagtcagttttcatgctgctgataaagacatacctgagactgggcaatttacaaaagaaagaggtttaattggacttgcagttccacagggctggtgaagcctcataatcatggtggaaggcaaggaagagcaagtcctgtcttacatgggtgacagcagtcaaagagagagagctcgtgcaggggaactcctctttttaaaaccatcagtactcatgaaacttattcactgtcatgaaaacagcatggaagagactttcacccatgattcagttacctcccaccaggttcctcccacaacacgtgggaattcaagatgagaattcccacgtgttgtgggaggagacacatgggaagtggaatatggaggggacacagccaaaccgaatcagtactcatagattttcaacccttgccctcctctttctttcccctaccaagtaacccccagtgtctgttgtttcaatcttcatccacatgtctacttaatatttagctcccacttataagtgacaatatgtggtatttggttttttatgcctgcattaattctcctcagataatggcctccagctgtatccacattcctgcaaaggacatgatttcactgtatttttatggctgcatattatttaatggctgcatattatttaatgatgggcacctaggttgatttcatgtctttgctactgtgaatagtgctgtgataaacatacgagtgcatgtgtcttttggtagaatgattttttttcctttgattctacacccagtaatgagattgctgggttaaatggtagttctaagttccttgagaaatctccaaactgttttccacagtggctgaactaatttacattcccaccaacagtgtaaaagcattcctttttctctgcagccttgccaccatctgtttttctctgacttttacatcatagccattgtgactagtgtgggacggtatcttactgtggttttgatttgcatttctttggtgattactgatattgagcatttgttcatgtttgttggtcattcatgtgtcttctgagaagtgtctattcatgacttttgtccactttttatttttttattttttatctatttattttttttgacagactccagctctgtcgcccaggctggagtgcagtggcacaatctctgctcactgcaagctccgcctcctgggttcatgccgttctcctgcctcagcctcccgagtagctgggactacaggcacctgccaccacgcctggctaattttttatatttttagtagagacggggtttcaccgtgttagccaggatggtctcaatctcctaacctcgtgatgcacctgcctcagacttccaaagttctgggattacaggcatgagccaccacgcacggccttgcccactttttaatggggaatttgtgttttgcttgttgacttaagttccttatacattctggatattagagctttgtcagatgcatagcttacgaacattttctcccattatgaacattttctcccattctgtaggttgtttgctactcctttaacagtttcttttgctgtgcagaaactctgtagtttaattaggtcttacttgtcaatttttgtttttgttgcaattgcttttgaggatgttgtcataaattcattgccaaggccaatgtccagagtggcatttcctagatattcttctagaattcctgaaatttgatgtcttacatttaaatatctaatccatcaagagttagtttttgtaaatgtgagagataggtgtctattttcattcttctgcatatggctagccagttatcctagcaccatttattaaatagagttctttccccatggcttgtttctgtcaactttgatgaaaatcaagtagttgtggatgtgtggatttatttcttagttctctattccactccatccatcgttgtgtctgtttctgtaccagtaccatgctgttttggttaccatagccttgtagtatagtttgaagtaggctatgtgatgactgtagctttgttctttttttggtttaggattactttggctatttgggctttacttcagttccatatgaattttagcacagtttttttcttagttctgtgaaaaatgacgttggtagtttgatggaaatagcattgaatctgtagattggtttgggaaatatggtcattttaacaatattgattcttccaattcatgagcatggaatgttttcccattgtttttgtcatctatgatttctttcagaagtgttttgtagttctccatgtaaagatcttttacctccttaataagatgtattgctacatgttttatttgttttgcagttattgtaaatggggttgcattcttaatttgactgtcagcctggatgttgttggtgtatataaatgctactaatttttgtgcattgattaaatatcctgacactttattgaagttgtttatcagttctatgagccttttggcagattctttatggtcttccaagtataaaatcatgttgtcagtgaagagagataatttgacttattgttttttcctttttggataccttttatttatttctattgcctgattgctctggctaggacttccagaattatgttgagtacaagtggtgagagtgaacatccttttcttgttcctcttctcaacatgaattatcccagcttttgcccactcagtattatattgtctgtgggtttgtcatatatggatcttattattttgaaatgtgttactttaatgcatagtttctttagggtttttatcattaagtgatgttggattttattgaaagctttttctgcatctattgaaatgatcatatggcttttatttttaattctatttacatggtgaatcacatgtattaatttgcatatgttgaaacaaccttgcatcccaggaagaatcctgtttgatcatggtgaattaactttttgatatgctactggagttggtttgatagtattttgctgaggattttacgaactgtgttcatcagaaatattgtcctgtatttttctttttttgttgtgtctttgccgtgttttggtattaggttaatggtggcctttgtagaacgagttaggaaagtcccttctcattgaatttttgtaagttttggtaaattggtatcagctttgtatgttttgtagaattcagccataaatccatctggtctggggctttgtttttattcttggtaggtttttttcttactgattttattttagaactcagtggtctgttcagggtttcagtttctcactgatactatcttgggaggttgtgtgtttgcaaggatttattcattgactctagataaaaaattctatcttgggaggttgcatgtttccaggaactttttcctttgctctagataaaaaataagttcttacctaataaaaataatgaaagtgttttgaattacattgttatctccttatcagaaaaatactgaattcaagtagcacataatacttttcaggtctcaatgagacaccagtttttctcctttctttccttttttttgagatgaagtctcgctctgtcacccaggctggattgcaatggcaagatctcagctcactgcaacctccgcctcctgggttcaagcaattctcctgccttagcctcccaagtagctgggattacagcacctgccaccacacctggataatttttgtatttttagtagagacggggtttgaccacggtggccaggctggtctcaaactcctgaccacaggtgatccacccacctcagccccccaaagtgctgggattacaggcatgaaccaccgcacttggcctctcctttttgattatagtatcttcagagaaagaaaagttctacttacaactatattttaaaaattttacatataataagaagtacatcaaaatgtacctcataaatttaaaagccgattcagaataaaagaagaaagagttaagcaaggaagacaaaatagcaaataatttttaagtttttgctaagaatgtttttaaagtattatttatttctattatcataataaattatttttaattttcatgtaggaattttcttttcagaaatttttacttttgtttcacagtagaaaacaattaagcctggagttaaaacacaatttaggtatattcacacagctagcttaatgactggtgccataaaaattaaaattgtatagctttataatgatgttcaaatgtgcattattcttgacatctacagttaaatcttgttcacagaacgttctcaacgtctcaatatagtatctagtttgatgagacactgatattcaattttagcaacttaatatgcataacttaagcatttatcacttgaaagttacttaaattgttatcattaaatattcttagcaattggtttggattcctgtcctgaaccacaaactcctagcagtggaattaaaattggagacagatatatggttggagatgtagtatcctttcagtgtgatcaaggatattctcttcaggtaagtctattttaaagttgtggttttgattttcatggccctttcagaatattttacaaatcaatgattgataagccacgggttttacaacattgatcctggtttgtgtctgaggtcaaaagggtgctcaatttgataataaaatatgcacatgagaaatattgctggaattgactaaatttgttttgtttggaagtaaacaaaactgattttgagtcaaaattaggaaagttagggaagtcctttctccttgattttaattaattagattaaagtcttttaaagtaaaaattaatctttacttttgtctctattcacataggattgtgacaactgaattcctggatttttagaatttgaaaataaagggaaatgccacttaaaacactgaatgaaacttccataacaatacatttcccaaattagtgaaaatttactacaagtatattttgctaaggaactggatttgcaatgtatattctgattttatgtatttatattgatcttttttgattttttttgtcgagggtcccaggtttatagtaacataaaaatttccttaaagaataaactcattaagataaaaagttaaggaaaatactgtttcacatattagataaataaattcttcagagaaagcaaaattaaaaattaataatttatagtctttaaagttgtatcacaaaattataaatctcagaagtgcaaacagatctttcaggactttatatttcaatataaaagttaatatactttgacttgttttaatatttttgtgaaaaaattttaaaattattctttaacctacttcaccttgtgtgttatagcaatttattataaaccaccatgtatactgccctttcacttatataatcactgcaatatcttagtaaaacatattgttataggaaaatattaaaaccgcaattctaatatgatatgaagtattattttttctaccactatcatgtagctatttcttacattttatcataggtgtatataatcacctttcttactttaatcatgctaagattttcatataagtaaatatgtgtataaaaataaagccatgtacttaagcttgtttttataataataattgactatgctacaataaatttaaactttttatgtatgtgtactgaaccacatcattttgtttatgtagggtcactctcacattacatgtatgccaggacctgtaagaagatggaattatccaatcccaatttgtttaggtaagttaaaagactataaagtatttaccctagaacttaaagtgtaaaaaaaaagactataaagtatttgtaagcttcatcagattttaaagtttcattctgtatatcatgattttcaaacatatagtttgccttttaccagatcttatggaaatgactttttgaggaaaatatttcacatcttcttttttttaatttaaaatttttatttttatttatcctcaacttcagtatcagtggatgacttaagctgtagaaattaagaaaagacttaaaaaaattcttagagagttttctcagtatatctattgaacagaaaaataagtaaatattctattgcttactattgagcgggaatagataaagaatctaaagtgtctagcaaaaggagtatgacacctcatgagatgtctttagtggtgtcaggcagtcaagatatggaatatattaaaaggaaacttgggtactttgaaagtacaggtgcacatttttgctttaactcaatgctgcttccaaattacttctattcatgcttttttttctcttcctcatttttttttgtatttgtgtgcaactattaatatactgggctgtaaagagtaagagaaagtaatgtgaggtatgatccctacctttaaaacattcaattactatttggagtactagaaataaaataaatgaatttgttatcaaataatttagagttaaattttatcattaactacatgatggaatttcagaaaagtgagactggggttgactaaagtattggcaaacatattcagcctgcaaggttttcacagagttttggataataagtctaattaagacacatggaggaagaagatatctctttctgagttggagaaagagcccaagtcaaaaaaaaaaaaaaaaaaagtccatgacttgtgtgacttaactctgcacaatgaccgtacctgtattacattcctctgcttgggtttccatagcagaacactccagattgggtagtttaaacaacagaaatttattttctcagagttctggaagcttgaagttacaaaacaaggtgctagcagattggtatcttctaagggcctctcttgttggcttgtagatggtatctcttgcatgatctttggtttgtgcacccacgctcctggtgtctcttcctcttcttaaaggacaccagtcctattggattaagaccctcctcttatgacctcatttaaccttaagtaccttcattaaggccctatctccaaatacagtcacattaggggttaggacttcaaaatataaattttggggggacataattaagtccacaacatctgcgtaaaatgcacacaattctttttgaagagtactgaaaaatgtttaagagtgatgatgtgtttaattggcaaagtacattgaaaacactcagactttaaattggatgatttttttaagggaagtttttaaggtactatgattaatttgtaaatgcatattataccaattttaaaattacctcatatatatacatgtaatgcaattctgaacacttacatatgtgcagataatggtgattgtaaatatattgtgtggtgtgtgtgtgtttatgtgtatatccaattgagtataaaagttgagaatataaaagagcacaaagagtaaaataaatatgtttttttctgctaatatgaaagcacagagtttagatctttcatccattaccatattgctagtgcctgaaaagtttctcatcttaaataggcatccattatatactgtttagtgaacaaattaatgtaaaggcttgggatactatatatatatagtaatgtttttctttttgatgttaacgtgtaagaatttctcataccatattgttttcaaaatttgaaatgtcaaaaactacaactgaaacaaacaaaatttgaattttgattcttgacacatagcattgtctaatttgtgcaattacttctttttcgttaaaagtttatttctcatcttttgatattataaattacatatttattttttcacattatgtacttcataattttatatttattatgaacacatctcatatcataattagaaaacagctctaatagcttgtttataatttttcttaaatagattaattatgtcactgaatagaactgcttaaaacctttcataaatattatcaaattgctccagaaggttgtaccaatttaaataccactctattattacaggacagttcccatcttgctatattgcttacatcaattattattcttaaaaaattatcaattttctcagcaccataagacagggcaaaagagaaataaaatgtaacaaaacaattttttaaaaaattacttttttagtagataaagtatcattttgattaagtttacatttatattataaactaaattagaaaaattgttttattatataattttgtatttttagtaaagttggggtttcaccatgttggtcatgctggtctcgaactcctgacctcaggtgatctgcctgcctcggtataccagtgtgctgagattacaggcatgaaccaccgcacctgacccattttaaattcctttttactctttttttttgtattttataaattttgaacaataagctggtactacatgtgacagagtattaaaatattggcagtgatacaatagcaatattgtaaggagaaactagaagcaagaggctgattcagcgaatgtcttaaaacactagtcatcagataacaaggctacagcctcgtgaactggaaaataagcaatctgccagatattttgatggaaagaaggaaaatttatgtgagattttagatattagagacaactaagatgaaaaaacagaagttgattttattttggaagactaaggtatggttgtccctaacaaaaagagtgtaatgggacacaaaagagtgtacatgaagctgctgatgacacacacaaaattgatattcaaggcataggagtgttgagattgcagagatactgaggaaatagacatgaacaaattgctgaaggcagatgcattctttggtatccttcttcatatgtctctaatgatttgtcattgtttttcttctgttgttgttatctctttactctattctgttttctttttctcttttggttttggtatttttcaccctgaaaggtggggccatcaatgcagaggacaggaattccagttcatatctaaagagatagaaagtaacagaattagaaggacaatcagcagctcaaagacttgaaattgtgaaggcaagaaaataaaagatagtccttgccttttactcaaatttcagaataaagcaaaacaaacctacaaatgtattgccataaactttaaaaatattttaattgagcaaactattgtttttacaactcattaattatcagattttgtgatgaatatgtgtgaacaattgaatttaggaaaatgaattggtaaatactaacttcattgaaaattgatttggtttaagggtgaattaacgagatttcagaagcataaaaaagcatatgggtatatctttagagcttgattataatcacaagtttgatgaaaggtttatatgcaggttgactccaagattatataaaatcagattgacacataatttatttagttcacatagcaaaagatagttgtcaaacttattgaatattgtataaaacattgttaaaattcctactgaatttgcctttaaaatatataacctgagatttgagtatctgtgtgttgctactcttggcacgaaataaatggatgcgattgcaaataagtattctgtataggtaacttttgaacttcatttgtagtcatgaaatttgattcttcatctaacaataaaatgataaaaatgtgctttagacggtcaagaataggtttctaaaatgcaattgcctttcatatatgctcaagggttctatctaattatatttaaaaacttgagtaaatttctggtcttagagcttttgcttaccttattgatagtaaaccgtataatagggattccaagacaagcacatttacgaactccctacattctcaaatttgtgtgcatctttttacttatttttacttctctattttttgtcttgattcttttaggataaaataaggccatatctaatgtgtaatatgtgaacttctcacatatgaatggaaaccaatattttgcttacaaatctttattgagccttctcacaaaaagaggaaaaggataggaggcctgggcgggcggatcacgaggtcaggagatcaagaccatcctggctaacacaatgaaacccccgtctctactaaaaatacaaaaaattagccgggcgtggtggcaggcgcctgtagtcccagctactcgggtggctgaggcaggacagtggcgtgaacccgggaggcggagcttgcagtgagccgagattgcgccactgcactccagcctgggtgacagagagactccttctccaaaaaaaaaaaaaaaaaaaaaaaaaaaaggaaaaggagggaaggctgtgaaaatgatttcctcttgaatacagtacttagagctgaagtggttggcttgattttactctaaattatatcgtctttgggatgattcaaaacatttctaggactacttgaggaagagaaataaagtgcccgctgtggcaaagcacatgtctttgttcgtttatatttactgcacatgatctgttacttttatgcaataattgatttactttccacttatttctgaggaaggaaggatgttgtctttttatgctgttttagaaaatctgttgttgattatatttaattcctagtgtatagtgagtgaacagacaatattcaaatttatatcagttttaactcagagccttgaaaacgtgaaatgattttaatatgttttttaatacagtaaattattcctctactctggtttactttggatttctgttattttgcagctcagtgtggtggtgctatgtcagacttcagtggtgtgatcctcagtcctgggtttcctggaaactatcccagcagtttagattgcacatggacaataaatctacccataggttttggtatgtgtattaaaaacacgtgaaagagctttcaatatttattaatgtagccttaaaataaatttcaatgtcgaataagaatttataaaatcttcacaaattgcagtttagtttaggaatacatacaactatgtaaattgaagagtgaaatttaaataattgttgcttaagtcaaatacatttcacttggagtacttggataattgaaggtatatgggcatattttttttttactctgatttattattttttaattgacaaataaaaattgtacatatttatcatgtacaacatgatgttttgaaatttgtatacattttggaagaactaaataaagttaattaatatattatctctaatattttttatggtgagaacacttaaaaccctcttagcaattttcaagagcgcaatatgttgttaataactatagttaccatgttgtacaatgaatttacttcttttgtgtaactgaaattttgtgccctttaaccaacattttcttaatccttctctcttacaccctggtaactacccttctactttctactcctgagttcagttttttcagattccacatgtgagatcatgtgatatgtctttctgtgcctgacttaattgcacttaacataatgccctccaggttcatccattttgttgtatatgacagaattcccttgttttttttatggctgaatagtgtttcattgtgtatgtatactatattttctttatccattcatcagatgatggacacttaggttgattccgtatcttgtccattgtgagtaatgctgcagaaatacaagattgaagatatctcttcaagattctgacttcaattcttttgcacatatacccagtggtaggattgttggcacatgtggtagttctgttttaaatttttttgtggaacctccatattgtttcctgtaatgtctgtactaatatttattcccaccaacagtgtgccaggtcattttataattatatatagagatgtatagactgatatagctagacagacttatactatttttcagtcgctatgtatggatataccctgaattagatatgtataataatgataaattcaacctaaattttatgtgcattgtttttgtaactcttttcttattgctgtaatcaagtagtacagttattattttctagtaatctattgaattcatcccattttctttgcaagtaaatcagattttatttttaaaaagtagtatgaattttaaaatattaggtttaaatacaaatcactataataccttcccaattttaatgtaataattcccaatatttttgatacattacataatatatcatatttaataaattctccttacccttacatcactaatatactctcttacagcttttgcagatcctatgagtttataaatgcactaaaagaagtgcttgattgagggtacacatgttcattaaatcacagaagactaggatgaatagatactcattgaagcacaaaccaggtagttttagagttattaggaaattctgtactatgtcacttattgaggactgaacttgggtatctcactacccagtaagcatctacaacctcagagtataaatgcatatttaaatgttttacataaattaacagataactcatagttttgacaaatatttactgagtgtatattatactccagatactgctaagtgctggagataaaatgtatggcaatgcagactttgcatttttctttaaataagttacagtcataatgaggagacagtaaaatgtattattatgatacagtgtaactagagagcacaggattgtacttagaatggacatcagcctagtataggaaatgcagtaaagtcttgacagagggagtgatgcttaaactttagctttaaagataagtaaccaggccaggcatggtgtctcacacctgtaatcccagcactttgggaggctgatgcgggcagatcacaaggtcaggagattgagaccatcctggctaacatggtgaaacctcatctctattaaaaatacaaaaaattagccaggcatggtggcacgcacctgtagtcgcagctactctggaggctgaggcagcagaattgcttgaacccaggaggcggaggctgcagtgagcggagatcttgccactgcactccagcctgggcaacagagcaagactctatctcaaaaaataaataaataaataataaataaataatcaaccagcctgggcaacatagtgaggctctgtctgtactataaataaaaaaaaactagccacacatggtggagcccgcctgtatgtcccacctaatcagaaggctgaggcagaaggactgcttgagtaccggagtttgagtttacagtgagctgtgatcatgccactgagcagctgggccaccctgtctttaaaaaataaataaatgattaaatgaaatgaaaaaacaaaaagttaagtaaaagtcagtccagcaaagaatgtcagtctgctgcaggacgtgtgaaagaaattccaggtaaacaaggtaacaagtagaaaaatgcaggtgagaaagctaaaaaaaattaaacatgcctgaacactgtgtgactggcctgaggttttgggaaagcagaacgttattgagagaaggttgctggggactttctatttagaaatcctatttaggatcattttggctaaaatgtggaaactctaaattcgaagttgtagtgaacttctatgtccattgatagaatactgatgtaaatgaacaacagatttgaaccagcatggctcttccacgtctttcactagccactgtagcttatgtagctaaatgaattattttaaaatgaattattaaaaatagtttcaataatctcattataacatgatcttcaatttctggctaattcttgattttgaaaaccaactttattaaaacttgaatatatagctctaatttataaatgaaaacataagagatttagatacttgattacattttaataaccatactcttttctttgagttttgattaaatcaaatattaggtccaatgtatttaaactatatatatatatataaatatatatatatataaatatatatatataaatatatatatatataatacatttcaagaggtaaagaaacatatgttcaagaatatatgaaacaattttggaaaatgtttgtaataaaagtgctcagttaaaaataaaaacaaaaagtgcatatcttcggtcttcacatattaaggttgcatgtccaaagttctaaaaagttaatctaattttttagaaagttgtttaatattttaaaccctgttttaaatatttccaaagcttatttgtccaagggactgtttaaaaaatcatttagtaacatgatgcgcgtttactcagagccccagtgtagttattaatatcataagcttaagagtctgaatgcctcggtttgcagttcaagcctactgggtcattgtgtaaactttacatgtgtcttacttctctgcgactcactttccttgttctcatgaaatggtgagaattaaataagttagcatatataaatcacttaaggcaggtaatatatataatgtgtagcaaatataaataacttaaaactttcaccaaatatcagattttattacaaataatttagagagtgataatagtaagaaaaacatcaaatttactaaaattgagtgttaaattaattaagcaaatatactttaattaacattttttatcccagagacatttcactgtctcgtattttagttatgcttataaagatattgagattacattgcaatatgaccacatataacaatgatcaccagattttattaaggttattatataaaagcctgcattatcttctgataagcaaaacactgaaagagcaccctttaaattatatacgttatatttctgagaagttaatttctctcctgtgaatgaataacttctaatgcaattgtggaatctatgttacaaatctatattacaaatttgcaattattttcaaccttagattgaccttttccataacacaaattaggccaaaagcggccttttcctctaaaaattagtttatgtaatttaaagcgtattaaagaataagaaagccacttttttggatcatttttcatacagtgacattataatgaaatgaaatgtttttccttttaactaataatggacatgtgagagcagtattcttttactttgaacctcagcaaagttacctgtcctaggcagacagcaaatccatgactcagatcttgagattatgcctcttgacttaaatgcaaacttatctaagtacattgatgtgattgtgtgtgtgtatatttatgtttaattcggtaaagcaaataaagtagcattctgtttgttttcttcttcaggtgtacatctccagtttgtaaatttttctacagaaaccatacatgattatttggaagtacgaagtggatcctcagaaactagtactgttattggccggcttagtggtcctcaaataccatcttccttattcagcaccacccatgaaaccagcttatattttcacagtgactattcacaaaacaaacaagggtttcatattgtataccaaggtaagagaaataataaaaaatgaaaatttatataaccccaaatcagctattagaaatatttaactgagtctaattattttctgtattctgttttagaaagaaaaaaaaaaaaacttaagccaaggtgagcttcaattaggaagatttttagaacaatgcaactctctgggaactacacagggagaatgatgtctctctgagaccttagaaaatcctaaccatgaaactggattgaattagtcttaagttaatacacaattaaattaagcaaggcatggcaaataagcaaggccagctgcacagcaaagatgtatctttgcttttatattaaaaggaatatattgaaaagatattttgtattattcatgtgttgtattatgtaaaatgttcttttactttatagtgataagactaatatgacattccttcattttgttctattgtcatgagaatataaatactttgataatcatgttatattagacctatctctcaaacagaactactgcatgaccttgagcaagatttttatctcttttgagtaaagggtttgggcgtaagtagagctaggctcaaatgttgattcttcctattctatctaatgtggcctcggccttgctctccatttgctcatgtgcataatggagttaattatactttcagataagttgtattgaactttttattaaaaaatgtatgtaaggtgtattccatgatgtatatttttagtaattactcagtcctttttagctattgctattatattatttcatgtcttatatgtgtatattctgttaaaattaaatattaaaatgatattttacataataaagtttatttctaatggctgaaatttttaatcaaaataaactaaaatgttattacatctctgccctaattattgaaggactttatgtaatgcttttgtatctcagctcctcaagaacaggcaattgggttgttcattggagtatcataagcatctagagcagtaagcacaataaatatttgctaaagtatctaccaaagaggaaatttgaaagtagttaagatagagataggtcttaaacatcaaattacatggatctgaaataattataatttgtattatacttgcgtgcataatgtaagaacactacattacacataatcactttcataaaataggagtcatttcaatcacctcccagcacattgaattaaccatgcttgcaaggaaattaattatttttaaaacaattgggtaattggttgaatttctcttctttgctgctagaagactcagaaccatatttgtgatatactttagcaagtgtacatggccttatgccaagttctttgccatgcaccttaaaacagactaaacctgtttttttcctattctcattttccctctctctcaaaataatgttcttatttgaatgatgtaaaactagaaattgagctttattaactctgatattttcagttaatatatccttgaaaaacaattcattattgacctaataaaagtgtaaaatatataaacttttttcactgttactgacgtattattaacaggagccataatgtattacaatgatgaggagatgttgtgaatcacactgagttttaaaatggtttctttttgtgctacatttatgtaactaacctagtgcattttaaagaaatagttaacatatatattcacagagtcaatattatttttggattgattttgtggttaaattttaagaaccttctgaatttggaaaagttatactgtacaatttagagtacccatctactgaaggaatcagtttgaaaattaatgttattactgacaagattattaggtttggtaagtcctgttgtcaccggtacaagattgtgactgcaagttgtccggattcttggctttttgaacaaagaattggacaaaacgcccagcaaagcaaagaaagaatgaagcaacaaaagaacgaaagcagagatttattgaaaacaaaagtacactcccagtgtgggagcaggccgatcagtggctcaagggcccagatacagaatctttttgggtccagatgccccctagaagtttcccattggccacttcatgctcaccccatgtagatgaagtggtagcccgcaatcagtctgatctgaaagcagccaaccagaagctgaagtgaagttacaaagatcacactcctgtgcaaatatctgattggttgcaaaaagcaaccaattgctttttgcaaccaatcagaggctaaggtgaagttacaaagttatacttctgtgcaaacgaggactcggcctgcaatcagtctgattggttgcagacagccaatttctcatctgctgggccaaaaaggtgaggggtttgcagatggagttgcctctggtcctcttattactaagttgtggaaagttagggttttcctttcaatttagtttgaggaagttggtgttagacagccttaggttccctgcctccagacccaattctcccacctcactgtattgtatataacattagaatgggaactttctcctacacacttaaaatctattttctatacttattaaactaaaaaacttggagtagaaattgaaagggtatatttaatagaataatatattccaactcctaatgatcaattcctaatacacatttgtcttaagttggaataagaactctttctaatatatttttgtgtagaatattttttgtgtagaatatcaattaaaatgaaaaggacacattaagaatgaaagcacttaacattttaaagaatttgttcattaattctgaaatctttagtcctaaaaatttgagttatattgtaataaacaacaggatagtttatttaacttcgaatgtgattttttatttgaggaatataaaattttaacggtttggtagagaagtagtctttgattttcagaaatttaaattttactaattagaatacaattttgaacttcttaattaaaaagttccaaatattgatattttatgagaataggccctgttcataggtctaacatttatttagtaatgtttatttaacactactctgtgaaaggcaatagccaaggctttgagatatgataataatacaaacaggaactttgatctcatacaaaatgtagagcaagagaagtatgaacaaataaataggcaattatactgcattgcccaaattatcccataactgaagtacaaagttcattttatattaaaataaaatttttttccagtgctttattttacaaactaacttctttgaaattaactcaacagaagtatattgtgatctgtagaaaaacaattagtaaaacaaactgtaaaaaggctcagaattaggcttatacatattcttattgcattctgtgtgcttgtaacataatcaagaagcaattgcattctctggaagagaatcagaatgcattggattaaaattgtagctttaagaagagtttacattttcattaaaacataatttagttgggttgcacaagtaggtgaagaaagcatgcgtttttattaattgtactaacattttaaatatgaaaattgtagacatgagaagaaatttatgtcacaggtcattgacagcatttatcataaacctgaattgctatttataatcaactgcaagtagcatcacatctatttttaagttgcaaaattgctgtagtaccctatctgtggcctctgaaatttggaaagaaaaaatgtctttctttttcctctttccagcctatcagttgcaaagctgtcctgatccacgcccgtttcgaaatggttttgtaattggtaatgattttactgtgggtcaaaccatttcatttgaatgtttcccaggatacacattaattggaaattcagctctcacatgccttcacggagtcagtcgtaattggaatcatccacttccaaggtgtgaaggtatgcttctaacttgaagctatcttttaggtgatgtcatctgtttttaatattgttttggcactttttacttgtcttcctcttccaatagcatgctaaatatatagtctctcagctgaagatattttttaaacccctaaggctctataatgaataacgattttatcattattggcaggagtcctaacctttcctattgggagtgaaaaaatagttgattcacactttagagcttttcttatgtgtgtggggaagggaagggggtgcatgtgggtttgtatgcatttaagtcattcttacataaaccactaacccagatactgctactgagttcctttcctctagaaaatcctttgaaataaaaggctttgaacctcttataaggccttatatgtacacatagtaagaggcaaatgaaagttaaagtctttgcattgatataaaatatttaaataatagagaagacaatgtaatttactaatctagtgatcattaataacaattatttagtatacctcatgtggaaaaataaataaaagttgactctattttgtgcactgttgccaacttcattatacatacctcaactgaagtaaaaacaaggcataaatgtgtttcataatgcttaagatatgtgaaatgtttgcctttttctccacagtcagtttattgttattttaaaatattattttgttttgtgactttttccgtagctctttgtggtgggaatataactgcaatgaatggcaccatttattctcctgggtatcctgatgaatatccaaactttcaagattgtttttggcttgtaagagtaccccctgggaatggcatctacatcaattttactgtccttcaaacagaaccaatatatgatttcattactgtatggtaagtcaggactattgttattgatttattcaattatatacacagtaaaacaaggttggaataaaaatatatcacaatcctctgttacaaattgtcatctgatatttgaattgatgtgagtaactgagggtgacagtatgtgtcttgtagaattacatacacaagagaaataggttttggcttatttgccccatgaactaggtaagcattgtggaacaaagacttcataggtgaaaacaagattaaaaaatattattaaattaatgtgctaaaacaggaagttaacagacttaagtttaaggtatggaagttctctacttacaaaagccagtggaatttaagaaattataattatttaatataactagtggatttctgccataaaaatttaattgtattaaagtcttgtcaattgaaacatctttatttaaaaatatattaaggccaggtgcagtggctaacatctgcaatcccagcactttgggaggccacagtgggagcatcacttcatcccaagaattcaataccagcctgggcaacatagtgagactctctctagaaaaaataaaaaattagccagacatggtggcatgcgcctgtggtcccagctattcaggaggctgagatgagaggatcccttgagcctgggaggtcaaaggtgcagtgagctgtgatcatcctactgcactccagcatgggcaacggagtgaggccctggctctaaataaataaataaataaaaatgtattaaagaaagtatctgaattaataattaactactgataatttatctgagttctaagagttgtaactttaacagtctgtgattctcaagactgttgctgaagaaaataaaagaggggcaaacctcaagcatttaaaagcatcagagttttggtaaaaaaaaaaaaaaacaaagacaatgtattgattataactaatatgagtacattccatttagtaaaaatgtaatctatttttatacttgacatttaaaaatatgtggtcacctacatagatatagaatatataatttgtactcattggttagcttcctgcatctttattattgatacgttagaatataaatatatgcaatacttttattaaatacggttcaaaactacttccacaatcaatcttgatctctcctcctttcccaatccttgtctcatagggatggaccagaccaaaattcacctcagatcggtcagttcagtggcaataccgctttggaatcagtctacagtacttcaaatcagattctaatcaaattccacagtgatttcacaacaagtggcttttttgtgctcagttatcacggttggtattatctgagagttcctatttcatttgctactgtttaatttgtcctggaaaaaagtgaatgtaatatatatttaaccaatgattgaaaaggtattaaaatttagaaattttataatcacagtaactttagcatttcaaacacatttccttgcaaaagatgacctcttctaagtattcagggacattaaaatgtgagcaaatggatataggaaataaatcagtcagtaattacccactggaaaataatcatttctgcatgaaaaccaataaaggagaaccagctgttcatactctagtgcatgtaattttgagacgtcaatagatttttttcctatacaaaatgtttaatctattcaacctgctgtgactctttctaaaattggcattcagtatcttcacgctttggatcacattactcattcatttatactgttgtttcaaaactgtgtctattctagaatcttacagttttaagtgactattccagatcattaagttcatagcttttactgctgtggaataatttatgtatagtctcaatttgatttcattgtataggatcctttgttctgggctctgtattcataaacttaactttttgaaaggacattcagaaggtttcacagaggtgtttctcttctttatttttgttttaatcctcaattggttgtattccattattaataagaaaatggctatttatctataatgattacatccttttatctgctatgactacagtctcattataacacattctgcctcatataactttgtcagactaattccatgagtatttcacaagaccaataatctactaaattaagtttgcaaaaattatatgaaaatgtgaggctggacatgtgctttgcccattacataatgtatgacttagcatttcacctttttaatatacaagtagctaaatatttgatacttaaagcttatattccatgaaaaatatagtatatagtaaatcaactgtgattgtgttcaaagacatttaaagcacatgggatctagtcagaaatttatcataaaatgtttgagttgcttaatttgagcacttatcagccaattagatggtatctaattagtttctccatagtgatccactgccatccagaactgatacgcaatccaacataaccagttgaaaagtcaggggttcagtctatggccataccaccatgaacacgctgatctcttctggaaagttggatattcagtcagacaacttttattccggctgttttttttaaaaaaataatttatttgcctttcctactgagttgatcattaatgctggcagtttgcagatatagcctaaggctgaaacaatagaattattactttgatagaaaatcataattcgggaactaatacataatcattaagataaaaaaatgaattagttgccaaactatattatgtacattttatctccacatggatttctgcctcaatattttttatcattttatgtactgcttgaaatcataaagaaaggactattcattgatgaactataaatatccacaagataaccctataggaagtataaaatttttataaatttaggagacatttcaagggaaaaatattatcaaaggaaaggatgtcagtgttgtgtgtgtgtgtgtgtgtgtgtgtatgagacagaatttgaacattcatataaaaatatgtggataatagatatacataaacacaaaatcttagtgtggatttaaatatacacatatatgaatatataaacatatatcctcatttcaaaatgtttcacttgacttttgcaagtgggctttgagacatgtgtgatagaaatagaattgcttaagaataaagcagatcaaggccaggcgcagtggctcatgcctataatcccagcactatgggaggccaaggcaggtggattacctgaggtcgggagttcgagactagcctgacccacatggcgaaaccccgtctctactaaaaatacaaaattagccaggcgtggtggttcatgcctgtaatcccagctactcaggtggctgaggcaggagaatcacttgaaccccggaggcagaggttgcagtgagccgagatggcgccattgcactccagcgtgggcaacaagagtgaagctctgtctcaaaatcaatcaatcaatcaatcaataaaaataaaacagatcagatattcatttaacccttgattttctatttgaccttggacaagttacactttgatctctactttcctcagctgtaaagcaatgtgatagaattgctgagaggattaaatgtcatattatatatgtataatttattccaattactggcatatattaggttgaaccatataaaatcattggtcaaaaaatcctatgggcaattttacatagctcaactgtagaaatattgtaattgttactattatcagctttaagctgaggagacgttttgagaattggagataattgataatatacaggtagcataatgcctggcagagcagatgttcagtaaatatctgtttccataccatatcttacctcacattttagatttttcaaataggacatttattcattagattttataataaggtgcaaaaaaattgccagagcctaatgaagcctactgtttgaatcaacagctatggagattctacccaaattttaaaataaacttgaagtttgggagcatagccagagttcatgttaaaaattgactgatactttaaatttctctagcctaataggataatttttctaaagcactgctttcattcctacctgccttttcaagaatgcatgaggcctacattaaatctaatttaaagctaccctataatccagttcactgattgttactctgcagtccctacacaacttcagtcaggttggttttctcactgcctcctgaacttccattcttaaatctcatcttcatctccatcataaatactcttggtttcttaactcatcttcagttatttaagtctttttatgttaagtcccatttcctccacttcttgataatttgaactcatggtgatcactgccatcacttctatgattacacttactctttttaccaaacttttgaaaacttaattacaatatggtgtattattttataagccttaggagtttattgactgttttttgaggatacaaatttcttgttcttatcctctttatatttttgttattgactgattgtattttagtgttacagtgggaagtgtgcattcagactctttaaaaagttgtttgcatttatttgagcagtgttagtaacaacttttacaaagatcattttagaattactaaatgtgtaatttctaaattacatcctccttaacaagaacaagaagatatgcctgttaatactaatttgagctataagctcaatgtcataaggaaatctcataatagtaaaaaattggtcaaattatttggaatttttgataaataaaccaagtatataattcattataagcttaacacttattttaagctggctgagtatgcctaatctttgaatggtttactaccccacccagttttctttatatcctcttagacttgatagttacttctgatataccttgctttataattcagaagtgattttctcaagacttgtatatttattttataaggttgacagttcaatatttttgtgtattttcttaaggtcacattgatcattgaagttttatttgttgatatattttgaatgtgctggaaaagagagggaaaaaaatgtatgtttttttctctaacctaacttcctttataagatccaggcagccatctgtcttttataaaacatcaccttcgtaaagccttttatgatcaaaaataacatttataaaaaagctttgcaaaatgaaagctctctgcaatgaaaaaataggacaagcgtaaatgttgaggcagtttacctcagatatcatatttttttctcatttgaggaaatgtttttgtatctctttgtgttgctataattatgatttcctaaaataagaaccgcattttcttcatatctgctgtagagtcaagatgaggttggtttataattaataataatattcagtcctaattaatgaccccctgaaagataaattactcaaaataaattttaactgagtgttctttttgcagtgactttgtatagccatcactatattagtggtaacaaccatttattgaaaatttaatatgctgagccttgtgctaggtgctttccatgtattattgctaattttcatagtaaccctataaggtaagtattattatcttcattttaataatgaacaaactgagtaaaaaaccggataacctacataaagccagagaactaataagtagaagggctggctggagttcaaaataggtctgcctgacttcaaagaatgatccctttttgaaaaatcaaaacaacaataacaacagctaaaattcattgtattcttattaagtgccagacaatgttctaagctggtattatctcatgaatagattatatttaatggtatataaacctaattgttctttaaaaatttagtcaaagtgattttcatttttagcaatgtgatgggtcatctcattttctcaaatacgcctcctaattataacttgaagctttaagcttcttattgcttcatttacccaagatctacaaagtagtgacagtacattatagatttatcacagctcaatgtattctttatagtttctaaaatgtgcctgtgggcactgtgccaagagaaaaaattttattgagatctggcttatgtcactcaaaataaccaggcgactagagtatagccaaaatatgtatttactaatttaataccgaaattattttatggtgtttaagccaattatccaggtcacttgattttctaatatcaatgtactagggaaattcactttgtaagtggaagattttcttagcataatatgatttaataattatgttattattttctgttattggcacattttctattgaagaatgagttgattacataatgactcattattgtaaagaaatgtatttaaaaggcctgtaatgtgtttcaggtcatcttttacggttatgctacttttacaataaatgctgtgtttggaaacaagtatatttaacttcacaaagtctcatcctaaaagagattgctgcagatgtaaggacatgctttatataaaccataagtcacgattgcctttaactgtgtgacccctttgcctcacataacctaaagacctgacctccttttgtattgtaatagctagagcacagaacccgtaaagtgttttattatttgatgtccagagagaacgggggtatggacatcgtgtaataatgtatgtgtgtgtatgtatgtgtgtgtgtgtttgtgtgtatatgtgtgtataaaatgaaacaatggagctaaaacccaaactgctagaactgttaggaggaaaggaaaataccatttactgttagttaaatgacttaaatgactacttaattattactcaaaactaaaagtcatgtcaaaattactatcttttgacacttcactgtatgtatatgcccagttgataaggtatggtatttattttcttaaatatcttactttctgttgcctccagccaaagactatcaggaacacaacttctgttaaacaaagttagatttattagctcatgataatgagtgagacaacatatgatgagggactctgtgatctcagcaaaagtgtgtcaggagaggcttgataaaggaatttgactgtatgagatggttttgagaagggttcaaggaaacataattttcttctggattgggtgctgttagaaaatttgagcagttttatgattggatatcttagtattttttctagaaggtgggggggaatggaatatacctatataattagtgtggaaatactattcactaatgttggctgaggtggaagactgtcattttgattatttgaacagtgttcttgttttctgattatgcctatggaaaggtcttatttctcgcttgtttcaacaaggtcaaagaattaccttgtcttctgggaaactgtttatgtttaacaggagacaatgcctatcaattagagccaggtctatatgccagggaactcaacaatgtagagaagaggtctttggcacattatttttcagattttaatgggctcagcactaaggcagcataccttaaattagctgtctgcatgcggagaagacaattcatgcaacagatattgaaatgttcttacaataatgcagcagatatcccagtagttttgtttcacaatagtttctgttatttcttttctaggtaaatagtaagagtgacttcttgttgactgtattagtccattctcacactgctataaagaactgcccaagacttggtaatttataaaggaaagaagtttaattgacgcacagttccatatgactgggaaggcctcaggaaacttacagtcatggcagaaggggaagcaggcacgttttaaatgttggcaggagagacagtgagtgtgtaaaggaggaactgtcaaacaccatcagatttcatgagcactcactcactctcatgagaacagtatcggggaaaccacccccatgatccaatcccctctcactagatccctctctcaacacatggggcttatggggattatgatttgagataagatttgggtcaggacacagaaccaaatcagatcattgattcattttcattcctcatgatagaaactttctttctcgcatctctaaatccaaataagcattcactcttgatttctaatattctcccttatagaggcagagaaacaaactgaatataaaatattagtgatgtaaaagggatatttgtaaagtaatttaaaccctgctggaacacacttctatcttcatgtcaactcactggcagattttctgcaaaatggaaaacaaatttattgttttcttctcttcaattaaaactaaggtagcattaatttcaatacacttagttctgctttcaagtgaaatagcttaagcttatttcagataagtttaaaaataacactgcccaaactgcataacagaacataaaatttatcaatggttgttctcccccaaatcatgagattatcatacttgaactaatctggatgagcactgaagtacactggggcttatatagagcttagagtttataagggaatatgcaacgttatttctgtcctctgtaaggaatactgtgtccttacttggcagaaaggttatgtgcttgtgctttttttggtttggagaaggaatggcaatttgccagtgttctgttttgtcttttttgaagaaggctttaatagcgcattgaatagaagtagatacatgcagcattattttctggaattgggttggatgtttcattgaaaagaaaatagaaaattaaaaataacgaaaaactattgccagaatcaaatcttaaaccaatttcaaaaagcatatttgttggacgaggaaccagatatctatgcacatttggacaaaaacagagaactatttaaataatagccatcctcagaagatacagacatgtggaatacgatgctctcatgtagttgttagtagttgttagatagcaaatggtgtttaaaagttggtggggcatgtcagataacatgattcttctaaaaagaacacatacttagttccaatgtgtatttttaaagtgtgaatatctattttgtgcagcttttctgttaatggtcatggctgcaaactgtttctaaatagaacaatccatgaaaagcatggactaacatatatgtacatatgatttaaagtttagatgacataatttatatgatttaatcatttcagttccaccagtggctgaatgtgtgaccttgtccacctcatttcacttatttaggtcatcttcctactaccccttaaagagtctaggagaaatgatttctaagattatttccagtttgtctatgatcctaacctgtacaatattggatatatttgtaccagacctgtttattttcttcctgagtaaccaaagcatatattttatacagaatgaggtattttctaactttgatttgttattaattagtatttcttaagtgatttccagagcactgtgctaatagttttgagaccacagacacttacatattatataggatgatacagtgtgttgctaaactcatggattttatactacagtataaggtacatcaatgtaaaacaaggatatccaatttatttatttatttacttatttatttatttttgagacagggtctcactctgtcgcccaggctggagtgcagcggcacaagctcagctgactgcaacctctgtctcctgagttcaagtgattcttctgcctcagcctcccaagtagctgggattacaggcatgcaccgccacacctgtctaatttttgtatttttagtagaggcagggtttcacctgtctctgcaggtggctagctggtttcaaactcctgacctcaagtggtctgctctcctcacatcccatagtgctgggattgcaggcatgagctactgtgcctggccaagaatatccaatttaaatcagaaaagaaacaaacaaatggttagatacgttctgggaagtcacgtgggtgctttgaatgacccattgtgaggaaggtcacgtcagattgaagttacatgagtatggggcacaaacatcatcacagcagaaatgctgatgccaatatttgtcaagcggaatgtaccctccctcttaactggtaatatgttcaggccttattctaagcactttataatattttaactcaatcttggctttatgtctattttacagatgagatagctgaagcagattcttagcagtttgcctaaggtgatggaaatagccaacagcagaccgagatttgaaccatcagtctggttacagagtaaatatttgatcagcctgctttgtgcacaaatgtagttatcaatacaaactggattatgtatttttttatgatgttgattggtttgatagaaacatcttcagaaagagaagcagagctgcacaatgtttaattcccctttgttgccttcaattacaaaacatctgctgcatcacacctcacaatcattacacccttttctttgaccaacaaagacaacatgcctcaattttattcataattctgtaaataattgccaaatcaaaatgtcctttatacataagaagtgaaagttaagaaaagcagaaaatattaatatttatgttatttatttgtgaatgtcaaatatcttgaagaaatagaaacccaatttgatgtcatagtggtttattcttattgaaagataagcttaaaatgtgccagacagtattccaaatgctttgcatgtgtaaacccatttgattctcataactgccctttgggatggcataaaattattactattatcattattattttataaatgaggaaagcaaagcagaaagataaataacttgcccaagttttgccagtttttcagtgttcaaaataagattcgaacccaaagagccaaagagtctagactatgtccttactcaataccataagaatgtgttatatatcatacgtatatactcattcatatatatacttatatgtaatatatatgtatatacactaattcggcatccattctttcatttctctagcagtcagtcattcagcaaatatttattggatgctgctacgtgctgaacactggattatgccctaaagagttagtagttaataagaaaagcaaaaatgcctgctttcatggaatttacattctagtataagaaaatagatagtaaacaaatgcataattcttacagattgtgaaaattgccagactgtgaaacaaagttaactgcaaaggatcaactttaggtagcattatcagtgaagacatctctgttttggtcatgttcaaagttataaaagagctaggaagatagatttcaagaaaatgaaagacaaaagaaaattatacagaacataaaattttagctatgttatcaaatgttaagctctcaaccatttaagagctctgttgatgcagtaattaaaaagactacagtaagaggttgtagacaggtttgattttttgaaatttagtattaaaaatgaagagatgtggtttaacatttttttaagaagtaagaatgataggccacatgcctatcagtggtacttgaattttaagtagaggagataaactattttttgattatttatagctaaaaatataagctggttaataggtggggatgaagttaatcagacaaagttagaaacccttggaggtcataatcaagacttttaatttaatgcgtaagtcatttggggacactaagaagttatgtagactctatcagcaattgtttatttaacacccactgcaatatagactctagtagtctcttgctatccactcttgttctcttccaattgtgtgtgtgctttttaaaaatttctgactacagccagagtgatcttttaaaggataaatctgaccacattcccctccaacttaaatctctttaaaggcctcccattggtctcagcttaaaataaatgaaatcctgagtataacttgtacaatcctgtctgatttagcccctgatttttgctcttttcgatccctcctctctctcactagggctatcattcatctccagaaaacacacacacacacacacacccacacacacaccccttgcttcaactagttaaattctactaattaatatctttctcaccaactattagcatatacagagcaggcttctgtctgctttgcttacctttgcatttccagcacctattatggtttctggcatctggcagatcataggagctcaataataacttatttaataaacaactaaattaaatgtgttaggtattgtaggaaatgcaaatacaatacaaaatacataagctatacgcggaacgtgaaccaatacataaaacaattcaacacaatgaaacactaaatgctaaatattatggtgccaatttctaggctggcaagcttgccagaaatgaagatgtgggataggaaatgaacatggcaaatacaaagcacccaggaaagttcagctgtatatagcagacatcttgtgtgagagactgatgagaattagggtaatgatcttgctttatctaagatgataaattcaatctgtaggccataaaaaaacactgtaaattgaaaatagggaaatggcagcaacaaaatgatattcaaaatgaggtttatttatctataaatcggggagacaatgtgtcttaattttatattggaacttggttcaaattctggctgtgtgagtagggcaaataattcaaccactatgaaatttagtgtcccttttggtaacatgagtatatttacacatattttgatgtggcattttagtgattaatgaaagaggcatgtaaaggacttttcagagtcctttgtacaaagtggattccaggtaaatacttccttgattctcttctatcacttcactgtatgtaagaagggtagtatcagggagacactgaaggtaaggaacacactataggccaatttaataacacaggtgtattagtttactagggctgctgaaacaaagtaccacaaactggtggcttaaaagcaatctttggcattccttagcttatagatgaatcactacagtttgaaccttcatcatcacatgaccatcttacctgtgtgatcatctctgtgtctctttttattttatagggacactagtcatattgaattaagggtacccccataattttatacaaccttaagttaaccaattacgtctgcaacaaccctatttcaaataacatttttaggttccaggaaaggcatgaattttaggtgaaactattcaacccagtacagcgggaattaaatggcaggaatctagactgagatattggcagcaagattggagagacattggacaaatcatagagttatgttaaagaacatactagtagagattgatgaagattgaaaacaaaattgttgcaagctacttatgattaagccttttgtagtgcttggtcttcaaaagtcaaaagagaaacagatgaaaagaggtttgtttgtttgtttgtttgtttgtttttcattactcctttcccctttacttttttattcaaaattacatagttcaaccctgaaaagcattttaaccagatcttgcctatatttcaatgtttagcattgtctgacactcaattgtttctatttcatccccactggcaattttaaagttgggagtcatcttagggaagactgttgagagactgcttccctcttgaagaaacctacattctgtcagttattagcaaatattagttgaattataagtatagtgacaagaactaattcctggatagtgaaaaaggtagataaacaaatagcctctgtcatgtaacttaaagtctacatagggacccaatgaacaagcatgcaaataaatggaaaataacacactttgaacaagtcgtgtttacatgtgccacaaaaggggttctgtgattagaaaataacagtgaggagtgggaaagggaggcatgaagaggtcagaagagatgtttagcctggcaatatagaattgggaattgagacacagagtcagaattgtagccaaaagaatcaagggaatcacttaggtaagaatgtagaatgtttattcaaaggaaagtttgttcagaattcaaatttatacaattgataagaatagagttgttcttattgaagtagagttggaagttaaggacattacacctcagaccctccatgggctcacagtgatctcttagcttctagggacacattttataaaactgacagtgataggaaagaacagagaataagacattagctcacagcacccatgttgtcttggaaaaataacataataactctgagcatcatagtcttctttagtaaaaaattacaacctttgatcttttaaatcctgtgactgagttatctaggtcattctcagaatattccacagatgataatagtcatggattccacataaaaaagtgtttcttgtttacaataatcaaacaatttaggattagcatgaagattaaaataacttcacagaaaaacacaagtaaaataatacaggtatgagcatctctacatttctgtaatttctgagttgatctctattctctggtaagatcagacaaagccttctctaaagcatagtctcagaaagatttctctgtttaggctccccctatcttctccattttctcttacattttaggcatttcttacaattaccttttttctttatcactgtaccccctttaaagtataagttcaggaaaacaattgtcaaaattcctaattactatccaccaaacattttatcaaaaatctggattatactttctgccatggggttctttcccagcaagtctttcttctctagcagtaacccttctgtacagtggtgttttacttgcaagttaacatccacgcacagcaagtgcttttataaacaggttaaactactggaaggaagatgtttgaagggacagaaaacaatttgcagaagaaaattaaaacacgatttttttggttgtttcatcactgtagatctacattttgaaaagtctttcttttctttgtccttagtaacctgaatgtttattagccaattaatctcttataaatagctttttgttagatgatgatgaatcaatgattttatgctttgcacaagtttttgttcaagttttctcctccacctgaaatgctcttctccccaggatcactcttcagaactggaaaaattttactccttctttcaagtatatctcattcttttcctactataggagtcttcctgagctggtctagttgatgcttttcaatactcccataatacttttttgcaatagaagcagtgttgaatgggctttgaaattagaggatatacacttcagtttttggctatgtcctgtactaattgtgtgctcttgtataagctactgtgtattttgagtctcattctctttatcagcacgttgagtacataaagaacttctaagtttaagtagtaaaaataggcatataaaacaatttgcctcagatgttataatagtataaaacatgtttcctgaatgaatatgagtatagtacatttttagaagactttaagggaaaaaaaaagacttcaatcaagcaaatgattttgttgtagattttagatgtcatgtgaggatagtaggcatgaagcttggattcatagagactttgtcgtggtggcctttcaattatgccaaatgccaatctaatccaatgagatgaactgttcaagtgatatcataattagaaacatgacatttgataaacagatatctcataattatattaaagtagcatggcaagacaaggctctggagccaggctatctaggttcaaatctcagctctgtcacgttatagcttcttgatttgggcaaatttttaactctctttaacagttttcttttttaaagaatgggggcaattcactcataggtgggaattgaacaatgagaacacttgaacacacgaaggggaacatcacacacccaccggggcctgtcgtggggtggaggggaggggggagggatagcattcggagatatacctaatgtaaatgacgagttaatgggtgcagcacaccaacatggcacatgtatacatatgtaacaaacctgcacgttgtgcacatgtaccctgtaacttaaagtataaaaaaaaagaatgggggcaattatagaaatagtaacataaattaaataagaaaattttttttgtgaggattgagttaagtatttataatactgtctggaataaagtaaacactgagcatttgtttgcaattattgctgtatgccatgcactttgctaagtgcagggcattcagtgatgagtattgggaaagataggcacagagcaagtaagcaaacatgaatacgtaattccaaattgtgatcatgcaaaggaggaaaaaaacaaggtgttttgaaccacataacaagaaggactagaataagggtaagaaataaagaataaaaagtaagcattgttaccatgggaaaatattttgtaatgttgtagtatatttttaaaaataaagatgtaattgacacttgataaattatgtaatttatttttatttttttaaacaactttccataattttcttgtttttttgcatatgtgaatacatgtagctgcacagaaaaggaataaacactttgtttatttttgtagcctatcaactaagggtgtgccaacctccaccacctgtgcccaatgctgaaattttgacggaagatgatgaatttgaaataggtaaagctgttaaattattttcaaggaaaacatactgctggcagaactatttgcttaaaaataagccaaaatacagaatagtaatagcctgtcttgagaccctcattccctgtgttgatagagattatttagaatttttaagaagggagaaggagtgaaaagaggaaagggattattagagaagaaaaattaattttgtttttctggaatgtacaataagaaaacgtgttaaaatttgaagccgttaactgtattctgatggttctttccaaactattattttgctgccttctgacactatagttctaacctttgttctttgaattcaggcctatgcctgacttggcagaatgaatggtttgtaggccatattagaagacatatttcatttccatatcttggaaaatgcttagttgattctactcaatttaatcataaagttgctttaaaactgagttggaaattcaacccaaataatgccacacagtttgaaaaaaaattatatacgaagacatcttaatgttgctgtaataaacttttattattcattattattattatattgattttggttgagacacacaaagaaactatcagtgaccgatgtaacttcaataaatagaaagccttctaactacttgttgtatttttattgaatatctcacctatatcaactaaattatttccttatgactattgcttatatccagccagcatgcaccagtacagagggaatggcagttcacttttgccttcagtcctgatgggtcaatgagtattatatactggtttttcaatattttgaatataactcctacttatacctaataacatttttatactgattgaaaataactaaaggagaaaatattctcctacaattgaaatatttgtttatttttatcatcaccttgttgcttatatgaaacctcccctcttttgtttaataggtgatattattaggtatcagtgtcttccaggatttactttagttggtaatgcaattctgacgtgcagattaggagaacgactgcagatggatggagcacctccagtttgtcaaggtattcaatggttcctatgattatttatttcttaaatatttgctttatgtttaacttaatataggtatgattgagaaaaatctatataaatatgaaatgtttaactggaaacaatgctatacattttataactcatatgtgctatttcatttagaaatagtccactgtttatcagatttaactttaaacatctttgattctttcaagggtaaatttttctggtttagcatgaagtccgttcaacttacttcaattattttgctcttagggatgggaatggaggtggagagaaagggaaatcactttaaataaaggtttcaatgttaattgcttttacttagatagagcttcttatctaaccactagactcattaaactttgttgagtacctgttacacaatgaggatctaaggaaaaaacaaacaagcagagtaacaaaaaataaattttaagtggccctcgctgtggaagcatcatggaaaagggatatggcagtcatacaggggatagctgtacagtgtttagggaaagagaccaggaagctgtagattcatataatttttaaccggttgtggggtagggaaagcttgatggaagcattgtttcctgagtcatgaaacacaattccaaatgacaatgagtcttattctggtagaacagagctagagagagggtggtctaagtggcagatatatatgcaaagatagagaagtgaaaaacaacagggcatggacttcaaggattcgctatgttacaagagcaaggcaaagatagaccttgaatgatgtgctaagctgtgatgttcaaaaaacatttattgttcatttgtgtagcccctaggcccagaacagtgcctaacacacaattatcataaatgttgattaagttgaatacaattgagttgtattttattattctttctagcttttttggattaattccttctttaggtttcgtttggaaatctgtttcttgtgcagtatcttagctgctataacaagtctaaagtaacttctgattattatggggttttaagcatactataaaattgaaagcctttcaagaagataaaaagattgcaggaggctttgatggtagcaaaaagaaaagcaggaaagtgggtgtgggggtataaattggagccaatgtgagaatttctcatggtcttactgctattaggacatcttgaagttggttgagaattctgaagtctatcacttacatattccagacatttagatgtcattcattcagctttttccttcatgtaaggctactctctagacctttaggattatgtcggtttcatgttcagatatttagatatgcaaatagagaagacagaggctcaacctttgaggggttatacatgggaaaaaaagttgagcagacacaggatatgtcaatgagccaattacataacagcatttctgtcttgactccaataaaaactatattgtgagctcttggagagcaagcttcttgtttttatatctgaatcccaattcaaaaaattttttacgaattaaagtaaatataacattcagataagctagatattttacagttttttgtctctcagactttcaatgtcttattccccaaatcagaatttcctgtagattagtaattgaacttattctgtctgctgtggagaatacagaaaacatagaaaatttttgtctcctgataacacttcagatactagctaataaagttaataaatcatcctttagaatgagtttatgtagagtttctatattaattatttcaccaggcatttaagccaaaaaactaactttacatttttgtttaattgagtttattacacaagcttgctaagacagtcatttgtttggaatcggctagaattaacctacatcgtttttagtccatttaaaaaattttttgacttttcctaaaaaagtagtagtatcatttttcttctctcttcttctctagatgctctgtagctctatgtgtctcacttaaaatgtggaaaataattccagatatggttttctgtaaagagtttgttgtaaatgaaatttaatggatgcttacattttctggtttaaaaacattggctgcaactgaatctaggagattttgagcactttaaactttctggccatcagttttctcatatgtacaatggggataaaaagtatacacagtttttaaagttgtgataacggagataatgtaccaatggtgtttaacagtgcctaacataaagttacaatcaacaaatatttactgttattcttggtggctgtcaggcttcttgctatatgttagataatgtgagaatagattaatttgtgtattgtagtaaagtatattggatcataccagtcatttcaatatgtcgtagccacatacttacttttttttggcctttgactcatatattccatatcatttccaatcttcaggtttatctatttcttttttatgtatttttaaattttttgaaaatcaatgtcagagttctctttttaggtggagaaagaatgacctgataccatttatgcaatatttttaatctcaaaattatatccatgaaggaaaatcccaggttgaagtagaagaaactgaaataatatccaaaaaaagtagaaaacagctcttagctttagctatactatattttaaactctattatatagtcagttttcaaaaagccatgtgttagttctggccggttttcaagttttcaagaagtcttttcaagttattaacatgtttatagagaaatcatatgctgccataatccactatgttagttactcttttctactcctatacttgttggagactttataactcaaaaatatttaattgtctttgtaccctgaacactatgaatatataagttcttcatctatttattatattccagcaactacattagtagttttcaatcccaactcattcaaataaacattgaaaaacaggaattcttcttaaagtgctgctctaattattttgagaaacaatgctatttaactccaaaatgaaagctaaggtatagtagatgaattaggaaattgcatgggatatatttctaattaaccaaatcatcaaaattatctagttcacccattcattcagttgcctaaatgttctcagtaagaacacccaaaagatagtccagtctaagtttaaaactggttagcaattatgttcgtaagacattttactatggccattatactattctgacaaatagaaagttcttccttatattgaagcaaatcctgtttggtgcatattggtttacttctgcacaatggaccatactaaataattccaatactctttccacatcacagaacttcaaaaaaattttgtaagagattaaaatggcataatttgagtaaaaagggattgatcaacttagtcatattcttcattctaaatccaaatttaagtagatgttcataattttggtctgatacagaatgcaattgatgccaacaactaaaatttgctatatgttgcaggctgttagaccataattatgttttttgtcaatgtataacacattttatgtgtttttatagtgtgttgatatatatacatatattatattaaagcagaggtatattattaaataaaaagagtttgtgctttgggctacatttatgggctggagatagtgtagagctgaaaggcaactggtgactcagaactgtgttaaatcctcatggtaaacatatacctgatatcagaaatgattttacttgaaatgaatactttgagagaggacagttttctatctgaccccacacacctgagtgagtagaaggtttaagagagaagagagtgagttaaaaagtaaggaaagaaagaggtaaagcaaggacatagataagacaggcagaggtgggagaacaaaagattaggagaggttgggaaaaatgtgaagaaagaggaggcattaaatggcttatattttatttatgtatttatttatgtccagaaagtggtgcatcttccatgtaataaaaaataaatcaatactataaatttttaggtcattcctccagcttttgaatcataagtttaatacaacttgtctcttctaacaaataattcaacgtatcatccttatagctattgaacatgaaagcagaatactcagtatctaaaatacagttttcactgaggctctaaaagactggcattatttaatgacatttttctttgacagtgctctgtcctgccaatgaattacggctagattctactggagtcatattgagccctggatatcctgacagttacccaaatcttcaaatgtgtgcatggagcatttcagtggaaaagggttataatatcaccatgtttgtagaattcttccagacagaaaaggaatttgatgttcttcaggtgtatgatggtaaccaagggttatatttattggatattcatcaattaagtacaaatgttctaattatacatgtaaactttgagtataaacagctgcttatgtgagtttatcttacagatatttttagaagtaccaacattaaattcactcctataccatatgaaaattatagttagctccactattattttacaaattatacatcatttagctatagaattaaaatgcttaaaacaaacattttatgttttcaattattgttaatgaggtagattggtggtgaagcaatttaaccatatttaatactattctaaagatataaaatactaaagacaaatgagaatataattagctttatctaaattgttttattttcttcccaaaggaccaaatattcaaagtccagtgcttatttccctcagtggggattattcatctgcttttaatataacaagcaatggtcatgaagtatttcttcagtggtcagcagatcatggcaataacaaaaaaggcttccggataagatatataggtatgtaaaacttataacttcaggacagatctcactatcatcttcggtatgattatgattaaggagcagagacactattcagttagacatgaattcaaatcacagctcctccattgatggttcctggacaatttatgtaacctctctatttcctattgtaatgataataattctacatccctcatatgattttgtaaaatatcctaaaaaagcatttaggatatttatgacttatatgtcagttataaattatcctatatgtcctaaaagcattttaggatatttatgactaaaaaatcctaaaaaagcatttaggatatttatgacttatatgtcagttataaattaaactgtgatttttaatactttaaaaaatagatttgttttctttgaactgacaaaaaatattaatagtgttgctcagctgtgtgttatctgacctatttaagaactcctttaaatgacaagttaaaacaaaggataaacatacagaggtcaaaatctttgttttaatttttatccatctatttgtgatacttgctaaaatatcttaaatgtcgaaagagagagtaacacatcatttacaaaccttccgtttttaaaaacggaagcgttttgtcgctactgcttttccttgcgtgatgcttagaaagatgtaggctggaaattcttgttaatagcaagatgacatagatttttctattatgtcttcctgtttatagggtctactgatactgaaccaataattttcttgttgagtaaatgtacataaatagtcctctattatgtgaaggttatgttccttttctttactgcccttctaaatcatgtcagagaccattctaaatcacgtcagagaccattctaaatcatgtcagaggccatggatatgtgctcaatagcagaatccctcagaatcagccagctgtctctttctatacagtgttcacaccatgcttcccaaatcatgtgtcattggtaatcaattcaaccgaaaattccttttataaatgttttataaactctgacactatgattccgggcatagacagatacattttgaatttcagttctaaaaagtatactcttgaattttactcatttatacaaatttacaactacatataaaatgtatgaatagaataattctgtttaattcccttgattttaaaactctgagatgatagtttgattttaactaattaataatttgtattttacatattagaataacttgtgactgacagcatattactactatgtacataattgtatcctacaatgtttctattaaatcaaaaataatttattatgcaatcaaagtagacgtgttttaaaaaactgaaacatggccaggcgcggtggctcacacctgtaatcccagcactttgggaggctgaggcgagtggattgcctgaggtcaggagttcgagaccagcctagccaacatagtgacaccccctctctactaaaaatacaaaaacttagctgggcatggtggtgggcacctgtaatcctacctactcgggaggctggggcaggagaatcacttgaacccgggaggtgggcgttgcaatgagccaaggtagcgccattggactccagcctgggcaacaagagcgaaacttcttctcaaaaaaaaccaaaaaactgaactatatgatacacccagtcatcttgaagaattttcatacttgagcttatgtttctataatataaacaatgtaaatatctttttattaaagtgttgcccaaatagggcatttaaaagtcagcacattaaattcatgatacatgataacataaaaggaaactattcaaattaaacaattgtaagtattagattgactgtattatagaccaatccttgttcttattatttatgacaaagttggatattaatataatgaaaataccacttttagccctcaagaacagcttgacatattaaatatgtatttttgcctttagaaatgacaggttatgacatatatatcctaagtccaatttgtttcttactatttacccccaaagccccatttttctcagatgaattcattaaagtttcagaaggtaaatgggacctgccatgctgaatattctcaaaagtacatatgaaaaagctatttgacagtatctgttggcatttcaaacatcaggagatgaaaaaacttttttattttattggcaatttgtatcataatatgtaaacgctcttgacagaatgggcacactttaatagactgggaaagaggattatggaatgtgggggcttattttagacatcaaccaaaatgaaatgtatgacctaacatggtagaggtgtctggatataacttcaaagtgacatgtaaacgacatgctctaaaatattgctaccaaggctgtggcatataggtccctcaaatgacaggaaatgcggtttccaaaattcagttagatatttgttgggcttctgaacctccagggtgttaagaaaatacatttcaattcagaagacattttcggtgacaatataaattggaagaaagctcagagttagttatgtctcccaaaagttgtgtcagtagatcattttcaaaagaggaaagagcacaatatgttgttcatatgaagtaaaatttacatagatgaccactgacctacttttaagcactagtcgctgtataggtgtttatcactttgggtaataacttctgattcattaattaaacagcattttttttttcttttgaaaagctttctactgtagtacaccagaatccccacctcatggatatattatcagtcagacaggtgggcagcttaacagtgtggtccgttgggcctgtgatcgaggattccgacttgttggaaaaagcagtgctgtgtgcagaaagtcttcctatgggtatcatgcatgggatgcgccagtccctgcctgtcaaggtgaagtatattatgccaaaatgaacaaaaacatgaatgtgagattagcaccatttaacgtttttatttggatcactaacttttctgagaatggaaatattcggaagcatattgtgaactcttttcataaaaacaaggcataacattgcagaatgataaattccaggggaaagaaacatactgttttataattattcattattgttatgcaacttatatgccttgactttttccccttgtatacatactttattcatacatcctccattccagttactttgttttaagacaattattgaaagagaggaagactgagttagtatgaagtctgcagagaggtaatagagaataagaatgggcaagtacactgaagactgagtttcactcttagcatccaaaatttgcactcacagcaacaaatttaagagaaaaatgtaacccaccacctggatattttttttcttcagtggtacagataacacaacagagatatcaaagatatgttttttatttttctttgtattttgtcaaaagtcgaggcactgagcattatatcatgctgcaaaaagaataacaagcttgttaatcaaaaaattgcatgttttagagtttttgattaagacttgtttttatgggaggctgaggccggagaatgacttgaacccgggaggcggaggttgcagtgagctgagattgcaacactgcactccagcttgggcaacaataacgaaactccatctcaaaaaacaaaacaaaacaaaacaaaacaaaaagacttgttttaaatagtagttgagtctcttacgtaagtgtagtcatagtcataaagacaagctcaacatcagctacgcagaaaagctaatgtcattggactttgaaaattttaaaatacttaattcattatattattttatcaagatgaaaattaattttgtattttgtttaactctactcagcatgtaaagatgcagatagcaactttgaattctcacatgaaaaaatgcaggatactctaggttaataaacaagaagtcttacttattacctattttttggtgggcatttataaaaaacaaaatgtaagataggtaattaaaatttaaaatcaaccaataataagttaaaattagctaaagaataggtattaccaggcacttgaaatggcttcttttacctattagagtgcaatttataattcataaaaggatagctttcaaaggcatatgtaaacaaatgcaaaatgaaagaattattgtttcttgttgtattgatgcaaggaaacattaatcacttattaggattctgggaagcaccattaccttaatgggttatcaacactgaaggcatttacttcatgcagaatagatacattttaataaagtattaaaacagctgctttccttcgaccaatgaatagcaggagtatttacagttcttagtattaactgatttcccagaattaatttgggaaagaatctttgatgtcaaatttcataatagaattaaaagatataaaataagcttataatatatatattttaaataaccattaacatgctctgaattttaattgtttttaattttaaacttttgtattttagttacataatgattgcttttatttatatttatatacacacatacacatacacactcctatatggtatacatatataatccttaagaaacattttgtgagaataattgactatcatgtaaaataaaaataccgcatgctttctgaaattttgaaattgctttgtagaattagtgctacaatttcattgaatatattccatgtaatttacatatggagtcattttttcaatgtccttaatttaaaattgttttaaattcaaataagaaagttgaaatatagtttaaaaatgagatatttggtgaagtaaaatgataaaatatatgtaaatcatgtagccatttccaaaaattgatcttttctaattgttaaaaaagattaagaaaaaatgcttacaggatatgacctctatttggacattactaattgaaatgaaatgtttgtatgtcatttggaagagctatttgcataatgcaccttttatttcaacttgttttgcatttttcagtcatttttctttctcttacctcttaggtcttcttatacatcctgacatacatttacttgagctataaagttacacaacatgaggataaacatagaaaattagtcagctatatctatttgggtttggtcaggtgttttatttatttttgttctcatcacataactattgatccccccctcaaaaattgaacaatcctcatgaatataattaaatattatgtagtgttacgtggaaactcactttgtattccgtctcacttttaatttgtgatttcctgagagttgtatagacaagcctcttttacaaccactcaattatgatgacttttcttctgaactggatttattttctttcttttcttctttttaaaaaaattagcggagaagttaaattgttaactatccataggcacaggaattgtcccattattctggtacgttgtctctttttagttctaaaatagaaccacattttactaaacatatatgtggaatctatactatttaactacatctctttttactttgacctagattcaatctatactacaccaacaatgaatagttaatttttaaaaatcagtaaatacatgatctttgggagggagatggcatataacaacttgaaattcccaaaagttctaagtgaaaatataaacattgctttatcagacatcagggaaccatttacttttcaacactattttagaggttctgtaattagaaagcagggataataacataattatgtgagattgcatatgtattttaagtcagtgttacagcttttctgttcataatttacaggttaccaaattacagaagatcaattattcagcagtagggattctgccattcagttttgacagttttgtaaagatttcactaaggtttttcattttatatttaatttacgtgggttaatgaaaattaagcagcaaatggtagattttataagagaagtggaaacaatttttggtcgaaatggaagatgggtgaatagtacatagcatttataatatttaaactaaactcatctttctgtagtttatttcttctgttatgagagaaaatataaatctgtaattctttgtatgaaacgtgtaagctagatatctttcataatacagaagctttctcattttataacaataatgcactacatatatctatcagttattacataactccagttggttctggaatgacactcatattcaaatacgttagtccttatgtggagatatgtataaatatttactctgagagtgatatataaagatacacatagggccagatgcagtggttcacgcctgtaatcccagtactttggaaggtagaggccactggactgcttgagcctaggagtttgagaccagcctggccaacatgacgaaaacccgtgtctacaaaaaaatacaaatattagccggacctggtgatgcgtgcctgtagtcccagatactcaggaggctgaaggtaggaggactgcttgagcccaggaggtagaggctgcagtgagccaagatcctgccactgactccagcctgggaaaaagagtagtactgtgtctcaaacaaacaattggccaagtatggtggtacgcacctgtagtcccagctactagggtgctgaggtgtgaggatcacttgagcctagaaggtagaggttgcagtgatcccagatagtgccaccgcactccagccaggcggcagattgagactcctgtctcaaaaaaaaacaaaaaacaaaaaacctgactttaattgagtattgctaccaaatatatactttgaaagattatgtacatgttatttgaaagattatgtgtttttttttttctgtttctaagtgccaattgtgtacttaatagggcaaaaatggtaaaaaatcaattttaggggatttttctgtagccttttaaaattgtaaagtataaaatatatacaacaaactaggcaaatataacattttacattattatcacatcatagtaaaactaattttcacctaaatcaaatgtattgtagataaaaatcaagacatctaagacacatcagtgaaattcaggaagatcctaactaggtttttaagacagtaagtcctggccttgtatttattaaacatatccaatatacacaatactttgtggatggtgccccagctcatacattgtggcttctgctaagacagaaatagccagctttcaggtaaaataaatctatttgatttattcctgaccaaaattatgattcatattggttgccactctctttaaaatatttaatatttatctgtcaaattgaattaatcaaacttgctatatgatggtccagtcatgggcttgcattagagatactctttacctaacttgcattctcatataatccatacaaatgctgataaccatgcacatgatcaccagaaattaagtaagaaaccaagaaataaagcattaacaatgtatagattcatcaatttataaacattgctaaataagggtttggaataaattattcaaaatttatggttcggaaagtatttctgtgattctgagattgtttcagaggaattgataaaaatccccgttagttttgcatgttttacagttcagcagagttacctaataaattaaacatttttctgtttatacgattttgcttgtgtgtatgtttttctagcaatttcctgtgggattcctaaagctccaacaaatggaggaatactaacaacagactatttggtaggaacgcgagttacctatttttgtaatgatggatatcgattgtcatccaaagaactcactacagctgtatgccaatcagatggaacatggagcaatcataacaagacccctcgctgtgttggtatgtgtgtcaagggaatttcatcacttgtttttctcttggtattttatatacctgaaattttatgtattttagaattataaaaaccaatccctaaactgaaatgtgatgtctaagtcagaaataaaagttaagtaagctatcttgtacaatgaagtactagaagacagtacaaggtcttttccatcatttttgaaaacctcagaatatttatgtcaaaaaaggcacttttattttatacaatgatgttttattttgtaaaaagtcatcctttagtcaacatgtgttttcagtacatggccccttgagaaaatttttaaagactgtgttaataaaattatattttgacatatttcactctgattttataaggataaataatgttgcaaaaattatccataactttaaacttttgttgatattcttctgtttacttacacttagaagagttcctattgctgtcactattacttcactaggtaaataagtttacataatgataagacattaattctggtaaagatttggtagcaaaaaatagaaaatattgatgtgaataaactcttgaattttctctatatttcgattattttttcccatttagtactagcatttccacttagttgtgatttcatttaaaatgaagattgttaagttgttcgcactctcagcataggtttctaataaggcttctacttaccttgaaaaagttttgaattagctaaagttgatatcactactcctgcacaaaaaggccattcacatcaaaaaaatttcctcaaaatatagtcttttctaaacttataaagaaataagggagtagaggtaagccaacaactgggattctaagtaggtagaataataagtacaagattgaattgtgaaaccattgagtgtgttccagactgccagcaataccatatagctaggggaatggaaaatatcaacatgcaaaagaaataaagaacaaatgctaaaggaccttgtatagtgcaagagtaagtgaattaggtcagtggagatgtaaagaatggaatagacgttgagatatagtgatttgttagcaattacaccctttggtttttgtatagttgttacatgtccaagcatcaattcctttatcttggaacatggaagatggcgaattgtgaatggctcccattatgaatacaaaaccaaagtagttttcagctgtgaccctggttatcatggactaggtcctgcctccatcgaatgtcttcctaatggtacttggagttggagaaatgaaagaccatattgccaaagtaagtatacactctgctaaacttatttcataagctatgtttggttatcgaattgtttgaatcagttcctttcataaacacattagatcaataattggatgacattactaatatggtcatttattctcgttacgtttttaaattttctaactatgtttctatgtattagtaaatgcttttctagcaaatagaaaaacatgggctttggattaagaaatctagtgtttgaattgttgatctattacctactttaacaatgaagtaatgattacttactacttgacagacactgcttttagtcctttatatgttttatactcatttggttaaaaaaaaaaaaaaacctttgccccagatgtaatcattctattaaagtcagagagcctataaatgatagagaaatgatatttgaccaagtagcctgactaaaacccttgactttttatcatgttatatcatgtttattctctctgattccaaattctaaaactagaaaatcttaaaactagaaaattataacacctgtcatgtagagttactgcaaacatttaatggtatgacacaattgaaataccagctataaccacatcctcaataaatattattgaaccaaattgagcagttaaggcgttttatttccatacatttttataatataaatggccagtatctaatatacataagctaacagaacataggatattcaggtgaaatatcttgaactccctttcttacattcatttattgtctgttttgtttcaggaaatatgctaggcgaaaattcagtcttttaattagcgtccaacacaactctatggtatatattgcatagagacccatgatttatagacaaactaataaagagatcaaaggtctacctagggttattatgattaagaagtttaacgtagcagacaactatcttatgtgtaataagtacacaagtatctgatattattttatttatgaatattcactgatttgaaatttattttttgaatctctatatcagtatagaatttttcggttgccctgtgttccaagataatcacattaatgaattaaagtattaaaaatatatttctaaattatatttaatattgtaaaaatgtgccatcatctgtatttttttttgttgtttttgtttgtttgtttgtttgttttttgagaaagagtcttgctctgtctgccaggctggagtgcagtggcgcgatctcagctcactgcaacctctgcctcccaggttcaaacaattctgtcagtctctgcagtagctgtgattgcaggtgcctgccaccacgcctggctaatttttttctgtattttaggtagagttggggtttcaccatgttggccaggctggtctggaactcctgaccttaagtgatctgccctcctcaacctcccaaagtggtgagattataggcatgagccactgcgcacagcctgtatttctaaatttttgtactagtcctccaagtttttttcccaggatttttctctgactgcagactccttgttttttccaaattattgtttaaaaagaataatttgtttttaaagggcacatggataggaatatttcaaagagctaggtaattattatctacaacagaaacactcatttaatcaggttttcaacaaatgtttgattccattgtgttagattctttactatgtagaattgtttaaaggatgaataaggttgggttactgcctacaggtaagaatgagggaatggcaaggaatttaggaattgcaattaattgagaaaaagaaaaaaatagtattttttttctggtcctccatttaatcatcttttaaatgaaaataatataaatattagaattaataataatattagtatatcaataatattaatagcgacctcaaatgattttttttggggggatgagctcaaaatcatcagtacattttaaatttgatatgcaactcttgcaagtttgaaagttttctatttctctacctgacagctatctaaaacttaagactgaaaacctagagagttgttttgagcattacataaatgaaaacactatagcacctagtacataatacaagcccaatgaacatgatctgttattgtttttatgctagaatgacagttcatttgtggtcttcaaatatgaagaagtcataagagatgctatatgacccagcaagccagttaaatttattttcttcaattttttaaaacttagaaaaaacagatgaattatatctaatggatctcatgaaaatcaaatattttacatgtaaaactcaaacgatagagttcttgacaaaaattatattgtaattattattttaatgttggtttagatatgaagaaactttggctcaggtaagtcaaagggcttgcccaaagttacttgataaagcagagaaagattttggattaatgaattatcatctctttaaacttgtgatgtttttcatccactatagccaggttgactaagcgaaaaatgcaaaaaaaaaaaaaatgaaaaaaaaagaactttatgtctctgttacttagaaggttctatggggacttaaagagggtacattttacgttatgtcatctcttttctccctactttcacactcattcaaacatgttttacaaatgccaatttcctttgtaaatacatcaaatcataggaagctcaaaatgttcaaagcacagttttgttacaagtgcagcttgactatatctttaaggatttttatttatttatcattttaaagttatttcctgtggagaactacctacacctccaaatggaaataagattggaactcaaacttcatatggctcaacagctatctttacctgcgacttgggattcatgcttgtgggctctgctgtaagggaatgcctttcctcaggtctttggagtgaatctgaaaccagatgcctaggtacagatttttaatttgtttttgtcaaacttccccctgcccctcacccttgaaaagaggcatctctttttccctaatatgagatactaatttatattcattcagtaagtatgttaaaaaccagaaaatacttatctttaaaaatggctcatgatagaaaagctactaaacggaataatcaaatagcattcctagtgaaatctaaggagagacacattttcttccaggcatggtgaaaatataatggtgaaaactaattgctgaaaactgtatgcctgcttactcagctggattaatcgctgtagctattaagtcattctaaaccatagtcaattctcttttcacctatttgcttaaggtaatgactgaagaagataaacaatgtaatgtgtgtatttaagtacctttcttccgttttatttcataagatttcaacatgcataaaactaatttctattaaaattaaaaaaaaattttttgaacctgattttaggcaattaggatgttttccccttagagtatttattataaaaaatcttcagttaaagaaactgaactagttcgttcttcttaccctgcctcttttattatgaaaatattatattttatgctttatctcctttttcaaagatttcaataatttatttaatattaagaaaatagtatgatttatgctatttatgctttgttttctctaaaatgatttcaagatctgacagcaagtattgagttaggtaataatgaaaatttttctaatgattattcacttatctgttggaagtaaggcaagatctttttgtttacgaatttaaaaattgctgattatcatgaatagagtacggcaaaatttgtacagtgtttttgtctttaaaatattactgtttaagaatatgacacatggcagaaaagtttatacttatatattgtgtggctaataagcttgaaaatattcatagaaatacaatcattatttgaaatttcaaatggtatagttagaagttttggttaaaatgtcttttttctccttctcaggcacatttgttaatagttatgcttggaagcccagcaacaatttctttataagagcacacatatttgaatatacacagggaactcctgagtctctggggtcattaatggaccaggctctggctagggatggagttcctctcagactagtgtctttcctcttcctctttaagtctcacctagacagagcagagtggtgaggataggagtcatgatgtctcccattggataaggttgggcatatggatgaggccacttcaatgattattgaagaaaacagaaaatagttaatgagttaaatgattatgtattaatatgtgattatataatcaaataaaaactcaaaaaaataaaaaatcttaatagtttgtaaactgattttggttgtactaatttcaattacagattacttagtttacttatgcatttttaagtaaacttagtttacatataaatttttaaatttatatataattatatagaaatatatatttatacatactcaagtatttaaattatatattacatgtatctttaaatatgtatacatttataaataaatatatatttaaaatactatatttaaatgatatataatttaaatacaatatttaaaatatttaaatatatattaaaatattatatttaaaatgaaccatatttaaaatatagttaaaataaaactaaattttaaaagcattttaaatatacatataaatttgaaaatactatattttatggccatgtgctctcatgaattgttattgtgtattatatattatttaatattgtatatagtatgtggttttattcacctacttagaatcttgattctgttctctggaaagacagggcataacaggaatatttataagaaaatattgcctcttagtctaaggagacaagatcatccattgtagagaatacagtgtttatatacaatgaaatgcaaaaggatgttggtaggaggaaagtacagttaccaaacaagcaaatcccagaatattacactgtgaattgaccttaaggtttcattcttctcaactagtttgtgtaacctcagacacttttagcttagaacggccatgagaatgtgcttataattgtttctctaagtatggtgcatttattcctgccttcctagtattttattatgaatttttcaattaaaggaattgacagtgaacacccatatgcctaccacctaattctacaattagcatttttttcatatttgcttatcacatatctatccatgtttccaggcctccatcaatccattaatttatttttttgatgcattttgaaataagttgtaaacatcagtatactttgttgccaaatattaagcatgcataccattagctagagttcagtatttgttcaaagttttttttaaactcggcaaaatttgtatgtagtgaagtacatagatcataagttcagttagatcagttttgacaaatgtatacatcagtgtaactaaaccactataaagacatagaatattgccattacctcagaaagttttcttatgccccttcacggtcactgtgcaactctcctcctccataacctgaggcagtaactatttcgatattttcaccatatattcatttcccctgttctagaaattcattaaatggaattgaaaattgtgcactcttttgtataaggcttcttttattctcttttatctatgctgttgtgcatatctgtaatttgttccttttattgctcaataggattctattgtacaaatatgccacatttcagccattctctttttgatggatacatgggctatgtccagttttaggctattatgaataaagctgctatgcatgctcatgtaaaagtctttttgtggacatacgcattcatttctcttgaatactcacaacagaatacatgtgggagagttctagttgtctcccattctctccagcatgtggtatagccaactttctttttctctccattctgttggatgcataaaggtatcctatgatattttaatattttttgtcttaatgaatactaatgttaagcacagtttttcataggcttattggctatttgtaaattttcctttgtgaagtggtaaagtatattgacttgcctttttgttatgaattgtaggagttctttacatattcttgttacaaggccttcatcattatgtgttttataagtattttctcttattctatgacttgcctactcattttttaataacatcttttgacaacgaggaattttcaagtttggtaaagtctatcatttttgtttgttttactttctactagaagctttatagttttagctttaacttttatatctccaatgttatttttaattcctatgtgttacatagtagcattgaggagcttttttacttgcactttgtatcttgcactatttattgaaaaaacttcataataattattgaaatcatgtatgtaaatcctctaaatttgttcataattttcaaaatcactttggataccataacactttgcggtttcatataaatcttatattagtttatgaaactctacaaagagattctggtgggattgaatcctttcatcagtttggggaaaattggcttctaaaaacattgagtcttgtgatccatgaacagagtacatttgtttgggtctttacttattttttttttttttttttttttttgtgcaatggcaacattttgtatttttagcatagaatgtgctattgctaaatttattccccagaatgttttactattgtaagtaaaaagtaaaattgttctttttttattttttagatagggtcttgctatgttgcccaggctggtcttgaaattgtggcctcaaaagatcctcctgctttagcttcccaaagtgctggaattataggcataagccactgtgcccaactaaagttgtttatctaaattacattctccaattgtttgctgtcagtatataaaatacaattattcaaaatatttacctaatattctacaacctttctaaattcacttactagtttaagatgttttaaaaatataattttctacgtacgtattacctgagtatagaacagtttcactattttgtttcccaacattgtgctgtttttcttctttgtattaatgtattgcactggaggtttttttaacaatgtctttgttgggttgagaatgttccctatattcctaatttgttgtcagtttttaatcgtgaataggcactgcattttgctacatactttttctgcatagattgaaataattacatagaattttttctcttttattatgtcaaaattacagtaatttttcatatttagccaaacttcatttctggataaatcccagataatcatgatgtattatcatttatatgtcactagactgattttctaaaattttattaaggaggtttgtatctctgtttatgaagtactttggtcctttataatcatttaaggactttggtactttttaatttttttttttttttttgaggctttactattggggttaatgattacttcataaaataatttcaaaggtgattttttcttttctattttctaaaagagtttgcataagaattattttccccattaaaagcttgaatttcccagccaaaaaaaaaaatccgtgggaaggtttttgtttaagaattcacatattttaatagataaaaactattaatatttttatatttttaccttgtgttagttttggggcgagttataattttcacagaattttttttcttttcttctgaagtgttaaaatgtattggcataaagctgtttttagcattcccttattcttttaatttcttaaggctttatagtgatatcacttcattcctgttattgacaattttattctctcctttttggtgttaatagggttagctaagagtttaataattttgttgctatttttagagaaagaatttttaacttaatgttctctattattcgtaatcttaaatatttccttctgtctacttactttggctttatttttacatcattttgctccttgcttcttcttaacatggagttttaggtcattgcttttatatctctatttcttctactaaaagcactgaaacttattaatttctttaataagtaatgctttatctgtacctctaaattttgatatattttctttcttttatttatttatttattttttttttgaggtggagtcttgctctgttgcccaggctggagtgcggtggcgcgatctgcgctcactgcaagctccaccttccggttcacgccattaacctgcctcagcctcccgagaagctgggactacaggcgcctgccaccatgcctggctaattttttgtatttttagtagagacggggtttcatcgtgttagccaggatggtctcaatctcctgacctcgtgatctgccacctcggcctcccaaagtgctgggattacaggcgtgaaccaccgtgcccagcctatattttcatttttacacattgagatattttataatttcttcaagacccaagtgtcactagacacgtgtcttcttttaatttccatatatttgttgttttgctaaatatttcatagttacctttatgtcatatagttataattgaattatttgttgcttgcttttaagacaactttaaaggtttgctcatgttccacatgtatataaatatacaaataaaacaaatcacagtattaaaaatattactttataacgtatttcagcgggtcattgtggaattccagaactgattgtgaatggtcaagtcattggagaaaattatggatatagagacacagttgtatatcaatgtaatcctggttttcgattgattggttcttcagtgaggatatgtcaacaggatcacaattggtctggtcagctcccatcctgtgtgcgtaagtaagcatggcaaaagcaattagagacctctgatctttggaataattctagtttttgttaggcaagatgaatatatatattatgttgttatatatatcaatataaagtaaatttccacaatccaatttgatactgctatgcaaaagtctttaaagtggaatatgttcaagagaatttcagttatattttatcatgaagataataaattaaatttagctcttctcatatttaatataaatatataatattgataaattaatattcttatatggaagacacattatcaacacatttgtaattataagggtttaaatttctagagaccactgtgtagctgtatcaaggtttgttactatgtgatattacagagctttttatagtggaaaatattttggataaatattatctaacaattatgatactactgtcatgacatcaagattatatactgatgaagcacagtggggaatatattatcattaggcatgacatgaagaacctttgctctcatttcaggtcctctgatgattatgtgagctaatgcagtgtttaatctctctgggccgtaattcccttatatagagagtgtgtggttgaagatgtttatcattatgtcatcttttaacctcaaaatgcattgcatttttaaatatatcaagattacacatatgtaacgtagctatattttgtctgaaaaaaattaaaaattatttatgaggttgcgaaggcatatgaatgatatcatgaactctggggactagggagaaagagtagcagaggagtgatagatgagagattacacattgggtacagtgtatactcctcaggtgatgggtacaccaaaatctcagaaatcaccactaaagaacttatccatgcaactaaacaccacccgttcctcaaaaactattgaaataattttttaaaaagcagataaaaagaaaataaataaaagtttattttaaagcactgtttacactattttaaaattcatacaaaacatatgaatatatgtaattttagaaatattttaaaaagatctcaccagttcgacatatatccatgtgatcttttaggttgattagatatgaattcacagatgaagaataaagtgtattttgaaatatcttttcattatttcttaaatatacctgctgtgctttgtggttttaatggatctcttcctatatgtatgttgtggatttggccattgtgcacttattatgactgctatattatgaaaataaaaatagagctgaataatgataaactctagtacatctcagaatccccgtaagtatttagtgtttcagatcacaatctatcctactttggatcttaaagtcaactacatttttcttatatttttcacctaataatatccatctccagataacggacatttatattaaaattattattagtaaataagtactgtaaatatgttgtaattataataggatcataggataaagattttggaagtgtcagataaacaatacatgggacttttagtatgcgttcacaggaaatatttcatttaatctgtgaccaattgcatgtatacttataaattcggtcataatactgttttgatccaatccacagaaacgtatagaaattctagtttcatggtaatgataataggataatagaacatctagtttcatggttatgataataggataatagaatatctagctgacaatgaaaatcactttccacccctacaccccccccaagcaaattgattgtctgatgatttaaagacaacaatatcctgcttgtgtctgccctggatatgttctttttcatttatattcaagcatagccaattaataccactgtttttcttgttgaataattgagactataaatgagaattggcccttagggtaaaactggtttctttattgataattttaaaccagaataagatgcagttaaattcccaaatgggtaggttgacattaacaatacagctgaaaaataattgctcttgggtcatttcctaagtactgaaagtgactgtggtcgtttcctgtgcccaattaggaagcactattactgaagttgctctgattaatagagtgagataatgcaataaaacagttcatagaaatagtgtttggggaaagccagcactatgtaaaatttatagtgggacacagcattaaaagaacctaattaagaatattatttccaagaaaaattatattatcaaatatcagtgatgaagaaaccagtaagattgatttagagaatattttgagactatctcaaaatattaatgaatatcctaatgcagcctttgtgtatcattttctattttctacattatgtagtcacattaatttacttcacaagcacacatttgcttatcaatctattattcataaaaattggttgttcaaataatattgaaagcactatttcaaaattaaatgcaaaaaactgcctttaaatatcctcaattattaactagacaaggaaaactggtgcagttttgttcttttctactttttaactttgttttttaaagcacaagatctcattctgtcatctagtctggagtgcagtggcaagatcatagctcactatgatatatatgcatagctatgatcatgctcactacagccttaactcttctcctcaagcaatcctcccaccccggcctcccaaagcactgagattataggcatgagtcaccacacctggctagttttgttcttttctgctattaggtatggacatgaactttaattattccccagatttctttgcatttcaatactctgctctttgcctccccaataaagtagagagaaaggatgaaataggtaccgtgaaactttaaatatctatgtaccacttgcataaaattatcacaattttaaataattttctatttactaatataatcatgctgttagactattttgacattctactttgttcatctacattagtaaatgtactttccgtatatttccagataaaaagtagtcttctttctactttgtttgaaatgattaagtataatcaataatgcaataactgataactaaatattttttttctgtgtttccttccctgtcctcctgccacatcttattagctgttagctgtggtcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaaggtaaatgtctaagtatattcccatttggtggcatgataataatattcacataaacatcagtgacacacttaaaacagcttgagcagaatagtaaaaagtttttatctaataaaacaaaaagctttaatactgatgtcatctcattaacaatgctttcctttttctaaatttgtaacatatttttaaaagttaaaagtggtagagttaatttctaactttcttttgtaacttatatttttaaaagttaaaagtggtagagttaatttctaactctcttatttgtatctgttttgtgactgcatataaaaagtaattgagattatttttacttgcaatttgctttggcatttattttctttttatttttctgaaaactatatgtgggcctggcttgccagtacacctgtattgaggctttattcatttttttaatctatagaaacagattaaggagaactcttcgatgtttttccagtttgcaaagaagtatatttcatattgtatgacaaaatacaacctaattatcattctcctgcatgttgttttcttacagttcagctatagcttaaaatatgtcatttttaaaattcgtacttagcgcaatacttacaaagttgctattttcctaattgttgccaaatttttttctttcttctgtattttctaccacatagatgtcagtccattttctagataatccatgggattaattttattattggaatctggttgtttgaataaatttacttttgaaactaagtatgtacatttctaatataaatctatataggtatatgtatattattccaaacatatgtttcaaaatttgtcatttgtttagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaacctttaccagaatgtatcagtaagtagataatgtgaattgtttcttgagaacatgtcatggaaaccataggaatgtttatcatctttataaaatgacctaaagatatatatcacagagaagcatattgattttattgttttactgttttgaaattatacttttctatattttgcaaattcaatgtccaaatgtaattttcttaaaattaatgtgataaatatttatctatcattctttgattttgcactttggagcatataaaatatgaaaagtagtcatatttcctactttacaatattatcgtctgtaagaggcaactacacttttattctgtactaatatttaatatttcatttaaggcaaaattagtcttaaacatccatcatggattcagaatacatgaagatttacacaaaggtgtgacttaaaacttattgaccttaaatatttgtcatatagagacacatatacttgttaatgcaataaatgttaatatacatcatctttctagtcagtgaatatctaataagtgcattttgttatatgttatgataggagttgtagaatgtacataaaatagattacagccaagatgcttaaagtaacacacgtagtgagaaaaataatttagcagttataaatcaaacttctgtgaaggcatagaggagtgaacataaattctagcaattcagtcaattgataggcctcaaattgaactagatctcaaacagttggtgagtcttggacttgacagggaagagaagaacaatttcatagactgaatgaatagcgtgtgaagaaatcgttcatttttggcaaataatttttggttttattaaattgctaaataaaattattttatgattatgcttcatttagaggatttttttatgttcatgaggtgtacttttatgaacattttgtgacaacattcatgtactaatgaagaaacaacactttttgctgtgtctgtaaaatttgattctatgcatatagttcagtaatttggcctgctgattaaaattcatttgacttatttgtgttgactggtctaattatttgaataatttacttacttattcttatgtagctaccacattaaagttaaaaatctcttcataggacttgtaaacctgaagttcttcaggtgttctgagctctcatatgttttttgacttatcatttcctatagctctccctggtagagtattatatactgaaaggttttattaagtttttgtgtcctcatgtgctgtatgatactctagagatatgtgacactcagtatttctctgagtacaactaacaggggacacatgttaaattctgaaactacctatcactcataaagaatattctacaatgtattgacttttgattctgctatgagtagcagttttagtttataagccactgagtattgtctttttacagcataatttattcattactgacttgaaatgtaatgattctagactatatattaaattgtgaatcacagatcaatcttcattgaatctcttgaaccctcaagttcttttcatgtaatttctgtattgcttcactttaaatccacatggtgtcctatgtccttacttagcaaatccacattaatcttctccttaactttcacagattttaccaggaacagatacagttcgaactcatacacatatatatgtggacacacactcatcactctcacacgtacagatttatcataatcacttaattatttttaatgcttacttagcttacaatgttgctgttaaactcatcctcggaatgagtaagttaacagaacagctgctatagctgcaaactccactttgtttttaaaaagacaccttcaacatagatgtttgatttctggaggctttagatgtttcagcagaacatttacttctggtatgttctataaacatgctggtataggttgttcgataggagatataaaaaaattttatatttaataattatgtattgtagtgattgactgtggacaccctggcgttcctcctaatgcagtcctgtctggcgagaagtatacttttgggtctactgttcactattcctgcacaggaaagcgttcccttttaggccagtcatcaagaacctgccaattgaatggccattggagtggatcacaacctcattgttcaggtaccacttggaaaattggacaatatgtgttggaaattacattattgttagtagtagtagtagcaacgtatacacaaaacaatctaaagacttaaaatatatttctctctgaaaaatctcataagaaaagctgaaacactgcttacacattactggaatatgtgtaaggctatagaaatgcagggtactgatgttgtagatgataaattacaagtttgtgttttgaactgtgttgctaatttaaagaatttatggttttaggatgctacactgtatgaagtgcttttgttcgttaaaatggtgaaactattcaagctaaagtatctatcccattttagcagataccacatataattttccccagaaggcaatattgtatcagtggttttctgtcagagttcagttctgtttaactttctaagcaattgattactttaatggtataattttaaaataaagtccaaaatgttgtaaattgaactaatctaattcattttattaaagatatttatctatcctaatattaataagtgacatattgcttagagttatctttgcataaatcagtattaaagatattttaattaataatttgttcacagagtaagtatttggtaaatcttttctgagataaacgtttaagttaccactttttttcaaaaacaccatttacgttttagatctatgatggctccctagttgatactatttatttttacccatcaaccagatattgtgcttatttttctgctttttctttatatttatatattgtccattgtctttacactactttatctctgtggataccattctgatgacttactaggagttgttttacattattttcactttagagttaaaagcagtgaaatggtaaattaaccccaaatcttttaactagtgattaatccctatgaagtgactgcctgggactttgaatgtaatctacagatttagaaaaactatcatttttaatgtaactataaaattgattttatgagaattaaagtcttatcttggagtgactcatagtaaattaactctcagataactgcttatacatgcgaacacacagactcaccccccgcccccaccccacaatgtattaggaaattaggaaactgctactaaattgagtaataaaatggtacacagatatttaaaagtgaaatactaatcttaaaattttgtgtggttattaattttacatcacatgaaaataaggacatataatgaagtattccaaatacacaaggcatataaaaaggacaaatggaaagaacattttcaatgcttatattttcaacccttctctctctctctctctctttctctctagctcgctcactctctctctcaatgtatattaacactatggcaattttgattaggattatttaagaaatgataaaacgactaggtaaagactgagtaaatctttaacactaaaatcaaaagatgaacgcctagttatgagcaatattcttatcagaaacttaagtcagagtttctaaattttggtcttttacattttatttttatgttttcatatacgaggaatatgcagttcattcatctttgatcattggtcattggtagagaaaataagagagagaaacctaggctatcagaactgtattataatatttacatgtcctagcacaccacagttctactttaacaaaaacaataaaaatattatcagtaatcaggaaattcagaaaaggaaacatgcaaattgcagaattcagttttttttaaattttggttttatgagtctgttgtcatttgagttcatagtactgtcagttacacattttccattagcttggttattaactaggtttggaaaaacttatgaaatatccttaacctatttaacgtctccaaattcactgataaaaaagtaacactgtactctgcaactattttctttttcatttacacttttttttaatgactggagtcagataagaaatatgaattacaattttactccatctgtgctaaaacaccgcatgcacaaaaacaaatgcctaccaggcccttggactaactggtaaacttaataaatgtttatgggaattggttaacttgaactgtactgcattgcaggtgatgctactgggacatgtggcgatccaggtactcccggccatggctctagacaggaaagcaatttcagaactaaaagtactgtacgttatgcttgtgatactggttacatccttcatggctcagaagaaagaacatgtttagctaatggcagttggaccggaaggcagccagagtgcaaaggtaatctcaagcagaaattaaatatattgcaactactggattttagtgtgtatctaaatccagatgagtactactaggaaaattactcttactagtttattctgcctgcaactatgaaataaaacagtcgtattcccattatactgtaaccatctcctaagataactataaccgataatttttttaaaaaaccctcattggtcatatatatgcaaacattgttcacaacatagcaaatgtttagatttaaaaagtaatatatatttgttaaaaatatttattctttcctctttacagtagtccctcctttatccatggagaatacattccaagacttttagtgggagcctgaaaacgcagatactacctaaccctttatttctatgattttttcacacatacctgtaataaagttttatttataaattatgcacagtaggagattaaaactataatagtaaaatagaacaattatagcaatatactagaataaaagttatgtgaatatggtctctcactcaaaatatcttgttgactgtactcacccttcttcttgtgatcttttgatctgataactaaggcagatattaggtgactgacgagtggatatcatatacagggtaggtaccctggacaagggatgattcactttccatgtgggacgacatgatatttcatcatgctactcagaacttaaaatatatggattggctatttctggaattttccatatattatttttagaccatgattgaccatggctaagtgaaactgtggaaagaatagtagataaggggagactagtgtacctatattgtagagacaagagaaaatgataggttattcttaccctaacataacctcaatgtctgtcttagcttctagtttgtagaaatggaaaaatatagaaacatacagaagtattattaagatttttaattgtagagtacaactgttagttactagaattcacaacatctagggtgtttgagtaaaattttaattgttctgactcagagttaacataattaaatctttacaagagtgccagttgtggctgaagcctgtaaaccccacaatttgggacactgaggcaggaggatcacttgaggccaggagtttgaaccagcctgagtaggacccagcctgagaccacatctctacaaaaatcttaaaaattagccaggtgtggtggcatatgcctgtagtcctagcgactccggatgctaaggcaggaggatcactgagtccaggaggcagaggctgcagtgaaccatgattatgccactgcactctagcctaggtgacagagcgagactctgtttaaaaaaaaagaaagataaaaaggaaaaagaaaaatattttacaaaattgactagtaaataaaatgttgctagaaaattattgtattgaccttaattgttctttttgtgattattttattggaaaaactaaacttgcaaaatatttttaaacttacttgacgttgtaccaaacatattggttttgtaaatagaagataattcccaatcaaactttcctgagggttttttgattgactatgttatagaaatatttgattatgtttaatatttatattctagaaaagatagttatctttttgtaactgggtcagttttaataatcttaagaaggagttgcaacttagttgatatagggaaaagacttggaaaacatagtgctgagtaaaatacagtaagagagactaaactctttatttctcaaacttattttccaaagtcaaggtctttttaatgatgctgtgggcatcattatacatgcaacattgtgtaggtgacatctaagtcagtcctttgttcagctgacctacaaaatattttatagatgaaatgcagacttgtgctgatattgctttgttagcatgcatattatggataaaaggagaactattagttgtagcaaatacaatagaattaatatttttctcataaatgaagctgataccaatcacttacacaaacagattttagtagacgaatggataaaggatatgaacagaaagcagaaataaaaaaaaactgtaacctatagaaaaaattcaacagaactactaataaaaaattatgattaaatattaaggtatcattttcacctattttaaacacggtaatataaaattattgtgtgcgggagcagcaaaactagaactttaaaatatttcaagatgatttttattgttatattttgagagcaatttgacaaaaattgctctcaaactgataatgaatagaatgataaatattcatgggatatatctattgcttcagtttattactccacttttgtggaatgttttccaaggaaaatagaaatattaaagagaacacacaattatgaaaatgtaatttttatttctgtttataactagcaataatttggaacaatcttacactaggaaaagtattgcttaagcaattttatgtttacatgatctaatagagtatagtcaataaaatattacgatataggccatgaagcaatatgagaaaatgtacattatataaaacttagaaataagatttaaaattatgtgctatattagaaccatgagaaatgatattcatttaagtgaaagtatgaaaggaaatacacaaaaaaataatactaggacagagttgtgaaattattggtatttttactctttattccaaatgttttctattgctgtcatattactttaataatttataataaaacatgaaaggtattttcagaatgtgaaggataaagcacatgtaaaaataaaaatattaaataatgtgtttaagtgacttcatttaatcaatagagaaatgcaaatttgaagaatgtaacatttttgacaaactgagattcttttaaatgatggcaaatggtgttacataggaggtgtgaacacaagcaaagttttatgctatcaatacaagtgtgtattgttataatatctttagtggttctgtggcaatatatttcaaacaagttaaatttttaatgttttaggtattttttattgatacataattttacatattaatggggcacatgtgatattttgttacatgcataaatgtgtaatgatccagtcagaatatttatgatatccatcaccacaagcatttattatttctatgtgttgataatatttcaggtcctcacttctagctattttgaaatgtacaatacactgttgttaattacagtcaccctactaaaatatgatccagaaattattttagatatttatcttaaacatagaactaatgtacagagttgtaaatataagttctagtatgttatatctaaaaatcatagaaaaataaaaccaagcctaactaaatgtttttcaacagggaattggttaggtaaattattaactgtatggaaaaccatacagttactaaactttatgatagaaagataccttaattgtaattttatgtaagaaaaatagaaataaaaaagagtaaattaatatttcactgttgtatactctatacctaacacaaagcatagaatattgaaataattatattcatattaatacataatcatatacacatatgcatatataaatatcaatttctatttttcagtggtggaattttaagcaatctttactttcttccttatacttctttttgtcattttagaaatgactacttattactttgatacaaggaaacaaatggtaccatgatttttaaaataagagttctctctagcaacaaaagaaaggcaaacatataaaatatacttcctataaagatgcatcacaaaaaaaaattcaatttacaaacatgtattatgtttcagcttatttcctaccctgaatatgattcaatgcttttattgtatgctatcagcatcattcctaggaatttgtactagatgaacaatctgctattaactagctttgtgagattgggcaagttacttaatctttctgtgcctcactttcctattaagaaatggtggtgatgttaatactaactcagaacatttttgtgagaagtaaataattttggaaaagttgtggctgtgacatattaagtgcttaatgaatctaaaaaaatagtaactctcatttttattagattatgtctgttgactgctgggaaatgactcttgtgagaagagatggtttggttgactagtactaaatgtaaatgcaggtttattcacaggcaacaataaatcatttttctcctaaatgtcaatattgcagaggcaaagtagttgctgtttcctttcattgtatccagcaagctttaagccttcactcatgatagatgacgcacttaccttgtttcattttaagttaattttacttgtgcttagttcaaataaaatgtctggataggagaaatttgtgtattaggtgtggaggaattaaagtcaagagaacagaaacaacagtacgatttggccatatcttgaaaccaccctgactaaagaaattcttgatttttattgtgcagaaatttgactctgcctaggtctctatttcaaaataaaaattacatgacattttaaaagatgacattatctcaaatccttcttgcattacgtcaagctatggatcatgatatataacaagtaaacatggccaaaattttatttcaggcaggcactaatgcatttagaagaaagtaatcatgcttaacaacaaagtaaaaatgtctgttttatcataggttctgcttaaaatattatctagagtttgatttttatgtatatatgtaaaatggataaggttcttgcctacacatgcatacacacacatacgcgcatgcacacacacacacacacacggcagttatacaaatgataggcaaaaagaaatatttaagatgcagcaagagatgcagatggtattttctgaaattataatcatatttcatatccataaaagccttcacttctgtaaggtactaaaatgccttctgatattacaagaaaattaagtattacgtttgatatattatagcttttaagtcagatagtttaaaaattaacatattgttgacaaatagttaaacacatatataaaatagttaatcataaaaagacattcgtgtttgtaacttttatttagaatatattgaaacttaatgaaaacgattactaatatttaattactttgtttttactcggtttagttttggtactctggtctagaaatagaatttatacattttaatgcaaaacagttatgtacttatacaaacaaaaatatacatagatgcttacaatattaaaattgtgtatctgtcttttctgaaatataaatgtaataaatctctgttgcatctcatcactcattgttacatgtcttccaattttacatgagttgctttttagacagagattcttataatccttctctaaaagattttgtggtacctgaagccaatacagtactctttgaataattattttactctgtagagtttttactgaagctgctaaaaaaagtcttaagaaaatgttataatttgcatcccagtaattaagcgaataaaatcaacatacattcatcttgaatttcaactacctagatactttactacttattttagaagtttttattgcttctttgaataatttgaaagaatcgtttagtcattaacttttttgggaagaatttctgattgcattttttatatatactcttaaacactttgttttatagctgtgcagtgtggtaacccaggaaccacagccaatgggaaagtcttccgaattgatggcacaacattttctagttcagtcatttattcctgcatggagggatacatcctttctggaccttcagttagacagtgcacagccaatggaacatggtctggaactttacctaactgtacaagtaagtatattctcaatatttaaaaatcagtaattatatgaaagtattgatgagtatataagtatttttgtgtgttttgtaattaataaaaccatgtaaggttttaactgtttgtactgcctttcagattaaaggattatagtagttaccatggctgagtgtatactaatgactttaggataagttggcttatcaaggtactacattaactggcagcagaaagagaggtcagaggaagtcagcactaataaatgtaatttaacagaattttaagaacaatgatgatttatagctgcaattaaaattaaaaatagaatggatgcaattttattttgtcaatataacacatattaataacaaaattgatttttaaaaggcatactgattctttatgggttcttgcactgtcgtagtgagtctcgataactgatttgctctcttgttatgttaaaaatagatggcactttggagattctgcattataataaaattactcccttgaagaaatttttgaaaaatgtgtttaaaagtcttaaaattatacacattattgcttatttataaaataaatagtatttaaccaacaataatacacaaccattggaaattatggttattttcattaagaagaattagcacttttggaggctgagatgtgtagatcgcttgagcccaggagtttgagatcaccctgggaaacatggcaaaaaccctgtctctacaaaaaatacaaaacttagtcaagtgtggtggtgcatgcctggagtcccaggtactcaggaggctgagatgagaggatcacctgagcccaggaggtcaaggatgtagtgaactccgaatgtaacactgcactacagcttgggtgacagagtgagaccctgtctcaaaagaaaattgtttagactgtgtgttcatggattctaagtatcatgagaggatgttgctgaagcctctgtagcaaaggagacttggggatactagtgggagggccttttgtattgcagtttggacagagtatatatacttttgctgaccaaataattatcagaaaattaactgagaaggcatggccttgtattgtgtgggtgagataatccccttttatttctgggctcctttttgtttgcattttctggatgaatgggtcaaatgaatttgttgccctcaaaataatggcatacatgcattcctggagaaaatcagttgtagttaatatattgcatgcaaagtttgtgtgcaatgtcacacaagggctgttgagatacccacgtatattttgtctcttcaaaagtgaaaacaaactatgcttgggaagctgttgaaataagtactgaatagaacatattcactaaacctataatagcaaaatattttccagttattgataggaaccaacaacttcagtaatattgatatggaggtcttaatcaggggcatcagggtatttaggctgtggtaatcaactttcccatgccaattattttttatcaggtttaaacactgaacaaattggactatttaaagggaaggcagtaggaacaatagttgtttccttcagtaggtgttatatgatggttcttaattactgtagaccttgttttaatctaagttgggctgtattaactattgtaattagaaggacaggtccaaggggctccattttaccaagctgattgtaaatgccagataattaatattaatttattactaattggttcaaaatgtccgtatcaggtgctataggtcaatgggcactctgaccacaaggaatttaggcaaagcaacagtttcaatgtttaaggtgagacatacatgtttgccttctgttttgtgtttggtaactcctctaaagtacaggatataccttgtacattcagtggtatctcctcatataactgtaatttgaggcccagtatctatgaagaccacaaagatttttcaagtactacatatcagaatctgttcatttaaaacccatattgtggagatgtgaaatccaattctgttattttatctttctgttgaataactattttagaaaaatttgtattttcaattgagtccagttgtggatctttatttcaatttttgtttcttctccctgtatcctagtgttttgttgttgttgttgttgttgttgttgttgttgttgttgttgttttttgggggtggagttacaggatacgcttcaggaagaagggcaatcttctctactctgtccttatttatatgtatcttcctccagagagttccaaatcattattttaaatgttgggggtctcccacagggcagttgttattgggtttagggactccaggcttaagtcaggtttgaattaagcccacagctgtgctatgagatgatatgggtgttcttccctgagaaccagaatctttttgatgacagacacatagacagtagcaacaacaacgaaggttgttttagatacctaaagccatctgagtttaggtatggactggaggacaccacatggtgaccactccttgtcagataggcaagcattggataagcatacttattgcacagtgtgccagcctttcccctgagcactctatagaatgggagtcaacacctgcttgagacacataaccaatagtcatagagtaagacattcatctgagcctagcatcattcatggcttgcactaaatttgagacatatgattaaatctaagacacacagataagtctaagctgagaggcacagaactcagaatcactttgggaaggaccacaagccaatactcctgtctctgaatgtcaattttcaatacttctgacttagatctatcatttaaatcttggcagaggccagaaaagctcagaaaatgcatcaaaatcagcacatctcaaagtgtaagtacactagcacagcaccaagcactctctagccaggtggcagcagagccagttatcaagtcacaaacaacaacaaaaaagtccctcaggtaatgatagtcatcccttgggccaccctactcactgccagttgctctgtggttgcctaagaaagagcatgatcaactgccccctccccagaattggttccatattgactgattatgccacaaggctgaagatgtcccaagaaggtatgaaagattacccacatggtaagactctctttggtcagaaatggtttgagagaagggatggatgaatagtgatatgggttggctgtgtccccacccaaatctcatcttagattgtagctcccataattcccatgtgttgtgggagggacccagtgggagataatttaatcatggggcagtttcccccatactgttctcgtggtagtgctaagtctcataagatctgatgattttataaggggtgtcccctttcacttggttctcattctctcttgactgtcaccatgtaagatgtgcctttctccttctgctataattgtgaggcctccccagccacttggaactgtgagtccattaaatctctttttctttataaattacccagtcttgggtatgtctttttcagcagtgtgaaagcagactaatacagtaaattggtactggcagttgggtgctgctgtaaagataccccaaaatgtagaagtggctttggaactgagtaataggcagaggttggaacagtttggagggctcaggagaagacagaaaaatgtgggaaagtttggaacttcctagagacttgttgaatggctttgagcaaaatgctgataatgatatggacaatgaaatccaggctgagatagtttcagatggagatgaggaacttgttggaaactggagtaaaggtgactcttgctacgttttagtaaagagactggcagcattttgcccttgccctagagatttgtggaactttgaacttgagggagatgatttacggtatctggtggaagaaatgtctaagcagcaaagcattcaggaggtgattcaggtgctgttaaaaagcattcagttttaaaagggaaatagaatataaaagttcagaaaatttgcagcctggcaatgcaatagtaaagaaaaacccattttctgagaagaaatacaagctggctgtagaaatttgtgaaagtaatgaggagccaaatgttaattgccaaaacaataggaaaaatgtctccagagcacaagagagaagtctgtggcagctcctcccatcacaggcctggaggtctaggaggaaaaaatggttttgtgagtcaaacccagggccttcctgctgtgtgcagtctaggaacttggtgccctgcatcccacccatggctaaagggaccaaggtatggctcaggctgtggctttggagtgtgcaagccccaagccttggcagcttccatgtggtgttgaggctgcaggtgcacagaagtcaagaattgaggttttggaacatctacctagatttcaaatgatgtatggacatgcctgtacgtccaggcagaagtttgctgcaggagtggggtcttcaaggacttgtacactctgaagtcatggcctgagctgtaccttgacccctttagccatggctagagtggcttggatgcagggcaccaaattcctagactgcacacagtaggaaggccctgggtctgacccatgaaaccgttttttcctcctagacttccaggcctgtgatgggaggagctgtcacagagttctgttatgccctggggacattttccccattatcttggtgaagagaaacatggggttggagcccctacacagagtctgcactgaggcactgcctagtggagctgtgagaagagggtcactgtccttcatactccagaaagggagatacatcgacaacttgtaacatgtgcctggaaaagtcacagttactcaatgccagcctgtgaaagcaggtgagagggaggctgtacctgcaaagccacaggggtggagctgcccaagatgatgggaacccatctcttgcatcagtgacctggatgtgagacatgtagtcacagaagattattttggagctttaaggtttgactgccttgctggattttggacttgtgtggggcctgtagccccttcattttggccaatttctcccatttggaacagctattatccaatgcctgtacccccattgtatctaggaagtaactaacttccttctgattttataggttcataggtggaagtacttgtcttgtgtcagatgaggtttgggactatggacttttgagttaatactgaaatgagttaagacttttgggaactattgggaaggcatgatttgttttgaagtgtgaggatatgagatttgtgaggggccacgcttggaataatatggtttggctgtagccccaaccaaatctcatctttaattgtaactcccataatttcgacattttgtgggagggacccagtgagagataattgaatcatggaggtggtttctcccatacttgtctcatgtagtgaataagtctcacaagatctgatgattttataagaggtttccacttttgcttggttctcattctttcttgcctgccaccatgtaagatgtgccttccaccttctgccatgattgtgagacctccctagccacttggaactgtgagtccattaaacctctttttcttttttttattctttttgagatggagtttcgctcttgttgcccaggctggagtgcaatggtgcaattttggctcactgcaacctctgcctcctgggttcaagtgattctcctgcctcagcttcctgagtagttgggattacagacacccaccaccatgcctggctaattttgtatttttagtagagacagggtttcgccatgttgatcaggctggtcttgaactcctgacatcaggtgatccgtctgcctcggcctcccaaagtgctggggttacaggcgagagccaccgtgcccagcctaaacctctttttctttataaattatccagtctcaggtacgtctttatcagcagtgtgaaaaatgtacttatacatatagttttgcttttttttttattgtggttagtggttgggaacttgggaaaagttctagtgagtgtgccagggtttgcatggtttgaacttccctgctgatgccaaatgaggaagcaagccgactttcttgttggcttgcccagatgtggagtagaaggggaatggggaggtagaacttgaagcatcaaaaggttctttatgcaaatgctcttgtagtcaaacattttacttagtcaatgttacaaacaccaaaacaccacgcagcgtagttaaacaactttaattagtcaactatttcttcaagagatttaaatagtaagacaaatcttatttatgtacgtcattactacttcaagtgttgtaatatttttgtgtagatacatacttgcatgaggtattatttttcttccactggaaggacttctttaaatttgtcttgtggtccatttctacttatgataatgttttcagcttttctttgtgtgcatatgtttcatttcaccttttaaaatacatatttttgctgggtatagaattctgtatgacaagtggcattcctggccccatgtcagctccagatattgttacatctcatcttttggggtagttttttctcaaaccatgggcagtttcctcaggagctgatcagaaatctgctgactgtttaaggagtttccttcctatatctctagagacatttctctgtcaatgtcgactctggtaccatgtcccataaactctacctgcatagttttctcttgactctcagatccatcttctcaactcaaggagtctgctgggctatgcatagcttcctcttccctgtgccacagacttgaaactctcttaatgtagtaagatgaggcaatcaggggattcaactaatttgtttcctgtcactcaagaatcactgtgctttgttgcctaatgtccattgttttgaaatatttcttttttttaaatatactctttcctttttttttttcttttggttctttcagatggaaggtaaattcttccttgttactccacgttgaaggaaagctgaattcctcttacttacttagaaaatatctcatttttgcaatagtgaacaacttaacactatcccaccgtagcctttaaaactcttatccaccttttaagtatcagttcatgtgaaacatttggcaaaacacctcaagacattttctcctcatatcctttttagctaaaagtaatctctccatactgtatagctttttttttttttttgtatgttacctataccactaaactgtaaactttatagagcagtaatgactgggtctgtttatctcactggccctttatggtggagcatagcacctgatgaataagagcaactcagtaaattgttggtgacagacttcaatagacaaattttattttagttatcagtatacatgatttaccattccaactcaattttttttttttttttttgagacagagtctcactctgtcacccaggctggagtgcagtggcatgatctcggctcactgcaaactccacctaccgggttcacgccattctcctgcctcagcctcccaagtagctgggactacaggcgcctgccaccaagcctggctattttttttgtatttttagtagagacggggtttcaccgtgttatccaggatggtctcgatctcctgaccttgtgatccacccgcctcggcctcccaaagtgctgggattacaggtgtgagccaccgtccaactcaattttaaactacttgcagatagggcctacaactgtatggctaacatagcacataggttctggcatatagtaagttttcaataatagtcattgaagagattgaaataatgaaaatagttcagagtaacagaaatatgctgaggaacactttcattttttttttacaatgaataacaattttgtttatttatggataaataactcaatcttttatttacagctgtcttccaattttagtgaaataaaaataaataaacattcctatttttgtgattgaaaattacattgacatttttattgaattgtcttcatttttcctcaggaatgttaaattataagtcatttgattcaagacagattgattatgaataacataggaaaagtataaggaaagtttgtttctgtcagttcttcaaagagaaatatcgtattgcataaaataatttaagtgttagcttttcaacaatgaattgctattaaactaaaagctgataatttgtaagtttatgtacttcataggcaaaaagttactaacaccccattaacaatccaaaccaaaagcgtaaataaaaacccccaaaaagaaacaaagagagaggtttcagtggaaattaaaacagcctaaacttctgtaattaaagaatctagcatagtgatagtgtttatatgtggtaatcaaattaaattagaatcagtgcttcagattccttctcattcatttgcaatgaacataaatttaaatatatgattggtagaatcatattattttgggaattgtcctagactcacattgtctagatcaagaaactcaggcatcacgtatttagagggcttcctgactacgggcagagctcaacactaaacaataatttcatctatatttcacatatatagatgaaattttccattcatgttattctctatacccactagaaggctaatttcaagtgtaaatatgtttttaataaattttgatgtgttataattgcctctgtagacacaatttttatggttactatatgcccagactatataaattttatggttactataggccagttactatatgaatttgaaataaattatttgatgtatgccagttactatatgaatttgaattaaattaatgaggtatgcaaaaaatttgaagtagctgaactttccaaaccaacatcctgatatcaatttttagaaaacccgaatgtcttagtctatttgtgctgctataataaaattcctgagacagggttaaatactaaagaacaaacatttatttctcaaaattctggaggctgagaagtccaagatcaaggtgctagcagatcctgtgtctggtgagggctacttgttgcttctaagatggcaccttgcttctgtgtcctcacatgacaaaaggggtgcatgttacgccctgactggcagaaggtgaaagagcaaaaaggggcctagctattaatagttccctcccacacttttagaaggcactaacctcattcatggggagagggccctcatgacttaataacttcccaaagcccctaccttttaatactatggaattggggattaaattagcacatgaattttgaagagatattaaaaccatagcactaaagaaacaaagcctttattcttttcatgctaattattactatttcttctcataaataatagtatctgttattgagtgtttaccatttgttcggatttgtgctgatttacataattatctcaattattacaacaaatctatgagatatatactgttatcctttttatttcacattcaaataaatggtttcttagagaggaaacaactttcttttccatggtaacatagctagtaactgtagaatgtaagatttaaaccctagtctatttcactcaagaatccatgttctttagtatacttttatctcttcttctgtacttttctccatttagttttcttgctttattctctgtcttcactacaatggtcaaatgtatatgacatactataataagtagaacattggtgataaggcatatgaaaatgtctcattaatttatgacctatttctctaaaaaatttttaatttctgttttctctgcatttaccaatttgaattctgcaaaattatatcatttcttaatgaaacgaccatttgtaaaatttgtttttgctaaacaatacttccagtttaacattacaatttcctatttatttgttatcaatgatatttttgtcagatgtacaaagcaaatataatgtaagtcaataaataagtctgcaggtttcacaagagatgagatattttaatgtgatgagtcaaagcaagtgaacaagagtgctcgttgaatcttgtacataatcattgacaaagaggatctagtagatttatgacaatgtcagttcaaagaaagaaaatcagcaagattgattatatgatagatatttcaatgtagggtgatttgagaatgaaagaatgaatagaggcccttgagaaaattaataatacccttaaaatatagttaaactatgtggtaaagacaaaatataaagacttcaattttatttggatttctttttactttttaattataagattttggtcactttaagaggtttttgttttttaccttggctagttatctttgggcacttagttcctcctgagtaatgacaaatcagaggaataatccaatttttagcttttcaaaaatctttaacttatattagagcatgttttcttacaaaaacctttaaaaacaaagtagaaacataactgtgagtatacaatggaactggattttttatagattcagttaataaaaaatcatttaaacaaaacctactatcattgggcactttgctaggaactgagaagacagagttcagtcggtaaggtatctgctccctaatatttcacagatcagtgaagtaactttggaattccaagcatttttgacctttgagaatttcctttgagaattttacctttgagaatttcccactggagttatttgcaactataccttttcatttgctctattgtccagcagtaacacacacacacacacacacacacacacacacacacacacacacacacacacactcacccctctgttttttagaaattctagttcaattatatgtggaaatgtgtcagctgtgatttgccttgttcatttcaatgattttagaaacatctttggaataaatgtgatttaataataatggtaaggtctccaatcccctatgcttggccatagtagagatgttggtaaaagcataaacttttactcatctaaattctacctgctgttattcaaccggcttcagactatacgtgagttggaaaattgcaagtctaattaatctatctctaaaagtatgcctcataagcaaaatcttttcccttttcccaacactcattgtttctaactccagacatgtcctcattaagcccactaccagtggtggaaggagaagtttcctcagaataactagttgcctcctgggtgggtaaaatattgtatcttgaaatcaagatcatgcattaaaatgttatgcacactttgacagagggattataagtgtgaagaaacatgcacagagctaaccaaactagaagaaaaagatatttggcataataccagatcgctcaaatcaattccttgatttaaaatgtagtgaagttattttctatgatgttcagacagagagagaagatataataagtacatgtaattactctttcaaaattacatttttttgtcagtacaaaatgttttgggatattaattataaggggatccttagctttcaatgtctaacaggcagtaccacctctgttacctagagcccatcatacacagagtgcatatggtgttttgggaagaagacacaaacagtgctgagacagggcttgccaagtagagtaagaattagctttctggtctgaaaagacatgtgcttattcattttcttggatgatatttttagaaaactgactggacttctgcgtccaaaaggaccaacccccaacatcctgcatctgggaagtcttgttcctttgggctaaggacaccatctttaatcaggtccaggtgataaatgaatctaaggcttccttttccaaatagccacctatcgaaatgcccctgactgaatttttgtcacaaatctgaaaattctcaaagatgtttttctaacagaggacagatcaggaagatggggttagtcttacaaaagagagggctggggatatcccagcataaaactgagcgcagataaaaaataatctaaatctcctcaaggagtgagagctattcctcagcacagtggttctcaactagagaggattttgcttcccaggggacatttggaaatgtttgaagatactttttgattgtcacagtgcaggggcagggggtgcttttggatctagcaggcagatgccagagatatattgcagaacattctacaatgcacagagcagcccctcacaacgaagaattgtttgactgaaaatgtcaatagggtcaagcttaaggtagagaaaccctgccttttgagatctaaagaagaaaccaactttttgaatgtggagattgtgtaaaatcagaagcattatgagaggaatggtttagccattctttctggaacttcattttgctacagtagaactctgttctgggcttgaagctagaagtatggcagagcacatacatatgtaatgatgctcaagcaagcattttcgttgctgcattgtctgtaacagaaaagcagtggaataactcaaacaccagtccataggtctttggttgcataaattatattgcatgggattaatatgccattaaaaatgttatgcatgtctatgtatattaatagttacatgcaaaaatatccattagatattgaataaaaaagtgaatcctgtgaaaaaagtaatgtgactttattttattttaaaatgcacatttacaatgcttgtataagaagttaaaagagaaagtagttttaaagcggcatagattgactagaattaccacaattatgttttatttgtagcatagaggttatttacttagatttatcataaatgatgccagatgggcatcaattacatattgagaagcctcccacaaaacaaattcagacctttcaaataatttatgtgtttttgagaatttgagctgacaacttaatgattcctttatgtactcattcatttatttatccttcaaacaaatatttaatctcttatgatgagtcatacactagatgagactcttaagaaaatagcatacaagagtcaaagtatctgcctttatggagtttattggtgtgtttgtgtgagagagatgggtatttaagaaggtcaatgatcttcttattatgcaatggtatttctgaatttgttgtcatacaatgatatcgctgaattttagggtgaagcactaaagagctactattctaaggtttttttcctgaaaaaaccaaaagcctttttttttttggttgtctctgaaaacaagctggtagtgaatgaattgacttgcagagcaggtgctgtttacaaagactgttgctcttggaaactgcctctttgactagcctttgcttcattaggaagtcaccaaacaaacccttctaaagcttttgttgtcacgcatttcattcatggtggtgccatgatgtgcagaactctttcttcgtgcatctgtaaaataaacgctctgtcctctcttttggtggccgcatctcagctcatgtgccctgtgaccaggctggctatttctccttgccaagattctaatgcagtctggaaagcactgcccagaaaacaacaacactttataggtgttctctttaatttcctcttcctaattaaaaatcttggttataaatataaaataaaataaaataataaattgaaggcttatactcatttttacattcttgtaaatttttaaactataaaaagagatgacgtattgtcggtacatgagtagaattatttgattttctatccaactcagttgtatcattaaaaaaaatctttttactccccaataatcataggaaggaaagcagtcctgaatataaaactctattattattgagaaagaaacactcaaacagtttaatttcatcgaactgttttaagggctccaaaagttatgaggttgaatgctctgaatgatgttgtttaatttaaatgccattattcataatcctaaaacttcttagaatcaacagaatagaatatgaaaggaatcttgacattaatcattcttaatgataacataataaatacaatgtaactaaggtgttcttaaggtcttccatgccttaattcattcttaatctttaatcctgaatctccaaaatattgggaaaagtgaatttaaaaaagacagaaagaggagtagacagagagagagagaaaaaaaataacccagatttacctggagaaattacccttttatgaaccaaaagatttagcagactaaaaggcatgttaagtatactacatgttttttatctccagaaaataaagtgtaacttgtagttttcgttttcttagctggtagaaagttttttagccaattcgctgcccaaattaagcttaaatcctgtgcctcaaaacagttatcacttgtgtgacatatataatctttgtagtgtttgaatcttatgtttgtatttaatcaaaatacatttttaatgaaattgttatttgtgtttctaagctgtctcaagtctttctgaaacattttggctggcattataaagaaacgataatattatgtgtgcacttacactcatgggcatgagatcagtgcaactcataggatctcatgctcagaagagtcttgtgcttagagtttaatgctctgtgatagccatctcaaaattcttaataattttatcttcaaattaacattttgtaattgaagtccactggaacagtgcagcatattctgagggcttggagcttctgctcatgtgcagtctgccttgttgccttctttcttgtgtccttgggatgggtctagaccttttgctcctgacaacctgttgcccctggccctgcatggcctccccatttccatccctgctctgcaaaacgtgacaccctccacccagctcatccattgtgtcatcagtaaagagaggttcacattgcactattgtcctacctccttttaggggttggatgcaaacgtgaggatcgtcagagttggatatattaatggagtcttggggcagaacagagcagtgacagtccctattttgggctggaaacatcatcatgtattggtcaaggacttggatgggatggcccctcatacatctgcatttcttataacaagcacattccagagtgaaggttgcaatttcttgggggttgtctttctgagtgacactgcagaaaatatgctctccatccagcatgcctgataaattagatacttcagtagccatatataggaatatgaatttcaaatattatgttagaaatctgattctgcagattgttttctctgtggtcttatagtgaaggttagaagaggttactgcatcaaattcactacaacataatggcatattaacctagccttttcaggggctaagtgacagtttctgagccatatgtgtagaatctgtaataagcatacctgatcataatcaggaattgccagtatgtggtttaaatatgtttatgttttatgattaaaaatgaacacgataactaattttcctgcttatatattaagtatgccatatgcttactactcctctccattaaatacatgcctcattaaccatctgctcttctaatccaatactgacagtaatcagttgtggagacccaggtataccagccaatggactgagatatggagatgattatgtggttggacaaaatgtttcttacatgtgccagccaggctacacgatggaattgaatggctccagaatcaggacttgtacaattaatggcacatggagtggagtaatgccaacttgtagaggtatgataatgatttcttcaacatttaaaaatggtaaccagtacatattttcttatttttatatacaaatttaaagtatacttaaataaaattttttagttccaggttgcatttatttttctagtactaaaaatggctgtttcttaaaaattttattttaatatatagaatttaaaataatattttgacaaaaacattatatcttattgtgagtaatgacaataagctttaatgtaacaaaaataagtaaaatattatgtccatattcaccattgttatttatataaattgatgaatattttcaaaagaatataaccttgatgaattataactgtaatttgctgatccacttgggtcaagtaattcaagggtggggaaaaattctttctataatttgggaagagccggcctgaattatagaaccgtaatttttcttaaataatgggaaaaacttgtttttcatataatacaatctagaattaacctgttagtcaatacagccataaatttgctactttatgctgtttgtttttccactggaaatatttttataaattttttggccaatttttatgattacttgtagaatactgtacatgcaatgtcagacaaattgttttataataattagatttttaatatttaagatttttcgtttacgtttctatttaaatgtgaattaatagtttaatatcttactgacttataatctaacaaaattaataatttcaatgtgtttgtctttccttcttgattattaagcttctgtatcagatcactataaatatacagttagtaaatgaaaatacatgagcagacattttatgttttagatgttattctatacacttattaattcatactgatatgaattagatattactcaactgtaaaaagctattcagatatgtttttagttctcataatacagtcattcctcatgtttagattttgaagttgatacccttcctcatcctttcatctctatcttatccaacctgtctttgcttaaagataactgaaaacaatttaaacaaaatacattttttaaaaaaattaaaaatgcatttataaaccctataataataaggtttaacatatgaatctaagtggttaagggaactaacttggatattatactcagacatatgacctgtgttttcaaaaatgtcacagaactactttcaaattccatgattaagatgctgatactatatatagttaaacaacccaagtcttgtctgtctaaaggtcattggaaaataattttatataaaaccaataatttatcacttacagtatactagattgaaggtcaccctctgtttgccttctctgagatgtcaggcagcttgctattttgtaagagaatctctgacaaccagtagccattatgttgccaagaaaaagttgcatcctgcagggattaattccaggaatgactcaggaacactaccaggagaataagatatgtcacaacatattgtcctcgaaaaggttaaattagcacatgtgcttcttctaatgatatttatttatatctttaaggctcaggatatttcaacagctgtgtctaatcacttttaatgtaattgcagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttacgtaagtatgatttctactaacaactgttacttaaaattttcaaatttttctagaccaaatatgagattgttaagcttccttcaatgcctaattagggttcaaagaaaaatcagtatttaccaatgtagctacttttcatgtaattaagtcattatgtttctccttctctgattcaaaattttacactaaacggttttagtttataaacttttctaatttttcaaaattatttctcaaattagagacagccttaaatttattctactgctggaaaattatttttatttatgtcctttttgtcttagccgaatactctgaaatttgttcccaaatctttttcggcaataaatccatgtcacttctacatgtttattcaaataaagttcttatgatggcatttgtcatgataatgattgggattttacatctaaaattaccagggtaagcatagagataaaagggtttcttgtttgtttgttttgcctttttttttttttttttacagaggttgctgtatactatatacctagcaagtgttacttcaagattaatttggaagaacacaaaacaaaacaaactcctcttgcagttttacataaatgattctagaacattatctggacagtatagtcattcagagagttgtctagcattatcctgttcctagttctttttcctttcccagcatgggatagaggaggactctacctgtctcatgaccttgacattatgcagagctaactgtctcagttgcttaggaccctccagggttttctcacctcattcaaagtggaaactaaatcccctacatgctcataggactttttttcttgtattcctctgatttcatcatatcttactactcaccccttcatccactctgctccagaaacacaggccttcttacttttctttgagcactcagctgtgcttttgcaagagggcttttatgttcactattcactttacctggaaatttccttttattccttcagctttttacaaaaaatttcttttttcagtattgccttctctggtcaccttatttgaatttcatcactgacatataacacttcccttccaggctttatttattctccttaacacttccctttcacttctgattttttcctaagacatactatacattttacttatcttgtttatttgaactatgtcctctactcaaatgtatactccctgaaagcagagaattttttttgttttattcactgctctgtccctggaatatagcatagtccttggcagatataaaaactatattgctatagtaattaaaacagtatggtattgatgtaggtatagaaagtaaaacaatgttatggagaacacagaaccatttatacatatgtgatatattatagaacaagtcagtagggaaagaatggacattttaattaagtctgcaaggcaattagttcacacacatacacacacccacaacaaataaatcagtgctagatttatcagagatttaaatataaaagttttaaacatttagaatctatctaaatgacctcaggtttagaaggaatttcttaagcaagattcaaatggtataacccacaaatgaaaaagtgaaaaaatatcagctatgttaaaatatgaaaatttctcattatcagagaccaatcacagacttgtacaatgtaatcaatatgtgtgaaaacaatgacaatatttagaatatatatatgtatttttttttctaaaataaaaaaggcaatacaagaaaaatggtcaaaatacctggacagctatttcctctcaggagattgaaaaaaatattacacaatatcaagtattagtgaggatatggagtaccataaacttctatagactcatgatgggtgggtaaattgacacagccacttgcaaaactagttggtattatttagtaaagttaaagacttgcagagtctattgccaagaaattttatttttaagtatatgccctactggaattttcatatatgtgcacgaggagacatgttcaagaatattgttgtcagcattctttttagcagtaaaataatagtgcctatatttacacacacacacatacatatatgccatatgcacacacacacacacatgcatacacgtgaatgtaaattaccaataaatgtatagaaatgagaaacccagaatttaggatgacacaaagtatgctaccctgggcctaagaaaagggatgctttctgggtgatgcctacaaagatttgcaacagtattggcaattatcaattgttaaagttgagtgttaggttcatggatagtcattttataatttaatgcaagttatgtattttatagacctattttaaaaatgaaacagatatatgttagtataaaataaatatatattttatagacatagaattatgatgactaactgaagacaaactattaggtgcactttggcattatttacttgagaagcttcctattaagtgatggcaaatactgggcatgcatatggctattttgcttgctcatcaggtcactaatagtacatttgcttcagagagatattaacaagttagattgagcatgagagataaaactaacttattattacagtagtggtctagactgcagttcatataacatccaaaggagctccttctaggtactgtaatatgatttttaaaaataactttataaatttaaggggtacaagtgtagttttattccatagatatattgagtagtggagaagtccaggcttttagtgtaactatcacccaaatagtatatactgttctcattaagtaatttctcatccctcactactcctcccacccttctacctgagtctctaattttggaggaagtctgttccagtgcctcaatgtttttgtcacgtaattcgcccttaaaattctgactcatggaggaggtcatcttagcaaacatcactatgttctgaatagtactagatactccaggtcttctccaggacagatagggtcaagtaggttttacaaagatgagtatatggcaggtttgcttgtttgtttgatataactgaaaaaaaaattacaatcaagaagttatcttgatatggtgttttgtttttggttctattgaaatacaaatagtaataaaatatgtatttacatttcaaatgtaataacgctatctttgtctcagttgctttacgtatatcatttctactacacataatagagctcctgggtacgtaggattagtcatgacattttaatagacaatgacacttaaactcagaagggaaaatcaaattgcaagggcacagtgttactctgccatcatttagggaagcagctacattgtcataaggcctaaggtcataccgctagaaaatggcagagtatggattgaagttcagagaaggtatacttaagaaatgatggccttatccattgggtatgcaaatccattaatgttagggactttataaagaggaatgcttttttctctttaattttgcttaaagtatgttttctcatcttaaaagtttatgtctttatgaattaaagccatttgacaagaaattctgtgtcttaagtctctaaacctgatatcaataggttgtttggtttatacatgaaaattcacggatagaaatagatggaatgacacacagagagggtactgggggattgaggagtttaggtggttaagtctccctcctttatttgaatatgcataagaggaacacttcagaagtaggttaggcaataagttagttatagaaacaattgcttcagctgaagtgcccattgatgatgttcactgggaagcatgtattaattcaaaatgtactgaatatacaaagattaataagacagtgtccctggcttttgggtttgatattatacagcattgccagaaggacttgaatgtcaactagcccaaagttttacaatatccaagagatagtgaaaatttaaacacagtaaaccaatgttttttgtgctattattatacttgtgttactttactctggtttccgatttcattttaatatttatttatttattattatactttaagttctggggtacaggtgaagaacgtgcagttttgttacataggtatacacatgccatggtggtttgctgcactcatcaacctgtcacctacgttaggtatttttcctaatgctgtgcctcccctagaccctcaccccctgacaggccccagtgtgtgatgttcccctccctgtgtccctgtgttctcattgttctactcccacttatgagtgagaatatgctgtgtttggttttctgttcttgtgttagtttgctgagaatggtggtttccaacttcatccatgtccctgcaaaggacaataactcatccttttttatggctgcatagtattccatggtgtatatatgccacattttcttaatccagtctatcattgatagacatttgggttggttccaagtctttactgttgtgaatagtgctattcacatccgtctgcctgtgtctttatagtagaatgatttataatcctttgggtatatacccagtaatgggattgctgggtcaaatgatatttctttttttcttttttttttgggagatagattctcgctctgtagcccaggctggagtgcagtggcacgatctcggctcactgcaagctccgcctcccgggttctcgccattctcctgcctcggccttctgagtagctgggactacaggcacccgccaccacacccagctaagtttttgtatttttagtagagatggggtttcaccgtgtcagccaggatggtctcgatctcctgacgttgtgatccgcccgccttggcctcccaaagtgctgggattacaggcgtgagccactgtgccaggccatcaaatggtatttctagttctagatgcttgaggaatcgccacactgtcttccacagtggttgaactaatttacattcccaccaacagtgtaaaagcgttcctatttctccacatcctctccggcatctattgtttcctgactttttaatgatcaccattctaactggcatgagatggtatctcattgtggttttgagttgcatttctctaatgaccagtgatgatgagcttttctccgtgtgtttgttggctgcataaatgtcttctttggaaaagtatatgttcatatcctttgtccactttttgatggggttggttttttcttgtaaatttgtttaagttatttgtagattctggatattagccctttgtcatatgaatagattgcaaaaattttctcccattctctaggttgtctgttcactctgatgatagtttattttactgtgcagaagcttttcagtttaattagatcccatttgtcaaatttggcttttgttgccattgcttttggtgttttagacatgaagtctttgccgatgcctatgtcctgattggtattgtctaggttttcttgtaggatttttatgttttaggtcttacatttaaatctttaatgtatctcaagttaatttttgtataaggtataaggaaggggtacagtttcagttttctgcgtatggctcaccagttttcccaacaccgtttattaaatagcgaatcctttccctattgcttgtttttgtcaggtttgtcaaagattggatggttgtagatgtgtggtgttatttctgaggcctctgttctgttccattggtctatatatctgttttggtagcagtaacatgctgttttggttactgtagccttgtagtatagtttgaagtcaggtagcgtgatgcctccagttttgttcttcttgcttaggattatcttggctatgcaggctcttttctaatttcatttgaagtttaaagtagtttttccaattctgtgaagaaagtcagtggtagcttgatggggatagcattgaatctgtaaattactttgggaagtatggccatttttacaatattaattcttcctatccatgagcatgaaatgtttttccatttatttgtgtcctctctgatttccttgagcagtggtttgtagttcttcttgaagaggtccttcacatcccttgtaagttctattcctaggtattatgttgtctttgtagcaattgtgaatgggagttcactcattatttgactctctgtttgtctatcattggtgtataggaatccttgtgattcttacacattgattttgtatcctgagactttgctgaagttgcttatcagcttaaggagattttgggctgagatggtggggttttctaaatatacaatcacatcatctgcaaacagagacaatttgacttcctgtcttcctatttgaatacccttatttatttatcttgcctgatcactctggacagaacttccaatacttgtttttatatttagccagcatttggttgaatgggagtggtgagagagagcatccttgtcttgtgccagttttcaaagggaatgcttccagtttttgcccattcagtatgatattggctgtgggtttgttataaatagctgttaatgattacttttcattttaattattttttaaaagttttaaatgctactaaaaggaggtttaaaaatccaagtttatcgtgtagtcttgaatttcagggaaggttttatttggacattaaggccaagattatggtagtctataattaaggtatacatgcgttccagatggctcgggcatgccaagtttattcccattgttgtggtcgatctcttgtacatttaggatcccctttcactctcaaaagtttctcagtttggatgatgcattttatggacacccaacctataatcctcctaaggcaacatttatacttaaaaccattttgttgttgctgtttgtttgcttcagagggaagtaagctttcaggtgcttaatctgaacatttgaaaatcgagtacatttgaaaatcgttaaatttataaattatatgttatgtattttctttgccacaataaaaacattgaaagcatttgataaaggtgcatttgcctgtgttgtctgatatatttgaaatcatttgctttcattccccattacacttcttcatgctcactctgctccagccacacaggcctcctaatcttcctctagaaagctagccatgccccagcagaaggctttggcagtgctgtttactctacctagaatgcccttccttaggacttcatcatggctaagtattttgtttccctgaatcttttctcagtgagagacacctttgccaccttatttaagatcttctcccacctcctaacacacaccaccacacatacatacaggcttgatctcttttgtctgaatgattttttttttcccacgggacttaccactttttcacatactaccttttcttaaacttgctaattatgtttattgtttgttcacttccctcacaaatgcataaaccctataaaagcagatttcctacagtatttgtttactgacatgttcaagtgccccaaaccacctagaataatgtttttctttagtaattaataaatgtaagttgaatggaataatctaatcaaaatttttagaaagcctgtcacgttgatctttccagtgcttgttgtagaacattgacattccatagttttgcgtagatttagattctgatggccttcttttcttttaaaaaatgctttaaaaataccgacagtattttggagaggaaggcaataagtttctgggatatgtgcttcgagtattcaaagtatacagggtacaataaaacaaataaccagagctttttatatacatgtaaaagggcactgcaatctgtagcgtgcagcctggaacattatgggttgcttctttttgacagggacacctatgagtcacctactttttcaaggctatactccaccttggcagccaacaagtccaaatatgtggtttgattttggtcaatacaaaacgacaaaagtacaaaaattctttctttattaaggtagcttactaagtggaaaacatcgaaatcgagctaatttttaaatattatactgagttttcaattcagtatttatctgcacataagctaaaaaataaattttttcattgggatagctttatcatgaataatatatctctttagtacaatattcaaattgattgtcaccatttttccaaactgtgtactctgctgtatactaaatctttgatataagcgtctttcttttcatttccagcaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcataggtaatattaattaaaggctgattatgcacagtaactgtgtaattaataggggtgacatttaatggttttctttatcctataacctatagttggcttaatataaaaacaagtgtaaaatatagaagcaattagaaggcactggaaatgaatattggtagaaaatacaacattaattttagcactttaaacttccagaagaaacacttgaaagaattttgttgtatatcagtaaaatgaaaaataaaaatactttcaggtagtgacattattaagtactaacattttacttagatttttatagttaataaagaatcttcatatgaaattagatttgctccaaaaatatctaaaagttatattgatttcaaaatgattgtaactatatttctgtaatcctaaaattaatgccatatttggtaaactaaccaaataatctgtcattcaaataaaccgacacatctacctaccattattatgcctgaatatcctatgggtgtcagtaaaatccaaattatcaagtcctgtttctgggaaaaaactgttatttcttcaaagaaatattaccctaccccaaatcatagtttagcaaggtctttggacaaatgttatatgcatgtacactgctttcatatcctttatctttccttaattttacatccacagagctagttgaatgtcaagtgcttttatatcggaagggttcaaagttcaagaatttcataattcatatcaaatggagtctacctgactttcttgcttcaagattaacaggcttctgtccatggagagatgttattacatttacattatttattatttcctagatcctttgtaccaaaccccagattatttaaaattgttttctgtgagagaactatatctattgtaaattttaaaggactaatatctttttaatcttcattttagagcctacccaaacctcttgtgaaaacccaggtgtgcctcggcatggatctcagaacaatacattcggatttcaagtgggtactttagctatgtccatttagcatcatactaggtcagaatgcgtctttggttcatatgcatataatcttgttgacataacaaaaagtcatgttctatctgcatttataaacacataaaaagggtaacagacagcaaaagagtggaagtaaaggaaattagaaaaaaaaatttttttaataaaatttcctaactggaacataaaaataaattaaaacaaaaagcaaaaaatagcagtgagcataggaaaaatccataagcattagagagttatatataagacagtaagagtgagggagtaaatgagtaaactctacaggaagatatggggacagtgaagaaaagtaaagataaaagagtttaaaggagagacttctgagacaaacagcaaatatataaaaatgcgggttattcaataaagcactaattgtatatatgaccttgctgtcagtgtttaaaatggtgggaaattgctgaaaaataaccagaacctgttgctatacaacacatagttgaattgttacattagaattctttggcatgcccagtcatgtgtggctgactttcttgttctctctttttccaatttagattttaggtagagattcagcaacttttcagttacaaaagatccaaggggagccaaagtgcatactgattccaaacagaagtagccaatttacacattacccaattgccctgtgttgccgggttttgtaaattgtgctattctgtgtgaaattcagcgtgaacctgaagaccatccatttctaaaggaagggctcatctaaagggccatattttgttattaaaaatagtttccatttatctacagttcaggcacagtatgaacattgatttgatagcatttccaattcttctgatttccttcagtcctgttccagataatacaaaagtgtaaaaatgagtctgtctccattatattggtgtttttagagaactttagattaatatctccataaaaggttttatcaattgatctaaatcctgaaaaatgggcaactagctgcacagcactagtcctcatcatatgtacaaagaaactgaaacagaatgtgacttgctttgttcgcagatcaagttggtgacatattctaacagaatacaaaattgtgatgttagtgtcggtgtactaaatcaggctgattttctaaagaatatgagtttttttagtaaatattatttgagatattggaaatgagaatgattaacgtggagtttaaaacagtcatccaacaaaatgaagagaatcactaactctgctttctaaggattctattataatcattgaaaaatgctgtaacaaagttaacctaaccctgaatttatgttatttggggtaataaacaggtattaaatcattatattctatatgaataaatataaatagactagattccaaatatggtaaagtctacttatatacaattatataactatctattaaaattaaatgtattttgtgtcttacattagggagattggctttcttacatgcatatggcaggtatgaatgtgtatatatatatatatatatatatatatatacacacacacatactaaatctgttaactaaatctgtatagatctaacacaataaatagttatataattctaattaatactaatttattgatgaattccaaatgaatatggttttatatgcaaaaggcatcttgagccattgagaaaaacgattgcttgcaagtaacaaaaaaactgtttggagctacttaaagcctaaaggcattactgtgcaggtatgtccagactcccaaagaaagaatccatgtgagactcatcaaacccagagtgtaggtactggcttcaagtactcagttttttatactactttctgtttatctacttcatattttctctccgcagattggccatatggccaagagtgaatcatttctatttacatctcagctacatacagaaagtgatcatctcaatctcaattccagatttccaaggagaatcagaatgtcccaactttcgtatttatgttggtttcattaggtggccggtagtgagttatgacgcaaaatcacagctgttaggaagcccatttttgggaagagcaagagaaagttatgaactacagaggcactcagatcattttcttaattttctctttaatgtgttcatttgttcactctctttttctttatagatttatatagtagattttgggacatcaataattattaacatacaaaatatattactcattgctagagatgatgaaaactctatcattgaaaaaagtattcaacataatttgtctttgtattaaaatattgtaaattggaataattttactaaaaattgatagtgaagagaatagctgtcaaaataattgatgcaacatcaggattaaccatggagtaaatgacaagcacacatacacactgctgtatcacttgttaaactgagctctgggcaatggaaagtacattatttggatttagggcttgttacataaagttattataaatatgaaaagtttttaatccggctctttagatatttagcctcaagatatttaaccataaaatatttaaccctaccaaactaaccatagtgattatatatgattttcagtttgtaattgaaattagtatcttagtatattgaatgaggtaaatatatgtttcatagtgttttattaccttaaatgataaatacagtggcatgaattctgaaagtaaaaaaaaattactttcaattaaaatcttcttgttttgaatataaataataataattaaacttttcttgaaccaggaagcctaggaccaaagttaatgctcagtcagcataaattacttgcatctgaagcacatctgttataccttcattttttatgatcttgcctttctgtgtcaattttatttattttaatttacatatatcttttattagaagctacctcaatttttcttgagtaaaatgttttgtataaatacataatgaaaaacgtaaatttatttttaaaaatatatattgcaaaagaagcatatacgtttttgagaccttaataataaataaattttgaaagttcttaagacccatgctggatactccagttaaacaaacatgtgatattagaagtcagattcaaataaatgcattgatgaaaattctagcatgccaagtgttatttgccatgaaatctcatggaagggaaaatagagcttactgagaatgttcaaaatgtatacaaaatgtctattatattatttgctatataaattttatgatttaggaactaagatataacatttaaaataggagaataaggtgttaaagaacataagtgatgtttactgattaaacatgtcttaaaattctataatgcatttatacacaacatggtactttaaatcaatttaaagtgatttttatttaaacattggttgcaattaaaatttgatatggattgtttttaattcttgttataaaaactttcaatattaattattgcaatgtttgatatacaaataatactttttattcgtaaatattggtgaaaaaattgtacataagttatttttccaagaattttttgaatttgataatataaatttttagaatgttgttgcctatttttctacaaataagcaaattatactatgcatgttggaagttgttcagtcagaaggatatatcaaattgggaaaggataaagaactatttaaaatacactattaagtgggttcatcactgacaaaattatttattaatgcactgatatttagagaaaattttgttgatttgactataacaagttctggataaacaatttaaccaattattaaatctataaatatttattagatattaggtataagtatttgtgaatttgacaaaaatcttattagatgtgttggtgatacacagaaaaatattaaaacagattttattttaattctataatatttggttaatatttaaagcagttgttataatgattttgaaaagcttacaggattgaagaaaaatgtcttacaagtaaaaacaaagtgtatgtagtccaacatatttcttatacctgaccaatataaaggtttgatgaaataacccaaatatacccttcaaagaaaaaaacagaatgatctaaccttacattatctaaagtatagagatgatatcactgcattttaagaactgatagacgttaaatattctaaagttaagtaatcaagtaattttatattattttgtccccattccttccattgctccaacattttcaaatcacatttttaagctcaaggtgcacaaggatgagtacacacagtctccggcctagaaaggctaacatttctaacagagatggtttttctaatttcttgctgcagggaagggtttctacagatgatggctgagctaattcttttagtgtaagagctaggaaaggaaagttgggagaggcattccatgcagtaggaatagcatgaaaatatgcatgcatttcaggatacaaaagttcaatgttaattgaacagaatttgagtaaagtaagctgttaatgatgatgctagatagattctcagttatggaggcctttgtcatgttagctcaatgtaactttatcctaatgggtgaataataaggtcaaactttcgtgttgcatagatcactctgactttaaggcagaaaataaatatagtggatcatgaagtgagaaatggagacaaattagaagattattataattgtctattgtgtagttctcaaagtgtagcgcctaaccggcagcagcagtttcacctgggaacttgttggaaatatagattcatggacctaccccagatccactgagtacgaaactctggaggggggtactcagctatcactgttttcataaagtccttttggtgattgtgatgtctgctaaagtgagaaccaaagcctatggaaaagatattggggagtaaaactggatgtaaactggagaaaaaaggaagacgatactttgaaaaggatttagaaggtaaaattgccagttttggtggtgaagtgaatgaagggaaaatttattagtgacaagtgacactattaactgggttctaaccttaagaaggattgctggattgatagagatgatggattttgtagaactggtttgactgaagaatagaactgcaaactgtatataacataatctagcccatactgaaaaatcaaaacctgtaccaccattttgcacaacttcagaaagaatgtgaaaggcgtgctctggagcacaagtcaggggactctggttttaaggaataaaatgcaaatggtgcttcttggaatcaatccatgtaacagcctagagaaaatggggcatccagggataagagatcttctagaggcaaaggtgagggttcatggaagacacagcatgagataacataaagaaaaaaggttgttgtcagataaagaattttggaatttagtatttctggcctagtatagttctgggtaataataacaatatgaaaaatggtggaattcagagtctgaagtttcaaatggaatcttggtatcaaattatatcatcttaagcttagcttcttattgtccgctcaagagggggtaggaattaaggggaaggcagaaaaaaggatctgagtgataagtcctaaaactgtgattgagccttctcagactgcaattgctggagaagtacaaagtggcagaccctaaatatcccttatctcatcctccacctctaatcatccaataaatcttgttgatttttttcttgtgattgttttgaggaaatgacttttttccccaggcttactgccacaagttagtacagtttttatccactcaaatgtaaaatggcagtgccagcctcataattagaattactactattcttctaaataccatatcctgccatttgagacccttcggaaactaattcttacttatgtctccaatttagtcatcatgcctataatttatttaaaacttgagtgtcatcctggggtggagtggagtataaattctatttcatttaatccttaaaacagatttcaatacaaataatattatcatcattatttataaatgataaattaggtctcaaagaggagataggagatatgacttattcaagtaaagtgagatccagaattaaaactacatgtacattactctggtgatttgttttcttgtttactatatacccctgcttcccacttatcccaaacctctacctaccctgctcactttgtaaacaataaatgccaatcaatctaatatactgttttcccctaaagcaaatgatatatattgtaaccaacatacatttctcatcatgttattatcttttccatttttctgtaagtcttttgcaaactttagtgtttattaccaccacccaaagggcttgttaaaacagattattggtttttctaacctaacagtttctgattcagtgtgtctggggtaaggcctcagaactgacatttttaacaaattcctaggagacattgatattactggcctagagactacactttgaaagccattgtcctagatattctcctaattactatacccttaaaagctagtacaaacagtatatcttccattgtatatttccgttatcaccaccaccttcagtaaccacctttgtctctaatctcatattgcatttttcaccttcaatatttatttgtttcttatgtggttagctatatttatttccatatatatttttatcaagcttcatttatttatctttatctaactatctatctctctatcttgtattcatatgtagcttgttggattttttggtgtcttaaatattttcttcaaattcccatggcaaaaaagcttggtttctatgtatgtactaaggacccaactatttgatgatgatatgtaaacaaataaagccaggattttattttttagttttgaatttttcccattttattttaaatcagatttcaattatttttttcttccaactttaccatacggaatttcacttgataacattttctcactcaagctctgtttgttgccatatttgaagttgtaggggaatatttttttcctctctttaatttgctataggtaggaagtgttgtacagttccattgcaaaaaaggacaccttctccaagggtctacaacacgcacctgcctccctgatcttacgtggagtgggattcagcctgaatgcatacgtaagtattatggataagaaataatgctatcatgggtaagaatttatatgcattttttctcccaagtattcaaatacatttacatctatatgtgtatcaaattgacttttagattataaaacatattatatgcatataattttattactgtatcataaacccatggccattgggaagcactctctaagtaagtcagaaagcacaaggcacaattttgttctttttgtaaagaccttatgtttagttttgccacctggtaattttaggtaatgattaggttttagtttatagatctgcatctatcagtctgaagtaatctaaaatacccgaggaaccaatctaacagcttctaatttttaaaaatcgcttgtgaaaatattatctgagaatctggggaaactaacaacatctatgaaaggaaatattcatgggcacttggccaaaaatttgagaacaattttagaatttcctttatatgttctctgatcctcagtggagagcacttgctatacagattaaataagaacaaagcctggggccactaaataactttttctgacatacaattagaaatgaattctagctggtcagctatttggcttttctttctctccagttgccttttaaaaaaatctcttcccttatcttttcaattgtgtttcttggtgaaaaatggaaaaaagtaagctggagtggaaacacttattaggatggtatctagcttttaggatttgctgaagcatacacaagccctgtgaatttactctatccctgttcagaaccatccaaatgattgtgggggcacctagggaccagcagcttactttaaagcaggagaacactccacagagatgccatgttatgtgccttgttggcttatatttaaatatggaaaattccttaaaggagaattcctcagaatgtgtactttaaaacagctgtgcgggctgtaactaggtatttcacagtaaaccattgttctttgatgtcctctagttgggatatgatagtttaaataaagttaaacagcgtctgtcactgtgaagcatctcaaagtttctaatgtgtccataacatagggcttaagatggcagtagagacagactgtagttttccttatcaatacttactgcatgaggattacatttcactaactgcaatatattaaatataaaccatttaggccaggcacggtggctcacgcctataatcctagcactttgggaggccgaggtgggcagatcacttgaggtcaggagttcgagaccagcctggtcaccatggcgaaacccatctctattaaaaatataaaaaattagctgggtgtggtggcaggtgcctgtagtcccagctcctcaggagtctgaggcaggagaatcgcttgaaccccggaggtggaggctgcagtgaactgagattatgacactgtgctccagcctgggcagcggagtgaaactcttatctcaaaaacaacaaaatcaaaaacaaaaaaccatttaacacaatgtttagcacacggagtaaaaaaatgttagctattatttatactgttatggacctccattaagaaacaaatgaaaaatattgtttttttttatttatccacagaacacttttttcagagatcacttttatggatgtatatctatgaacaaataattaaaaaatgctatctgtttcaggggaaaaatttcttgtagcatttatctctgacggagaaaggaatggtctttataagacataaaaccgatgaaataaggggaagatatggtgtaatcaaggtagagaattaggagtggaaggaaacatggagaaaaggagagagagttaggtgaacaaaatgatacttctagcatatggatccaaatatggcctgaaaattccatatgtaaaaaaattattaaaatgtacttttattgggaagtattaataccagagcaatataattagctgtggttttatttaacaatagaaaatagatttttaatttaaaataaatataatacatttaaaatttataaaataatattttctaaactcatatagaaaacctgagcttgacaaacattaaaaggtatcttaccacagaacttcacagatcctttaaaatgctggtttttgtgactctctggaatgtgtgactctctaaaatggtaaagcatacatttctgagcttagttgttgacaatgtctttttttttctcaatttatttaacatctattaacatctactagtgttccacaaatggtggattaggaaatgctaaagtatgaaatcaataagtatatttgcattgaaacatttttgtgatttattagaataattattctaagatatatgtatataaaggcattgaagtatatctgaaatatattgtgactcctgtctcaaatttttcttaacatatctatagaaaatttacattgttctcttttcttaatatagcccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaaggtaagttttctctatagaatctttttaacacaagagattgcactattgctttcctttgctccagacaaaaactcaactcaaattagcataggaacaagggaaatttgttggctaactccaagtctaggagtaatgtaaacacttctggatccagaggcatataaattttatgagtctattcatagcttttttcccatgagaatgttacttcttgccttaattctatcttcaaattctctcttcaggtaggtatattatttttctagggcttttataacaaagtaccataggctgggcggcttaacataataggaatttattccttcacaattctgaagtccagaagtccaaaattaaggtgtcagcaggaccttgtgccctctgtaagctctaagcagaaaccattctttgcctcttcctatcttctcatagcttctgacaaccctgggtattcattggctcctagccttactccaatttctaccccatttcaatatggccttcttttctgtgtatctttgtgtggcctctcctcttcttatgaggataccagtccttgtatttggggttcagcctaaaatcaggattgttttatcccaagatctctagttaattacatttgcaaagaccttctttccaaataaggtcatagaggtaccaggtgaacataaattatgtgggtacactattcattagagtacggagaattgctaccctaatgcctagattactctgccagagtaaccctagtagaaagagtccttcccaaagttttggtcaggaaagcactatctgggattctatttgccacaattttgaatggatcccatctccaaatccattactcagccagggtgatatggtattaatatttggaccagatctgggtgaagtgtccaccgattgctgctcggtcaggacaatttccatttggaaaagggttataatgccagaagaaggagtaaaggaactttttctagtgtttttggtaaggtcatcaacaaaatccatttccttatatccaaaaaacctatttgtaagacctaatgttttatctaatgcagctgtcataaatgacaattactttcttttacttgaaatgttttcattttctttatcagaacattcctctgctatttttctttctattttttttttatgattgaaatcgctgtagtatgagaagatcttattctttggtttgtttgcttgtaattatctgcttccactctcctgtcctcctatctacccctcttcaactagaatataatctcatgagagacttcactcaaagtgtttacaactgtaattttaacacaaatcagtaccttacatgtgaaaagcattcaataaatatttgttgaatgagtaaatgttttactccctcctaattctaagtatccattctccatttcctttatacactgattgttttctacttatgattttctaaagatgcagtacttagccatctcttgttttcatctcgtattcacttttaggtgatgtcattcaaaccagtggcttcaacagctgtccttatgtagattacttacaaactaatatttctggcttatttatcttattttagcttcacacttacatattcaattgtttgcttgatatctctagtgaaattcttcagtggcatttcagtactcaatacatgcaaaactaaactcatacatttcttttatctatatagtttccctttggtattccctatctcagtgatattaccatcctatagttacacatgagatctagtaatctccttagatattttcctatccctccaagtcaccacaatttcaatagctttttcgtctgttcccctttttggtttattgtcactgctatcatactctaactcagtattatctctactgggactactgcagtgtctctcaacttctctagccatatccgtacttgctgctttccaaagttttcttggttttgcagccagagcaacatttgccgaaatcacatccctttacagtcttttaagacattacattgttcttaggatacatagtttacaaggcattcatgtcatagctcctataatattccagtcacttctacatcctacatgatttatttggttttggactacctttggttttggtttaaaacctggaagatttcacctttaagtctatccaatttctggtgacatctttaattatctcaacaaactttgatttttaaatgtaaaccctacccaaatagtttttgctttctgtcaacaaaaacaactctcagctctcagcttccatgttggaggcaactgtctccactttggcttatgcctctaaaataagaaatgacatcccaagatgataaagcaacacaaatctgccccttgtgccaatagactgtaatgggaataattattgaaatcattagttgcataacgagtgctgagtaggggactgagatgttgtgatgaacggaacattttagagaaaactatctatgtgaaatgtcagagaataaaatggacagtgcatcacactgtgtgtgtgtgtgcgtgtgtgtgtgtgcgcatgtgtatgtaattaattgcatcaacttttgtaaacacctttatttcttttcatagctggttctaaaatattggtgaaagatcctagacctgcactgggaacacccagcccaaagctaagtggttagtaatgtcatttgtttttctagagttcattatttctaaaaatggtctactattttcttggcatagtaactgtgtatttaaaaaatatatttaagtataaaaaactatgactgtcttgaatttgataattcacaagatgttgaatttaaagcaatgtaatacagtgacatgttagtattccaaaagtattgttcatagttccgtctgctaaaaatattaaaatttcccttgaagagtatctgtaaatgactatagcataatggcaatactgtcatttaaaatattaaaataaaaatgaggtcttatttaacatttttaaatgtatatgtttttaaaaggatccaaatacacttggtatgagaataaagatcggtaacttctagaaattgactagtttattttcagttatttgatttaaaaagcaaattagaaaacctagcacaatcaataaaaacataaactttaaagccctacaaccttgatgtatctcattttatatactctctgacttgtgaccttggaaaaattattttatatatctgaatctccatatctttttctatccaaaagaaataataattaaataattatataataagcttcatgcaaatgaagtgcagagtgcgtagcccatagtaagggctcaatatatgaattgctttgtattagttcgttttcacactcctgataaagatatacccaagactaggcaatttaaaaagaaagaggtttaagtggacttacagttccacatggctggggaagcctcactatcatggaggaagacaagtaggagcaagtcctgtcttacatggatgcgagcgggcaaagagataatgaggaagatgcaaaagcagaagcccctgataaaaccaccagatcttgtgagacttatttactaccaagagaacagtatccatgattcaattatctcccaccagattcctcctacaacatgtgggaattatgggagtacaattcaagttgagatttgggtggggacacagagccaaaccatatcatgcttattcagtattagtattttgtttatgtgatactatttaaaagctgccaataagagcataatatctgatcttcaccttggaaacagatttctctcagttgtattgggccaagaactacattaggatctaattttagtgaggtttagaagtgctccatgtacatgctataaaagtggagggaccaccaagctctgtgacttatactgatacattcaacacttgtcgaaaacatgctgaatgccattgaggcaatcaaagaatacataaaagtaaggcagagtttgtttgcaatggagtcagaaaaccataattgtccatcaatgccccaaattttccaagggaaatgcttgatttgggaccaggtggaaactctgaataatagctccagcacatcaaatctgtaaaaaaattgctcatatattaaataataaattaaattaaacaaattttaaaacgcaaagttagtcttcatagctcatatctgactaggatgtgattaaagttcaatgaggaaatatgtaatttaaaacattcctgtatgtttggaaattcagagcaaaattagtaataataaataactcatgaattaaagaagacatcaacacagaaatatattagaatgtagttattttgaaaaattgaaatatcaaagcttgagggctataagaaaaggaaagttaagagggaaatttgtagccttaaatccttacattattgaaaagaaaagcctcagaattaattagttgtgtccctattaagagaatattaagactgtaacagagtagcagggcagaaatcaatgtaataataaaaacaggcaaccgcccaaaacagtagaagaatctcaacagaaccaaatgtcgttcttttcagaaacaaagtagaaaaatttctggtaaaaataagataacaaagaaaatgtgagcataactacatagagagtagattaatgaaattcaaaatatgttaagggaaaactatcaataattatcaacatttaaaaacatttacacagagcagacaaattactagaacactacatcttactagaactaataaaagaaaatgtgaataattttatagcaaataaagaactggttaaaattatttccacaaagaaaatgaggtctatgtggccctactggtaagttccaccacattttaaaggaacagaatggatctttcaagttttataaaaactcttctggacaataaaattcattctctaggctcaacatagctctaataactcggataaagatattataaagggagaaaaatttcaggcccatttgactcaggattataaatgagaaaatcttacataaaatcttagcaaatcaaattcaacattgtagtaaagataacccatgcgaaaaggaaaagtttagctgaattaaatttaaaggagtttaattgaacaatgaacaatttgtgaatcaagcagaccccagaatcacagcagattcagagagactccagggatgcctcatggtcagaacaaatttatacacaaagaaagggaagtgacgtacagaaatcagaagggagagacagaaacaactagattggttacagttctgtgtttgccttatttgaacacattttgaacactcagcagtgtacgagtagtagaagtacagctgctgggattggccaaggctcagctattgttacaggtgcatactcctgaattaggttttcaatcttgtctacctattaagttagattgaagttcattacaaggactcaaatatagaactatggagtccttctcaggccatatttagtttgctttaacacccatcagaaccaatctggattcttcatagctatgcagggatgttttagttttaaataatccttaaaagtaatgtatcacattaagagattaaagtgcaaaaaattatgataattgcaatatttgcaaagaaagtatttgatcaaattcaacacttataatttttaaattataaatttaaaaatttataatttttaaaaattcttaacaaactctaaattttagtaaaattatttataaaaattatatggcaaatagcatgttatatgagaaaacattcagcagtatttcatttaaaatcatgaatgagacacagtgattacattactccaaagtgataagaatggaagttggcagtggtatcaaagtaaggagctatattgcttataaattatcatggaaatagaaattttagttgttactgaaatattcagtaaaaactcaactcttagggtatttttatgctgatctgccacagtggttttgctttcttggtttaatagaattcagggaatacacagcttgtcatggcaatccctgtgatctgactggtaagaagtgtgatacatgcatatatcagatgaaaaatcatcaataacttgttagacaaattaaaaaaaaggactttttcctaaatccacttcattcagtcattcatccaaagagggttgggtaccttgaatagctgatttctagggatgtgctgtgctgtgaggtataggattaatcctatacctcagcttctctcagctgctgcccaggagctgtgtagactttgacataaccaatttatataactttaaattacataaataatttatataaatacaataagtctttttggctagtatctaaaatagtgttttttctttagatgaaaattttataagctttagaatgttctttgattctaccacaattcatctctcatccttgagagtccaacaatactagtgacaatttctaaaaatacctgtatacctcaaagctatcaatatggtgcagccctgttcttcttcaggagcacctgttattagaagaactaaactcagtattctgtaagggggaacacagaagcactgtctcatgataattttgcaggacctttctctttgctattcctcttaaaaatctattcccactgctggaaaaaaagcaggcctcttgggacttgggtatagttttactgccatggtgctgtgaaatcattttattttccttcagaaagaaatatattgcataaaagaccaaagataagtgaagtttatatttacctgggttctaaaaataaacctaatatctttaactggtgttttctatttctctcttctcgataacatatgaacaaatctagattattacaatgtggatttattctaaaaaatggaaacatttttatatgaagaattaattttgtaacacacattcaacattattgtgtattagcaatacatcattattcaataaactaatactctatttaatgcttatatttatatggcattgtaaaattaatgtgtggtatatttaatctattcacagttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggtatcgcaataaaaacagcagcgaaatataccttcatgactttatttctattatgatttcatcatttttagtaatgctttttatatggtgaaatgtttattttgatacatttgcttttgatgacattcatattcactcagaaccaaggttttctggtttttggattgatgaatgaatattactacagaaatataaaactagttttaaaataagttatttaaataatttttggtagctagaattagatgtcatatattagatcataacatttaatttaggtatgaatacaactaaatctttctctattctcataaaaccacggagaccaaatcattgatttctcaactattctgtggccacaaagctatttcttcaaatgaccatgtttatagatggacatccaatatttaagacaaataaagatagagctacacttgtttaaataggcataagggaaccaaaacctggtcaatcttcttaagtttctgttttctgtgtccagtacacacatctctcattatctttgattgcactggttttcctaacactcagatattctctcacaagtcacctcctcaagcaatactcccaatgacctgacctaaaggaaactttgtattacaaatgctgtcagacatattcttagttttaggcagccttaccctgtttttttctttacaatatttgaaattatatttgttatatttattattcattatgtgtctatattctaacaatataaaataaattctaagaaagctctttgccttccaacttaatattgtattcccagaggctagcagaacatctgaaacaaaataggcctcaataaatattttcaaattaatgcatttgaattataattgctctcattttttaaaatgagacactatgatatttgatattgcaaatatgaaatataaactgtaaaattcttgtctgtatagatataacccatataaatattaataatgaaataatttgtgctgtaaaaaattgaaaataaaattatattcattgattttataaattttagaatgaattttgagtgtcattcttattattgaatgatcctccgttaaacacaaagtaaaaatattagaagttaatatgtagtataattttaaaaatacatataattaccttatattaatcgaaagaaactttaaatgaatgagacaaatacatttaaattgtgactaatgctttatttaactttgatgtgttaacaaagtttttctttattttctataaaagagcccaaaataaatgtatacttattctaatctagataaactcaagagttttctatatatatggaaagacaaagaattagattaattcgctttcacttactgtctccatataaaccaattgtagcaatttttcagcaatattatcgattacttttatatcttcctcctattgattataatttaccttagcacctatgtctcattatcttttcatttcctgcatattatggtgccctattacataggtgaacaattaagttagaatgaatgaatacagtcaagttttaaacaacagttaatcagattttttcttagatcctattttctgttatttccctaaacaattttttccctccagcttacagctacccttagaacacttaccatgtaaaaatcattgtatatatttttgcttctcttccttatgtcattgcttgtatttaccttcccaaactaaaaattctactttatttttaagaaccagttcaaatgctgttttttgttgttgttgttgttgttttgtttttgttttttgttttttgttttttttgaggcagagtcttgctctgtcacccagtctggagtgcagtggtgccatctcggctcactgcaacctccggctcctgggctcaagccatcctcccacctcagcctcctgagcagctgggactacaggtgcgtgccaccatggctggctaattttttaaagtattttttgtaaagatggggttttgccatgttgcttaggctggtctggaactcctaaactcatacttttggattcagaccatctgtccgccttggcttcccaaagtgctgggattacaggtatgagccaccatgcttggccctccagtgcttttccttgataactattccttgatcattctagtgtgaaatgatctctctctggcttttaatttatcacattctctcatgtgtttgatttagctgtgtaccttacttatacctcctactttgttggaaattattaaaaacaggaacaatatatattcatctttgtggctcaagcagcacctagaatactgtttttcactgagttggcaactaatttgttattaaggaaaatatcaggaattttaacactggatttgtatgcttgaaaattttagaatctgattgtgggaagaaatcattttgttttcaatatcatggaatgatgttattaagaacactagtgcttaattgtgatagcataggtaatttaaaccccacaactaagaaataagttgaggatttcagaagacagataaatcaatgtatattacaggatttgcaaagagcattataggttaagccatccttgacttgcccttgttttatttctttttttaattacatatcttacataatctatttaaggaatgatagataataaaatgaagtataactatttacaaagttaagtagactaaaatgtccttgcattttacaggggtatataaaagccaggaagctcgcctaatgttacgcatatatcttattaaagtacctgctcatgcttctgtgaagaaaatgaaggaagaaaattgggcaatggatggctttgtaagtatagttattttaacatctgctgctgattttaatgataaatttgtagcttgtccaggaaaggagagttttctaaatttagctaattatgaatacatacacatacatatatattagtaaatataaatatttagtattctaaagtacaagcctaggaatactggattctgatgtgttttgcttacttttgtcgtgtgtgtgtgtgtgtggtggtggggtgtacgtgtgtgtgggggagggtatgggtggatgtgggtgtgtgtatgtgtgtgtgtgtgtgctgatctgcatttagtttttcactgatttcatcaaatatattccatctacaatcagcactatgataaataaatctggataaaatataattcaatctttggaaccactactacttaaggaatatgcaacatatttacaaagtacatcagaaaattaaatactcccattatattgaagcatgaatttagactattttatatataaagtccatgaaaaggaacttatgtgagctgcttcctatggggagatagttactgtagcttcaccatggagtcactcctattaagtgatttatgtgagtggagtgttaagactgacagtggaaaacacaagggccaggagtctttgctgaagagtcagcatgagagatctgactgtatcctctcaagtaccaagcctttttttcataaggaaaacttaatgggaaagaagatactgtagtggatcataggctgctatgtagtagccttcgataagtttcaataagccttcaataagttcaagaagcctaccatctagtaggcttcaataagtttggttcctgaggaaaaaaagtgtttatcctatttctgcattctgtattcatggagttgggaactgagtcaaatcttcaatgcactcagattgtttaattgtattattttatgtaggaaacaaagtgaattgattcattaaaatgatggagtttgagcttcttcttagaagtactttattttttagggtggccatacccagagtataatgtctgataataaagaataaatcagttgttgtgaaatgtcagacttgcatgggtggtttggtatcctttgctttttagagtgaggactcaagattcttacaacttttatgataatgttcatgacttaggtaactaattgccattaattaacacaaacttcaggatatatcactttactacttagtagtaggaattgctgaaatgtaacatttcctattttacttataagatcaaattacattatgcatataaagtattttttaaatataatattgtatacaaatgtaaggtgcatgtagtatttagcattggcaacattagacatagccatgaagcctctgggtcaaacaataataagtatttagttatttctcatttgtaatgggttagctgtggaggcactacttgaggctgtggtattaagtccaggtcttcatgtctcatcatctcattttggggcagagtctgaaagggcacttgctgcctagagcatgtacttctcttgtcagaagtccaaaactctcagaggggcaagtggttctgaaataagctgtgattctcaaataagctcaaatccattgacctatgcctttttcttgcagctcaatgtagatacaagtcacgtatcctacaattcacccatttaaaaatgtccaattcagtggtttttaatatatgtgcacatatatgtaaccctcatcatagctgattataaaatactttcattttttttgagcagagtctcactctgttgcccaggctggagtgcagtggcatgatctcagctcactacaacctctacctcccaggttcaagcgattctcctgcctcagcctcctgaatagctgggattacagctacatgccaccacccctggctaatttttgtaattttagtagagacgggggttttaccatgttggctaggctggtctcatattcctgacctcaagtgatttgccctccttggccttccaaagtgttggaattacaggcgtgagccacctcacctagactacaatactttcttcatgttgtaaagaaactccacagcctttagctatcaacccctgccttacattctcaaatcagctctgagtaaccactaacctattttctgtctgtatagatttccctgttctgactttcatatgaatggaatcatatagtatgtggccttttgtggctggcttcttccacttggtgtgatgggaagtatggctcttaaggcctaggcttgcaacttaactattgtcaatcccaatccccacactccataggcccaagcaagtcacaggaccaagcccaactaaatgagatagggagtaaactcttctcatgaaggttgggagagtggggatgtggaacagtaatagaatttactaagtacagtatttttatgttttaatttttaattgatcactgtatttcctcatgtcattgctttttattgacagcagatgtctatatcatacattaataaccaatctctgttttgtatatcataattatttcaaattagaaaatttacttttgcttttaatgatggaaaattttcacaatgtgctatattttgcaaaggagaaaaatatagaagaaaggaacttgtgataatatttctttcagaataaaattgtgtatttattaaggctgggaaaatatagctatggccagtattcaagtatatttggctgtttaaatatttttaggtttctgctgagcctgatggagctacttatgtatttcaaggatttattcaaggcaaagattatggacaatttggcctacaaagactgggtaatgtattcattttgattttcacgaacttctgttattatcccagacatcataaaaaaaagactgtggattctgtacattaggtacacttactgcattataaattctgtactgccagaactatgcattgatacctttgatagcccttttaaataatcacattcttcaaaatactggatctttatgtaccaactctgtacagtgtttagattttcatggtatttctaataaatatgacaaactggcttgcctttaagcacataaaaaggagaaaaagtgatatagataaaaaagaaaatattaaactgtaaattagtttattgtatctcatgagaactgtactacttttcttcagtttgaatattgtcgcagttttcattcttctgaaaatgtagtgacactctgagaaactcacagagtctggaaagagaaaataactttgaggaatgggccccttttggggacttggttctcttcaaatatgtaaattttctgcagtgggaagcaaagaattttgtcatttttatttccaactcttctatatgtatataaacctttaatggtctggcaagaatgtgtttatacacatagcttttggtgtataattctcctatgatccactgtctcccattattatactgtgacagggatacacaaagaataaattcaggctctaaaaattattatttgacatttatcttttaagaaatgaactttttttttttcttttttgagacagagtcatgctcttgtcacccaggctggagtgcaatggcacagtcttggctcactgcaaactcctcctcccaggttcaagggattctcctgtctcagcctcccgagtagctgggattacagaccaccatgcacactaccatggtagctggaattagctaccatgcctggctatgtatttctagtagagacagggcttcaccatgttggccaggtgggtcccaaactcctgacctcaggtgatccgcccgccttggcctccccaagtgctgggattacaggtgtgagccaccatgcccagccaaaaatgaactttttaaaaaattttgaacttttacatagcagtactaagtcacaggaaaaataaggtaaaaaataagatactaattttctttaacctggacaaagatgaggtttagttaaatgtaactgtttgtcaaaaagagaaattagctttctctacatgaaaagtaataagatgccatttacatcacatcctacctgtgtttgtcttaaaaacaggtaaaaacactcattaacatagtgcatttacacagttgtataatttagtgctgaatattttcatgtaatattctccaaagtgtctcaaacactacaagtctgaagcagaacccacaaaaaaggaactatttccttttaagaaagaactggtatttctttttccctcattcctgtgcaaatgtgtcgacaagcttggcttttcttatttcctaactctgcgaatgccatcggcatttactgagcttcaagtagaatacttgtaatcctgtgtcttcttgcctcttacatccacataaacaagttctgctaattttcattatgaaatcttcctcaaatctattgtcccatgcacttcctatttctctagtttaaattttaattcctttttttttttttttaatctcggctgtcactacaatcttctaactacacctgattccagtctgtattccctgaagtccatcctactaccgctatgttctaaatctcatgtcatatcactgggtcttttatttctaaacaccttcagttgttcctcactgaggtggatagtaactctggctgggtgccatcactcatgcctgtaatcccagcattttgggaagcttaggcatgtggatcacgtgagttcaggagttcaagaccagcatgggcaacatggtgaaaccctgtctccacaaaaaatacaaaagttagccaggtgtggttgcatgtgcctgcagtcccagctacttgggaggctgaggcaggaagatcgcttgagccggggaggtggaggctgcagtcagccacgaccactccactgcactgcagcctgggtgacaaagtgagaccctgtctcaagaaaaaagaaaaaaagaaaagaaaaagaaaaaaaaaagtttgagttcgtcagaatgatatttattcccttttagagtctagccatagtttattcttttaacctcccactcctatttcatgtcagtgcttgtcacatccactacctaagccacttaccttcccatttctagcctcatgatgatttttcaagccaagcctatgttgtatatcctccagaattactcctttcctttctaaagcacattgaccatttattcatgcttgatatacacacttattatatactccatatgtcttcccactattgtataaactccttagttcggggctctgcctatttttttgtctgtaccctttcctggaaaaatatcttctaagaggcactgtgcaaacatatgtgaaatgagttgaaggagtttcatgaattatttttgtttactatgtgatttccaggtagatatcttgagaatagaagaaattaattgattcatgggagtagaaattaattatgataaaagagttgtgtatttataatttattttttattttgtaggactgaatatgtcagaaggttcaaattcttcaaatcaacctcatggtacaaatagtagttctgtagccattgctattcttgtgcctttttttgcacttatatttgcaggatttggattttatctttataaacaaaggtaagctcattgatttttaactacaaaatgtttcccaaatctgtttttcatgttatttctactgctctagctcaaatcttaatttcaaattttcttctgagttgttgaaatgtctgtgtgctaactattgtcatagacactgaaaaatttatttcccctaaccacccctgcaacattacatacaacataacaaaagtgctctgttaaattgcacaagcattcagtttaacctttcttttgcctgtcaatttcctggcatggacctaattgtaaaagttatttctacattatctataatgagactttagagatagaaaatctaggttaaagtttaaattggagaggtaatatctgctgccagatatgtttagaaaactaagaaggagcttgtgtccaaacctcttagttcacacaaaaatactaactgattttacccaggcagacagatggcaaaatcctctaatcttctcattcatcttctgttgctttttgatgaattgcaattaatatatttgtgatagatctaatatatagctgtacatattattagtagatcctgttctctcagtccattacaaatcctggtgagtgctttactatatcccactatttgggacaatcccttatcaagaaaaaatatgtgggtagccagataattaaatgactataacctaaatgcctttcctccaaaattgatatatatatatattttttgagacggagtcttgctctgtcgctcaggatggagtgcagtggcacaatctcggctcactgtaacatctgcctcccaggttcacgccactctcctgcttcagcctcccaagtagatgggactacaggtacccgccatcatgcccggctaattttttgtatttttagtagagacggggtttcaccgtgttagccaggatggtctcgatctcctgacctcgtgatccgcccgcctcggcgtcccaaagtgctgggattacaggtgtgagccaccgcaaaattgatattttcatttggggtcaatctgcaacatctaagaatgatttatttaatattatataaatgtgtactgagtgtgaattaccagctacttaggtctagtcaatatcagattttattaatagataaagaataatcatcactaaatttatttataggacaacctaagtcaactttttaaaaattgtggtaaaatagatatgatataaaccttatcattttaaccattttaaagactacgattcagtggcatttagtacattcagagtgccatgcaaccatcactactgtatatttccaaaatattttggaaccccaaaaatgccaaagggaaactgtacttattaagttgtcactcctcactcccctcatccagctgcaggtaactgcaaatctgtttgcttattctgcatattttttacgtaaatggaatcatacaatatgtgacattttgtatctggcttcttaaacttagcaaaatgttttcaaattttatccatgttatagcatgcatcagtacttcattctcttatatggctaaataatattccattgtatggatgaatgtgtccattcatcaattgatggacatttgagttgtttctaccttttaactactgtgaatagtgctactgtacacatttgtgtataagtttttgtttgaacactcattttcagttcttttcagtatatacccaggaatgaaattactggaatatgtggcaattctatgtttaatttactgagtaaccatcaaggtgttctgtacagcagcagcagcattttccattcctatcggcaatggataaaggttctgctttgtccaaagcctaaccaacacttgttattttccaggtttggggggctttgtcttttgttttttattaaagccatcctagtgcatgtgaagctgtatctcactgtggttttgatttccattttcataattataggtgatgttaagcatccttttatgtgcttgttggccctttgtccatttttgttgaaatgcctattcaaatactttgttcatatctaaattaggttgtttgtcttatttggttgtaagagttctctatatattttagacactaggcccttattagatatatgttttgcaaatattttctccctttccgtgggttgtattttcactgtcttgagagtgttctttgatgtacaaaagtttccatttgatgaagttaaatttattttttttcctcttacttgtacttttgatgtcaaatccaagaaaccattgccaaattcaaggccatgtgtttttcctaagagttttatgaatttggctcttgtgtttagggctatgattcattttgagttaaattttattcatggtgtgaatttttaaaacttggtaatattttccttcaagttgttgaatattaagaaggggcaattattttgtatcttcatgattattacctaattagaaggcaatgatgttgctttggtttttattttaaatctagtttggaaaaaaaatatgatccagtagagttatagtattagacacacttagtaagagcaagttattagctttctcccaataaacctaagatagtttcttttacaattattatcgtagaaatcacctaatatttttgaaatatagataaattcagaaaaatgcattagtgataataaaataatataatggcaattacaaattataataaaattaatagttgaaattcgattgttcagtataaacaatagagttgagaaacaaatttattttaagatatatcccttttaggaattaggccccagaaacagatagcagcaagtctgccttttttccattacaaatgtgagcaagttatacatgcttcgtgggaaagataaactagattagcattagtcaaaggtggaagaaataaacaaatgaatcagaatttcaagaccagcatcctctaccagccaacccagaattcatgtgtctggttaactaattgttagtagtcctttagaaattattttcatgacttgagtatgagagtagccatttcttctttgaatttttgaatttgcatgctttaatgtataccatttaaaaaataaaattgagcattcatgttttgggatactccaaagtacctttccaaattaggcctcagcattaattgtgtactcttcagggaatctccttctctttttgtgcggaaccgacttataattcaggtttcagattaaatgttacctcctaaaagatgctttgttctattacctctcctaaagtggcttccagttacttttcatattaaccattttccttttcatcataacaattctcattacctactatttttggttttatttattttaatttattcttgttttctatcactacaatgtgaactccctgaaagtaaagactagtctttttttaaaaaaatgatatacccaatgcctagaatcatgactggcgcataatagatgttcagtaaatatttggtgaacaaataaatagtgatgagacttaaatccatcatcattattatttatactataaatgataagtcataataatttctaattttgtaagaaaatttattatagccatcatataatttatttatatttatgttactaatattgatgctgtacataaatatgtaatatatgtaaaattaaaagtcactcaggtttttaaagtaacaaggaaattgttcaagttgacttagtgtgtttatgatgtctcaattaatatttttaagttacattatctgctaacgatgtacattatgtttgagctgtagtctgctgtttctggaagaaagttaacacatagctaatcaatgttctcatcaacaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgtaaaa

SEQ ID NO: 79 - DNA, 1975 bp, Homo sapiens
tcggagggagggtggagagagagtgcagtggtgccaattgctctcgctgcgtcagggttccagataaccagaaccgcaaatgcaggcgggggtgtcccagagtcggctccgcctgcaccccagggcgctggggccgggcatggggcggggggtgatataagaggacggcccagcagagggatgaagattttggagcccagctgtgtgccagcccaagtcggaacttggatcacatcagatcctctcgagctccagcaggagaggcccttcctcgcctggcagcccctgagcggctcagcagggcaccatggcaagatcccttctcctgcccctgcagatcttactgctatccttagccttggaaactgcaggagaagaagtgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatgtgacctttccctctgacctcatgtgcgtggatgtcaagctcatctccccccaggactgcacgaaggtttacaaggacttactggaaaattccatgctgtgcgctggcatccccgactccaagaaaaacgcctgcaatggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaaccaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcatggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtggggaaaaaa

SEQ ID NO: 80 - DNA, 4175 bp, Homo sapiens
gttcccgagccccgtgtgcggcaccgccacagtctgggcagcggcggccgggggagcgctactaccatgaactgcctggtcctcctccccagagctgctcatccgggtcgggctggagacacagtcaggggaccccgtcgccgccgccgcgccccctcttctttcggctcaatcttctcttccaccttttcctcctcttcctccaccttctttgcctgcatccccccctcccccgccgcggatcctggccgctgctctccagacccaggatgccggggggcaagagagggctggtggcaccgcagaacacatttttggagaacatcgtcaggcgctccagtgaatcaagtttcttactgggaaatgcccagattgtggattggcctgtagtttatagtaatgacggtttttgtaaactctctggatatcatcgagctgacgtcatgcagaaaagcagcacttgcagttttatgtatggggaattgactgacaagaagaccattgagaaagtcaggcaaacttttgacaactacgaatcaaactgctttgaagttcttctgtacaagaaaaacagaacccctgtttggttttatatgcaaattgcaccaataagaaatgaacatgaaaaggtggtcttgttcctgtgtactttcaaggatattacgttgttcaaacagccaatagaggatgattcaacaaaaggttggacgaaatttgcccgattgacacgggctttgacaaatagccgaagtgttttgcagcagctcacgccaatgaataaaacagaggtggtccataaacattcaagactagctgaagttcttcagctgggatcagatatccttcctcagtataaacaagaagcgccaaagacgccaccacacattattttacattattgtgcttttaaaactacttgggattgggtgattttaattcttaccttctacaccgccattatggttccttataatgtttccttcaaaacaaagcagaacaacatagcctggctggtactggatagtgtggtggacgttatttttctggttgacatcgttttaaattttcacacgactttcgtggggcccggtggagaggtcatttctgaccctaagctcataaggatgaactatctgaaaacttggtttgtgatcgatctgctgtcttgtttaccttatgacatcatcaatgcctttgaaaatgtggatgagggaatcagcagtctcttcagttctttaaaagtggtgcgtctcttacgactgggccgtgtggctaggaaactggaccattacctagaatatggagcagcagtcctcgtgctcctggtgtgtgtgtttggactggtggcccactggctggcctgcatatggtatagcatcggagactacgaggtcattgatgaagtcactaacaccatccaaatagacagttggctctaccagctggctttgagcattgggactccatatcgctacaataccagtgctgggatatgggaaggaggacccagcaaggattcattgtacgtgtcctctctctactttaccatgacaagccttacaaccataggatttggaaacatagctcctaccacagatgtggagaagatgttttcggtggctatgatgatggttggctctcttctttatgcaactatttttggaaatgttacaacaattttccagcaaatgtatgccaacaccaaccgataccatgagatgctgaataatgtacgggacttcctaaaactctatcaggtcccaaaaggccttagtgagcgagtcatggattatattgtctcaacatggtccatgtcaaaaggcattgatacagaaaaggtcctctccatctgtcccaaggacatgagagctgatatctgtgttcatctaaaccggaaggtttttaatgaacatcctgcttttcgattggccagcgatgggtgtctgcgcgccttggcggtagagttccaaaccattcactgtgctcccggggacctcatttaccatgctggagaaagtgtggatgccctctgctttgtggtgtcaggatccttggaagtcatccaggatgatgaggtggtggctattttagggaagggtgatgtatttggagacatcttctggaaggaaaccacccttgcccatgcatgtgcgaacgtccgggcactgacgtactgtgacctacacatcatcaagcgggaagccttgctcaaagtcctggacttttatacagcttttgcaaactccttctcaaggaatctcactcttacttgcaatctgaggaaacggatcatctttcgtaagatcagtgatgtgaagaaagaggaggaggagcgcctccggcagaagaatgaggtgaccctcagcattcccgtggaccacccagtcagaaagctcttccagaagttcaagcagcagaaggagctgcggaatcagggctcaacacagggtgaccctgagaggaaccaactccaggtagagagccgctccttacagaatggagcctccatcaccggaaccagcgtggtgactgtgtcacagattactcccattcagacgtctctggcctatgtgaaaaccagtgaatcccttaagcagaacaaccgtgatgccatggaactcaagcccaacggcggtgctgaccaaaaatgtctcaaagtcaacagcccaataagaatgaagaatggaaatggaaaagggtggctgcgactcaagaataatatgggagcccatgaggagaaaaaggaagactggaataatgtcactaaagctgagtcaatggggctattgtctgaggaccccaagagcagtgattcagagaacagtgtgaccaaaaacccactaagaaaaacagattcttgtgacagtggaattacaaaaagtgaccttcgtttggataaggctggggaggcccgaagtccgctagagcacagtcccatccaggctgatgccaagcaccccttttatcccatccccgagcaggccttacagaccacactgcaggaagtcaaacacgaactcaaagaggacatccagctgctcagctgcagaatgactgccctagaaaagcaggtggcagaaattttaaaaatactgtcggaaaaaagcgtaccccaggcctcatctcccaaatcccaaatgccactccaagtacccccccagataccatgtcaggatatttttagtgtctcaaggcctgaatcacctgaatctgacaaagatgaaatccacttttaatatatatacatatatatttgttaatatattaaaacagtatatacatatgtgtgtatatacagtatatacatatatatattttcacttgctttcaagatgatgaccacacatggattttgatatgtaaatattgcatgtccagctggattctggcctgccaaagaagatgatgattaaaaacatagatattgcttgtatattatgcagttgactgcatgcacactttacatttatttataatctctattctataataaaagagtatgatttttgttacccaaggcaatgtaatatttgaagaatcagggtccaacctgccaatgttgccatgacaaatttgatctcaggctgagtatgtatatcgagctatcattttctcactgttctgttaagttaaaagtatagattaatgccaaggaagagttcagtcttttaaactattagtaccatgttatgatctctttccataggatatttttctgtaacttagtgttaggttcttttcccctacaggcagtgtttgctccatttaaatgactgtttagttgcctaagtcagataagagtgtgggatattgaaaacttattgctatgggttttgtgcatgaattacatttttgatcaactatacctctcgttttttaacattatacttagatagtaatcattagctcttatgtaaggaaatccctactccctccttcttggagaacagctgccatcttgtaagctgacattatcaacatcataaatactaaactattaatatagagtatgttattatagaaacactgcaccacagggtataagggccttttgacaattcatgtaagagatgctgaatttccaaagctgataaatgctctaaatttgtatttccaaaacatgttcaagagtgacattgaaaggcttgttagcaaagaaacatacaaaaaataaa

SEQ ID NO: 81 - DNA, 9646 bp, Homo sapiens
tcgcccgccgcgcgcgccggtccggcagcgcacgggttaaggctggcaccgcgcccggcgggagggggggcgcccacctcccctcctccccgcgccgggcatgcggggcccagtgggcaccgaggaggagctgccgcggctgttcgccgaggagatggagaatgaggacgagatgtcagaagaagaagatggtggtcttgaagccttcgatgactttttccctgtggagcccgtgagccttcctaagaagaagaaacccaagaagctcaaggaaaacaagtgtaaagggaagcggaagaagaaagaggggagcaatgatgagctatcagagaatgaagaggatctggaagagaagtcggagagtgaaggcagtgactactccccgaataaaaagaagaagaagaaactcaaggacaagaaggagaaaaaagccaagcgaaaaaagaaggatgaggatgaggatgataatgatgatggatgcttaaaggagcccaagtcctcggggcagctcatggccgagtggggcctggacgacgtggactacctgttctcggaggaggattaccacacgctgaccaactacaaggccttcagccagttcctcaggccactcattgccaagaagaacccgaagatccccatgtccaaaatgatgaccgtcctgggtgccaagtggcgggagttcagcgccaacaaccccttcaagggcagctccgcggcagcagcggcggcggcggtggctgcggctgtagagacggtcaccatctcccctccgctagccgtcagccccccgcaggtgccccagcctgtgcctatccgcaaggccaagaccaaggagggcaaagggcctggagtgaggaagaagatcaaaggctccaaagatgggaagaaaaagggcaaagggaaaaagacggccgggctcaagttccgcttcggggggatcagcaacaagaggaagaaaggctcctcgagtgaagaagatgagagggaggagtcggacttcgacagcgccagcatccacagtgcctccgtgcgctccgaatgctctgcagccctgggcaagaagagcaagaggaggcgcaagaagaagaggattgatgatggtgacggctatgagacagaccaccaggattactgtgaggtgtgccagcagggtggggagatcatcctgtgcgacacctgcccgagggcctaccatctcgtatgcctggacccagagctggagaaggctcccgagggcaagtggagctgcccccactgtgagaaggaggggatccagtgggagccgaaggacgacgacgatgaagaggaggagggcggctgcgaggaggaggaggacgaccacatggagttctgccgcgtgtgcaaggacgggggcgagctgctctgctgcgacgcctgcccctcctcctaccacctgcattgcctcaacccgccgctgcccgagatcccaaacggtgaatggctctgcccgcgctgtacttgccccccactgaagggcaaagtccagcggattctacactggaggtggacggagccccctgcccccttcatggtggggctgccggggcctgacgtggagcccagcctccctccacctaagcccctggagggcatccctgagagagagttctttgtcaagtgggcagggctgtcctactggcattgctcctgggtgaaggagctacagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccattgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagtcgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagggcgctttcggctcctcccagatgtacagcaacaactttgggcccaacttccggggccctggaccgggagggattgtcaactacaaccagatgcccctggggccctatgtgaccgatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaacctgcagcactgatgtctctttaccgatgggttccagacccaaggtagtcctggcactgccctgtggactcagcccagctggggaggacatggcgcccggtgccctaggagccctcagtgtcccctacctgacctgtctgcacctgtgtgacagccccttctgatttggccccctgcccgcttggagcctcccagcaccagacagggcaggtttggggagccgctgtccagccctatggtgagaccctggctgacatttcccctccttcctgccaaggctggaggccgccaggtgtttgctctctccttgtggggaggtggatcctctgccagcaggtgtctgtccccggcccagcgcatcttgaaggccctggactctgttaccagtggggggcctgtggccccggctcttcacagcaggcagaagcgtatgatcccagggagggtgggctggggggggggcagcacttgcctcggagccactgctgcgttgggtttgccttctgccagaggtgtggttaagggcagtgatagctgcgccccagcaaggagggtcatgggccctgagctggcccaggagaccctggccctgccctgtgccctgggatgcctaccctgcccacctccggaggtggaaccgggctgcccctgggggcctggacttgtcccattcccctgtccctggaaaggccttcccgggggctttttgcctgaggctgcactcttggaaggcgtggggagagttctgcctggagggggactggacccagtgccctctgcagacccctcccagccgcagcaccaagggcttgctgccttgtttcctgccaggagcgccctgacatcccaaaaccatcttcccacatgtgggttgttggaatcccacccactcccccggaccctgcccctccaagttggggacggagatggggagcaggtcaggccctccctaggcctgtttgtgtgtgatccttctcctggccccaggtcgacctggaaggcgtttctgagtcttgtactgggaccttcccagggaaggtgccttggggtgcagaatcctgggaatgttaggaaagggctgcgtgaaaaacccagctgggcctggggtggaggtgcacacgggctggggctcagctccttggagagggcctgcctgggactgagggggccagggctgggtcaggattcaccagcttgtgttgcagacactggagcgattgcctggccctccctaagccctatatgcctcactcataatgaggctgtctctgaaccccggagggcgggacctacaagtccttcctcttggcgcattcccacactccagtctggatccaggtctgcaaggccagcccgaccctgacactgcacgtgggcgtagtggggagcaccctggagtggagatgattgtcagcgggctcacatgttatggttcatccacatgcgtgttgtgtgctctgcggtgcctcctggcaaagggtcctggctcgggtcagaagctcactcccgtgccctcgtccccaaacaagcagtggcaagcactggggttggccctcgttgggagcagtgcccaccttccttggcccacagcagataggtcccgagcagcaggactggaggcctgtggcggtcagggcaggggtctgtgtctccaccccaagggctgatggtccctcccctgtgcgccttcctctcaggcaggcttgctctgtcccttcctctctgcttccctcccaggcctcgccagggctcccttctcctctgcctggttagactcgggcacccaggaaagcctggccagggctcctttgggcctgggccccctgcactgcctggtccagaaggggtggtgctgtccgtggccagcaccccggggcccgggaggggtgggctactagagtcagagcgggtttggggctgaccagtttgggagaggagaaaagatctgagaatgtccttcttggtttgtcagtcatctctgccaaaagtggtgatggtggtgtccgtatgtttggcgtctttgggctgggtttggtttttgctgctggtagaatcagggtcctcgggcatgaacgcgagcccaaagtgccagtctgcgattggaaatttccagccactttaagccagtgctgagtagggcttctgcagagccatgtttgagccaaggtcttggaaggcattgccccatgggctcaggtgactcggggtggagtgagcacgtctgcagggccctctcatacacgcctgaggcagaagcagcgtcccccgtgaaagccaccttccgaagctcctgcgttttttgcaaacttggcttcccccaggggcaggctggactttccctgccccctatgattgaagtcctcctgcttttgggggctgccttcccagagtcccccgggtgctcccctgccgaggtcaggagctgaccaagccttggcccggtgacacctgcagccctcactcctgtcatcccaggacacttgaggcccaaggaggtggagtggagagtgggctcgggtacatgggagccagaagccagatggacttggtcaagtgtcggtcacttggagcctccagtgtgcgtcagggtctgtgggcaggggacagggcgtgggtgggggccgaggctggcacgcccctctgccctcaccgtcttggtgacctggcctcggcccctcccccaagtctcttctgtgcaaggcccgcctcggcctcggcagctggttcctgtcctgttttctgtgtctgaaagtttacaggttgtggtgcatcagcccaaactcactggcgttgtgttttttttttctttaattttcagattttttttttaaacaaagtatttttttaggtgcgataacccagaaagggcccgttgggtgtgtgtgtgtgtcctgaactcctcaagcagcgattggagcccaagcacccctggagaggaagggagggtccccactggcccgtggggtctgagttcaggggtgtggagggagcagactccaccggcccaggcccagctaagagggggccgacccctttccccaggcacagccccaggctggcaaagggagggccctgggctgggtgcaaggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaagg

SEQ ID NO: 82 - DNA, 6385 bp, Homo sapiens
agatgcttccagcgtgcttatctggctgtgcttttcactttgggacaaagttctataatcatatctcatggatttattttctccacactataaagcctgaattgtgaagatctcatcatgccataaagggcagcatgagccaagttctgggggctgctaaggatttctttgccttttttccccccaccctttttggaaatgtgtatcaggaaaaggctttgcctttagagagaaattgtactgctcttgccaataatgtgtaatagtattaaatttaatggcagaccttgaagtgtataaaaacttaagtccagaaaaagttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaac

SEQ ID NO: 83 - DNA, 3854 bp, Homo sapiens
atggggggacagatcacccggagcactctccacgactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttgatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaactggaactccataaggaggggccaaattgggaggccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctga

SEQ ID NO: 84 - DNA, 789 bp, Homo sapiens
aaaatgtctgtgatatctgcacggatgacttgatgggatccagaagcaactttgattccactctaataagcccaaactctgtcttttctcaatggcgagtggtctgtgactccttggaagattatgataccctgggaacactttgtaacagcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctggtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttc

SEQ ID NO: 85 - DNA, 10064 bp, Homo sapiens
cagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaagagctggagaaggctgatggggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaaggagtgacaggtgcgtcacaacactgcctaaggctctccctctcaatgctgggaccctcgccccactcccagtggcagccaaaccagcaatatccaacagacataggccccctacgggacagtgtgggcccccagatataagatggataccccccgcacctgcagtaaagcatcccaaagccaaatgctcaattgcatcctgtctgcagctgggactttggagggtaatggctgggcagacagtaaagttgatcatctgttttctcggggtggcagacgcagccatgtcttggtatcaccacccatgtgacagctactcctgcacaactgggacaaatgtcagggccagagccatgaaggtgtggtaccccttgatcagcttctccacgtcctggccccaggtcttggcggggagggggtcacatgagtacagaggtcaaatatctaccaccctccagccctgagcaccagaagctctgcaaccaacgtccccaggaatggccttccccttgctgctcaggtcatacttctggaggaagagaaagctcattccatattttccccaccactctactccgaaagcaacacagttctggcccagtatcaaactagggttaggtccaagagagcagtcaagcgggtcgggggtgggggggagggcggagggcagcaggcattttcccccaaggaaaccatgaaagtccccagggcctgcagtcaagtttctatcaccttccccgtgagaaggaccttagttccatggagatgaagtgggtgaggttcaggtagaagccacaggggcaggcatccagaatgaggccccctgaggaaccctgagtgctgaccagtgccggcagaaatcagttccaccctgtggccctgacactatatgtcagggtgacaccaactgcagcaggcaggagccacaggaaggaagacgtcatccgatggagcctgacatccccaggttcccgccctggtgagcaaggtcttcatttggctttggtacatatgaccctatacagggaacctagtgtgtatcactcaccagcctrctttctgtatctggggaaaccaaggcagtgaggtgactgcactcacctagcaataaagtaggcctttggtgcacttgcaggcatgtcctcctctggggcagagagcaggttccttgctgaagggcagatggtggcaaacatctccctcaactgtttccctgggccagtctttagggagcctagggacaagggcccaccctcccccttccacgtgtgccaaatcagcacctgaagtgaggcatttccagcaagcaactccacagacccgagaaaggaagggctctagtggaagagctagcatctcaccaccccaggtcccctggcctggtccagggcagccagctgcatgtgaccattctgttgccagctccccacacatccctcctgtcacccaggctccaagacattcgaccaactagactgaaaatgcaggcatccagctttgggagaccctgtgtgtgccacaccagggctaagctctcccagtgccctagcaaggtctttttttttttttctctccttattctactctacagtcttttgacagtattcccaaacgaggttgacacagctccagtccacaccagcataccaggcttccttcccagggcagtttagaggaagctccttctgggcaaggtcaggcggtcctccttccctctctccttcccctttgtcccagcctcaactgactctggctgtgggaggtgtggagggtccttaggcttccctccccaacctggcctccaccaacacccctaacaggaggcccgtggaaggctcagcctctcctccgcatccctcctccttcctgcctatcggagggagccagggtcccctaggctgaccctgaatcctcttcctcccttcatgggaggggggcaggaatccagaggaggatgaagccagcgggaccacatggcttggtggcttggacaaacaagctcagggaggaaatgaggaggcggcggctgcagaggaatgcaaccctgttgggcacagaccatgcaatctggggctggccctggggccagctgggtcctgtcctccacctgctcaaccgtgcttccaccaaccagaggaaacccatttactagtttttctaataaatcaataatgctcc

SEQ ID NO: 86 - DNA, 5944 bp, Homo sapiens
ggcagggacccacgggacaccccctctgcctccgctccacgtccagggggccgaaggggcgccggacgagggaccgtgcggagagaggggttcggcggcgccaggactcccgcgggctccccggagcaggggtcggaaggagggggagcgggagccgcgggggccgctgcagcagaagggggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgatggttttattggtttcctttcccccaattaaggccaaataaagtcgtgagaacattacccatttacttcctaagagtggatttgagtttcaggagccttaaaaaggactgaagagtttctcctgggactacagcttggatggaaagtttactcggggactggtagaacaagtttctttgaaaggatcatggatagtgggtctggagtagaaggtgatgacaagtcagaaagtgtcttagtcccttcaagttgctataacaaaatgcctcagactgggtaattataggcaacagaaatgtattgctcacagttctgaaggctgggaagcctaagatcaaggtaccagcagattcagtgtctgatgacggcttgttgaagcttgcctgcttcaaagaatgcacctttttgatgcatccccacatggtgaaaagggtgaacaaactcccttaggcctcttttataagggcacttacccattcatgagggttaaactttgatgacctaatcatctcccaagagcctcacctctcaataccattgctttggggattcaattttaacatatgaattttgggggacataaacattcaaaccatagcaggtgcattcctgtattgggaagacattaaattaaatgactcgtaaatcccccatatgatttaggagactaaatggcatccagtgaggctgactgcagtagcctgtgagaaggcaaataaacatgggaaggtagtacagggaacatggaatcattgccagggacaggctaaataaccttaatggcacttccttgatacacacattccatgggggtaaacagttccaagtgggctgaacgttagctggttaaaacctcttttgcttggggacacatgactaacgctttccaacctgccattttcatatgtatcatgcactctccacccacaataattctgcctcccaaaagagcatattatagtcaatgaggtttaaggtttcttcggttcagtcatgtggaagttttgctttcctaaaattatagctggatcactttgattggatttgggatattacccaaatgctaatcaaatattaaaaggcaatcttttttgttatgtgattgctacagattactgctcttacagtttgattcttcaaattttcattctcagaagggaatcttaaacccagtttgaagggtaccttgtccacaaccacttttaaattttggctaacttcccaaccttccaccatgttctgggaaaactttttctgctgttatagtatgtatgtattcaggaagtgcaacattattaaactaagcataattcagaagctaagtttcctttcatcaaaatttaatattacgaattgtgcaaagaagtatgttactttgatcagctttattttagagcttctttatcaagttatcatcagtcctcttgaattatttctgaaataaggggaaggaaggaagggaaaaaatatgaatgcatagatagatctaagcagatgccttcagagccctggaataatcctagctgggatatgggacatgaaaacaactctggcctactgctgctgggggctgttgcatggtgtgacataggaagtaaaatgttgctgtatgaataggaaggagggtcttcctgtcaatgagaattaatgttttcctaatgatttaacttttttactgaaaaaataatatgtgtacatggtaaaaatccaaattgtatcacagaaaatacagtgaataaaaccatcctcttaagagggtgtgtacatttataaatttgcctatgattgcctataaagtcaaagaagttgcaccagtatgcatgactgccaaaagtacataaactgagcatatccatttccctarcattcttgcaaacattgtgccttcgaactttttggcctctgatagaggaaaaatggtaactccttgttttattttttatattcattattccttttgtaagattaaatatcatctcatgaataa

SEQ ID NO: 87 - DNA, 654 bp, Homo sapiens
ccggtgtgtgcggagcgtggcgggcgcagcttaccgggcggaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcg

SEQ ID NO: 88 - DNA, 2490 bp, Homo sapiens
aggcgggagccggaagcccagcgcggagccggccgcggccccctgttgtgttgctgcggagaggtacttggatgcattttacaggttagcctcacttgagctgttgtcctgcaagtaaagtgtatttttggtgattgaaagttggagaactttcatttcagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgagcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggag

SEQ ID NO: 89 - DNA, 2300 bp, Homo sapiens
aagtgtgaaaaaagcgcgcctctgttgggacgggaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcat

SEQ ID NO: 90 - DNA, 7470 bp, Homo sapiens
ccgcctcgggagccggaggagaggcagccgcggagcgccgagctggcctcgccccgaggcccggccctgggtgtggggaaccgcgctgaggagctggaaactttcccggcaggagctgactgctgggcaggaacgtctctcaggagaaagagtggaagagaaaattgtgaactaaggccccctgcccccttttcctggtgcatgtgaagttatcaaaaacagaaacaagtgttgaaaatgttaaaggctgtgctgaagaagagccgagagggaggaaagggaggcaagaaggaagcaggaagtgactttggtccagagacttctccagtcctgcaccttgaccacagtgctgactctcctgtgagcagtcttcccacagcagaggacacctatagggtgagcttggccaaaggtgtctcgatgtctctgccttcctcacctttgctgcctcgacagtctcacttggtgcaatcaagagtgaacaaaaaatccccaggtcccgtcaggaagcccaagtatgtggaaagccccagagtgcctggagatgcagttataatgccattcagagaagtagccaagccaacagagcctgatgagcatgaagcaaaggccgataatgaaccgagctgttcgccggcagctcaagaactgttgacaaggctgggatttttactgggagaagggatcccaagtgccacacacataaccattgaagacaaaaatgaaaccatgtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattatagccacaattacaagttcatccgaaaatgatgaccggagtggctccagtttggaatggaataaagatggaaacctaagattaggggttcagaagggagtgcttcatgaccgcagggcagataactgctccccagtggcagaagaggagaccaccgggtcagcagagagcacgctgcccaaagcagaatcctcagctggagatggtccagtcccttattctcagggctccagctcactaataatgccacggcccaactcagttgcagcaacaagctcaaccaaattggaagatctgagttatttagacgggcagagaaatgctcctctacggacgtcaattagattaccatggcacaatacggccggaggtagggcacaggaagttaaagcacgatttgctccctacaagccacaagacattttgttgaaacccttgttgtttgaagtaccaagcataacaacagactctgtgtttgtgggaagggattggctctttcaccagatagaagaaaacttgaggaacacagaactggcagaaaacagaggcgcggtggtggttggcaatgtgggatttgggaagacggcaatcatttccaagttggtggccctgagctgccacggaagccgcatgaggcagattgcttccaacagcccgggttcatcacctaaaacctctgaccccactcaggatcttcatttcactccgttgctttcaccgagttcttccacaagtgcttccagcacagctaaaacacctcttgggtctatcagtgctgaaaaccagagaccaagagaggatgcagtgaaatatcttgcttctaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctacgtccagcacagggtgcacagcagccaggacatcctcagcaacatctccctgaatggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaagggcctcagtaagaagacgggaatttcttcaagccatctccaagccctgtggatcggctacagcaccgaggggctgtccgccgccctggcctctctcaggaatctctatactcccaacgtgaaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaaatgctgcttgggcgatggccacttccaaacctgatatcttgattatacttttacagaaattaatggaggaaggaaatgtgatgtacaaaaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaacaaatgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaatccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcttccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaatagaa

SEQ ID NO: 91 - DNA, 10063 bp, Homo sapiens
cagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaagagctggagaaggctgatggggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaaggagtgacaggtgcgtcacaacactgcctaaggctctccctctcaatgctgggaccctcgccccactcccagtggcagccaaaccagcaatatccaacagacataggccccctacgggacagtgtgggcccccagatataagatggataccccccgcacctgcagtaaagcatcccaaagccaaatgctcaattgcatcctgtctgcagctgggactttggagggtaatggctgggcagacagtaaagttgatcatctgttttctcggggtggcagacgcagccatgtcttggtatcaccacccatgtgacagctactcctgcacaactgggacaaatgtcagggccagagccatgaaggtgtggtaccccttgatcagcttctccacgtcctggccccaggtcttggcggggagggggtcacatgagtacagaggtcaaatatctaccaccctccagccctgagcaccagaagctctgcaaccaacgtccccaggaatggccttccccttgctgctcaggtcatacttctggaggaagagaaagctcattccatattttccccaccactctactccgaaagcaacacagttctggcccagtatcaaactagggttaggtccaagagagcagtcaagcgggtcgggggtgggggggagggcggagggcagcaggcattttcccccaaggaaaccatgaaagtccccagggcctgcagtcaagtttctatcaccttccccgtgagaaggaccttagttccatggagatgaagtgggtgaggttcaggtagaagccacaggggcaggcatccagaatgaggccccctgaggaaccctgagtgctgaccagtgccggcagaaatcagttccaccctgtggccctgacactatatgtcagggtgacaccaactgcagcaggcaggagccacaggaaggaagacgtcatccgatggagcctgacatccccaggttcccgccctggtgagcaaggtcttcatttggctttggtacatatgaccctatacagggaacctagtgtgtatcactcaccagcctctttctgtatctggggaaaccaaggcagtgaggtgactgcactcacctagcaataaagtaggcctttggtgcacttgcaggcatgtcctcctctggggcagagagcaggttccttgctgaagggcagatggtggcaaacatctccctcaactgtttccctgggccagtctttagggagcctagggacaagggcccaccctcccccttccacgtgtgccaaatcagcacctgaagtgaggcatttccagcaagcaactccacagacccgagaaaggaagggctctagtggaagagctagcatctcaccaccccaggtcccctggcctggtccagggcagccagctgcatgtgaccattctgttgccagctccccacacatccctcctgtcacccaggctccaagacattcgaccaactagactgaaaatgcaggcatccagctttgggagaccctgtgtgtgccacaccagggctaagctctcccagtgccctagcaaggtctttttttttttttctctccttattctactctacagtcttttgacagtattcccaaacgaggttgacacagctccagtccacaccagcataccaggcttccttcccagggcagtttagaggaagctccttctgggcaaggtcaggcggtcctccttccctctctccttcccctttgtcccagcctcaactgactctggctgtgggaggtgtggagggtccttaggcttccctccccaacctggcctccaccaacacccctaacaggaggcccgtggaaggctcagcctctcctccgcatccctcctccttcctgcctatcggagggagccagggtcccctaggctgaccctgaatcctcttcctcccttcatgggaggggggcaggaatccagaggaggatgaagccagcgggaccacatggcttggtggcttggacaaacaagctcagggaggaaatgaggaggcggcggctgcagaggaatgcaaccctgttgggcacagaccatgcaatctggggctggccctggggccagctgggtcctgtcctccacctgctcaaccgtgcttccaccaaccagaggaaacccatttactagtttttctaataaatcaataatgctcc

SEQ ID NO: 92 - DNA, 2466 bp, Homo sapiens
ggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgta

SEQ ID NO: 93 - DNA, 3804 bp, Homo sapiens
ggggtgctgggcctggcgggcaaactaaggctgcggaccgttgggcggttccgcggggcgttgtccggagagctgcgaggccggggttcccagggttcacgccacactctaggaagtgcctgagctagtgagctggccaacgagctccgcgggctgggaccatgggctgcttcttctccaagagacggaaggctgacaaggagtcgcggcccgagaacgaggaggagcggccaaagcagtacagctgggatcagcgcgagaaggttgatccaaaagactacatgttcagtggactgaaggatgaaacagtaggtcgcttacctgggacggtagcaggacaacagtttctcattcaagactgtgagaactgtaacatctatatttttgatcactctgctacagttaccattgatgactgtactaactgcataatttttctgggacccgtgaaaggcagcgtgtttttccggaattgcagagattgcaagtgcacattagcctgccaacaatttcgtgtgcgagattgtagaaagctggaagtctttttgtgttgtgccactcaacccatcattgagtcttcctcaaatatcaaatttggatgttttcaatggtactatcctgaattagctttccagttcaaagatgcagggctaagtatcttcaacaatacatggagtaacattcatgactttacacctgtgtcaggagaactcaactggagccttcttccagaagatgctgtggttcaggactatgttcctatacctactaccgaagagctcaaagctgttcgtgtttccacagaagccaatagaagcattgttccaatatcccggggtcagagacagaagagcagcgatgaatcatgcttagtggtattatttgctggtgattacactattgcaaatgccagaaaactaattgatgagatggttggtaaaggctttttcctagttcagacaaaggaagtgtccatgaaagctgaggatgctcaaagggtttttcgggaaaaagcacctgacttccttcctcttctgaacaaaggtcctgttattgccttggagtttaatggggatggtgctgtagaagtatgtcaacttattgtaaacgagatattcaatgggaccaagatgtttgtatctgaaagcaaggagacggcatctggagatgtagacagcttctacaactttgctgatatacagatgggaatatgaagtgcaatgtggaaccaggacttggtattaagcctttcccaacttgtgaatatagaatttgataatacacttttgtgtattagcaatggtttttactaatgctaaaacttttaaagtttattttttaataaattgttgagtattacatcatttacttgaggttcaaaaataattcattttaaattaagtagttttaatcagcttaaaagctatttaacccattttaataagcttgcagttttgtttctctgcatatgatattcttattagaaaacagaagtagctaaaagtttattattttaatcctatttaaatgttctttcaaatctctaataatttaaactttcctcagtgctccatgatactttttttgagactccatatcattgcttattttacctttttcaatttagagggatttgttactagtcgatcaattagaatgaacctatgcacatttttatgtacacatatccagttatataattgcttcctagttgcattatatggcaaatgagattttgtaycatggagttgacataatactttgtaaattgaattttttaaagaaataggcatttgataaccagcttggcaagtaactctactaacagatgttggtatagctatttaaagactacttcgtaagtagtatgattatttgaataaattacacattgtttagttttttaatacaactgctatatgactcttctgcttcctgataagaaaaggtatatgcaatgctaaaactgtagaagcccaatcaccagcagtttttaaaaaggtgataacttttattagctcttgtgggctatcaagagaattggaacaaaaccttgtgacttttaggtaagaaataggcatgatgataagctatgcagattattaaaaagcttgatacatttgatttttcattagatatgccattcatatcaagtaatgttcaagtatgataaaattattttggttgctttaaagcactgtttcccaaatctacctgatcataataatttaccaggaagcagaggagagctacttgtttaaaaatccacattcttggacccaatcctcagatgcacggattcagtcttcaggggaaactctgttttaaggggtatgttgtaatctaaagtaattggttcaggaggtgtcaataggttgaacttgtgagaaggcactgaatctgccatccacatcacatatagcagctattatgaaatcagctttcataggcctatttttaaaaggaatctgaaatttaattctattttgataaaactaagactgaaaataaccacttgtaaacattcctatgattgttactaaaatgtattttcatgtttaaaatgtttttggatatttttgggttaataactactacattgaattgcatgttaaggtgcagaaataatacattaaaagattttcactttaaattaattagtaatattgagcgctcaccctgtgcgtggccttgtgctaaccattagcactgcatcatttcaattcttttataagggcattcaatactacaaaatcaacatgatttcataaggtgcaaataaaagttggtgacagatttaatataattttgatcacaatttacaaatgatctttgcaaatagtggtcagacggcattagtttttcccttagttaagctaaattaaagggactccatcctgttatgattatattattattattattattattatttttgaggtggagtttcactcttgttgcccaagctggagtgcaatggcgcgatctcggctcaccacaacatccgcctcctgggttcaagcgattctcctgcctcagcctcctgagtagctgggaatacaggcatgcgccactacacctggctaatttttgtatttttagttgagatggggtttttccacgttggtcaggctggtctcgaactcctgacctcaggtgatccgtccacctcagcctcccaaagagctgggattacaggtgtgagctaccgcgcctggccatgatgatattattaaacaccattattcacatttcaaataataacaatactttttgtttttcaaaaataaaatgcaatgttatataaagctataaactaagttctttatgatatttgagcaacaactcaggaatataacatataagggagatgttaatttaaaaatttccactacacttattatctattaaccaaagcttaaaattttgtattcttctgttagataagaccttttacccatttaatttgtctttaaggacagtcatttggcttctgaatgtttgaaacgattttaaaaaataagtagtgctatggttgtttctataattctaacctttgatagtaatcagaatgtattacatttcatttctgaatagcttttgaatttatgaaaaattattaacaatgaaaaattggtaattttattaagttatatgtgtttaaatattatattagcttatttctcttgcattaatagtactgctgtttttgttttgcttctttatatttatgtctagcttttatatgtaatttatctagtgtttataaaatgtgatttgtaataaatgttgttaaaatgaaaa

SEQ ID NO: 94 - DNA, 2206 bp, Homo sapiens
agttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctcctag

SEQ ID NO: 95 - DNA, 243164 bp, Homo sapiens
gcaattgcaagagcaaagattcttccttttcccttttttcctgggggggtggggggtggggtggggggagggagcgcccccagacattccaggacatcaccccctgccccaagcacgcaataaacactgacaagaaaaagtttttatttcctggttcaacttttttttttttccctggaatatagactgaagaatgggaataaacacgaataaataacaaagcgaggccgcgcacgccgggatgcgcctggctgcagccggcgaggctattgtctccccgccctgaagccagccccggcgtctttctccagctcgtttcctttcccggccttttttttttttttttttttttaattttcttttttaaaaagacgccccctccagccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccaggtaacgggctgggcgggggcggcgggcgggtcggggaggcccgaggcaggtggcgctgagagcaggaccccgcgaggctccgcgccccgcctgcattcggggagccgcggcaggaacccgcgctcggccccgcggttcctatccccagtctcgcagggctggggcgcctcggagccctttgtccataaaagagctgatttcctgggtagagccgggcgctgcagcttcccctcctctccggctggtgagctctgccgtcccctcgaaggaggcttcctttcctcgggtgctgaccggctgggggaagagaggcagacccgtggccgcctccgcccagcgccggttctgggccattccctccctccccactgccgggccccagctccggacgtccccgcttgggcatctgctcctggaaggcagcgctccgcagctgaggccaccgcgctgagggcttccaccaggcgcctgactccagcggggcctggcgcacctgggcgcgctagcccccggacaggtgtgctgggcagagccgccggcagggagacgaagggcgtgcgccaggacagagcccggtttcgtgacagcgtgtggactccgtccactcttccacccccatggcagcgttgattgtttaggtgataaaccggtcacaaaggcgtctatagggcttgattgattactttccagagaggaagaaaggcctaataaagcggggggggaggtgggggggggggtgggctgtgtgcgcctgtcaccatggagacgcaggaagcaaagtgatcattaaaacctctctccaccagaaggcaattttcacttcacagggagaagtctgggcttctgaaatgtagggttcaaaaaaagaatcaaagctggtgttttggtatcaagccacaggactcagttttgtatcttagagaagcacaattccttcgtagattctgttttgataacaagttgcttcgcctgcctttgaagacttattctctctaaatgcaacgaccccagatggggacttgatgatgttaaatggtgggcatcagaatccctggggcccgggtgaaggctggctttgtggggagggattcctgcactggaacacaccagagcttcccgataaactgcctagaggactcattacaggcagctgtgtgggcactggatccctcccccccccatttgaaaatttaaacaataaacccgggcaagtattggaagatttctttgttaagactattgacactgtgtcacttggtcaaactaaggtaccggcctgaataaatctctgacttttctttatctgggagggcaggttaatttccttagagtttcaagcagaggctgccatggccgacccttaaggttttaattaatccttttactaggaatgggggattcagccttcagcactccatgatggattgcctttctctgggttggagaggcgcatccacaactgttccaatcatggaagttgagtggcttctcatgagaatccttctaagctccctttgtctccctggcagtaagaggaagcaaacttgaaatggaaattatggaggacttggctttttggctgtatgtgagtttatgcctctgtgggtgggagcggagggttgggcaggtggtgccggtccatgagagaaggaggaggaagggctgggatgcctgtgattaagttatgcgtgggagggcacaggcttgagctctcctctggtgcaactggtctaaatgggacccagagaacaggtgtcagaggtgaaaagtctaaaatatgtgcaattctgtgagcagtagaaccttactaaaaagcaccaagcaattaagtatttatggattgtgtgaagcagattgtgtttctgttctggcagaaagagaatcagaatcatcaagttggagggaacttgggaacttgatggaggaagggcgggctcagggagtattttctgtaagcaccttgcctggctggcctggtgtgtgcctgcatacttcttttgatggtggactcagttcttcctgatgtagtgcatacttgtctttgggcagatctgtttaagaattctttttccaatggttccaaagggtctggtacccatcagtcctgatgggatcttctcctgctgggtgttactcagggctttcagagagcctggggttttaggtattgaaacaacctcagtcacttcttggaaagtctaggcccttcacctgctcttcctagatagcctcccttatttgtccacctgctgctctaatgtgagactcctgaaaattgaacctgaagctccagctgtggaataacctcacacagagttaagaagcagagctgtctcctcccatctaaattctataatttaatgaaagagtccaaggttgcgttcaccctttcccctgcaaaggcatttttaatgcatcagtatttgcaaagactcaaagcattcttcaaaaggtgagctatgttttgacacctctttctcccattttccagaggttacccctgctgggaattgaggggcatcctttggacttttcctaatgttttatatacttgtgttgcttggaaaatggcatatgggaatgtgctggactcatggctcttccatgagtggttctgctccacactgggtctcggagatcttgcctcattgcaatatccatctccctttcccttttaacacccacacaggatgccaagaaacaatttttcagtttagccattggatatttgtattgtttccagtttttacccactacagacaacacagctgtaattacctgggcacaaactgccttgtactcacctgagaatttcctctagggtgggtgtgtgccagctcttgggatgttgaggccacaggggacccacatattttattttaatgatattgcactctcctagaaaatgtacgaattcacactttccgtaatctatgagagtgccctttctccaaacccttgccaacacctgagatcatcaatctatttttctctagcatgaagggtgacaaatggtttcttgttgtgttaatttgcagttccctgattgctagtgagcatgagtgtctttttgtggccttattagttcattaaatctcccatggccgggtctgtggccatggactgtgtggcggggatgaaatatttcccctaggcctgaccttcccgccactttcaccactgcttcgttaatgggcccgtctgtatctacacaatgtgcctctctataaatccgcactctacacccgtgagcatggttaggtgttcttccaaaatagaaatttaatcaaaggtaaggaagcatcccctgatctttcctccttcagaggagctcatggtcacaaggggttttgcttccttttcttccatctgctctcaggctctgggactaggcttctgcccgctccacatcctggggccagcccctggcatcggccccagcacgatggtggcctccttcttgtcgggtcccaggctgcctcctgggccttcctcaacatgatcccatcactgctcctcaccagccatcccctgtcccttggctgtcgctgccttgctctgtcctggctccatgcctctccagctcctttctccaactctctggctctgagctccagacctctgtgttctgcccggtccttccagtccttcagacctgttccccaccccagggaactctgatctcatttctgatttgctcctggcactcttcaacacctggggttcttgtcagtttcattctctgtggactgtcccttctagactgggagcctcttgaggacagggggcttgaccatcacctgaagtgctgcacccctgagctcagcacagagctcagatgcaggagactttcagtaagcatttgtaggacgaatgggcacaagccccaggcgctggtgtctcaacctatgtggcggtgcctggccaggcaactggccactcctgccagctggatggggccagagagtgcttggagggagagcaaagaggagccagcagctgcatccttctgcagggccgggtccaggtctgctttactgcctggagagggagaccctctcagagcatcctctcctgtcatgagctacagacggatgcacagacacattccccaggccctgggctcagggcatcccatgctggccccttcctcttttatgccactctgccagcagacaggtgtgggcttgtgctgatggccacttccttcatcacctgtgcaccctcatcacccacacaccgtcaacaccaggctctgttcttgacacctccctctcccaaggtcacaggtctgccagacacgggcctcctggagcccaccccacttgtttcaggtctcccacccccacccccaccctcacccccaccagggtttagctcctaccttccctttcctggacaacctcaacactgagtcttggttctcttcctcttaccggttttcctgcagaacaggaagtttccaaaatgcaaatgtggtctagtctctcctttgcctcaaaccctctaatgctgcccccttcctgggcgtgggagagggcggaggcaagagcctcttttgtctgtaccatggctctttctagcttccttcctcgaatgttctcttattctggagtcctgggttctgaggatctccctctggctccttgtagagtgtctacatggcttaattagtagtagaactatgcagtaattaccttgtcagcttcttcagggttattaaaaacataaaagctagatgcttaaaaaatactgagtttaagaactcagagcttttttttgattatgaaagcattgcctgttcattatagaaaatggatgctttaaaattccttttcctagctgggcatggtggtcacacctgtaatcccagcagtttgagaggcctaggtgggcagattgcttgagcccaggagtttgagaccagcctaggcaacacagtgaaaccctgtctctataaaaaatacaaaaagttagctggttgtgatggtgtgctcctgtcgtcccagctacttggggggctgagccgggaggatcgcttgagctggggaagcagaggttgcatggagctgacatcatgcctctgcactccaacctgcgtgacagaggtagaccctgtctccaaagaaacaaaattcctgttctctgcccccttctcaccctaacaccacacagaagccaatgacaatggacccctttgtctttaggatctgccaggtacctggcgaagctgtcagcattggaacaacagacatgaggaagtcaggcccaggggcaccgtccagcctcacctgccttcctcatggtcacaggaacctgttttcagtacctcacttggtactcctggagatgatctcatttgtttattagacaaacttgtttatggtctgtccaatacagtagccactaactacatgtggcaatttgaatctgaataaaataaaataaattaagattctgtttcctcagttgtagccacatttcaagtgtgcgggagccccatgcagctgtggctgccatactggatagtgcagatctagaacattccttccttgcagacagctttgttggacggtgctgcttggattgtaagctccctgagggcagggccttgcctgtggtccttttggctgtgtcaccagtgctagcactgtgctaacacttggtagttccccaatgaatgctgacagaatggatgtgccagagtgactggtgtggtcttgagctctcctgcgggaagggaccctcagcctccctagtctcatcatctcatcctctgaaagggagggtacccagcagagataatttcctatccacacagaactcatttatttcaatttagtgagctttcccagagcacctgcaatgcagcacacttggcccttgccagaagggcctctttggacaagagaacaatgagatgcaaagagattctttccctggggctaaataaatgtgtccaagtcctggctcagccatggataagctgtgtgactttgggcaagtcactttacctctctgaatctcagtttcctttaatgtaaaatggtaggcattattgtccttaagttcagaatgagtgaggataactgagctgttgtctttaacaatgagtaaattttgagacacagctttaggaggcagacacctccccaaacattctccaatccccttgaggtaattccatcttctgttaacaaagtcatggtggcagtgaccacagtgatgtatacagcagggagcgggaggaggcgcagcctgcaggtggaccccagcccttctgtgtgcctggctgagctggtcagcctctctgagttctgtgaaatgtgagttagagcaggactgatctggctaggggccaggcaggagtcatgggaccgtgtccctcagtgacgcagaacagcttcaggcaccagggccattctcagcaaatggtggaggaaggaggaggaggaggaggatgtggttcctgctctgattctggattttgggcccctggctctaaaaggctcctcccctacactttcccactctcaccttttgtggaggctgtgtctcccctacccctgcctccctctccggccccaggtccacccagcctcggatgttgttccccggctcccttcctggctccccagcttgtgaatggaaatctcctagggtcccccaccttcacaagttattccctctggtctggtaattttgggatagcacactggttgtcttgaaatgcgatttgaatgtgtattttgcggggattgttttactctgatgagtttgtttcctttgcaagtatatcttcagggaaggtgctttttaggggagggtggctgtctggaatgacacaggtgagccttgttaatgctagtcctgtcgcatggccaaagcgtgccggaggggacggtgcaggtagtgggtgtgtcctgggccctccccagagctttagccagggcagcatatatgggaggatatgaaatgtcacaggaacagaggcaaaaagaaaaagtttgaaaaaaactagtatattagtttgagaccttttcttattgaatttgagagctgggttctattccatgcactagaaaactctttaacacagggcaccaaactgcagcgtctgcagggccgggacttccgctgtgggagggtcagggtgtgtgcctgctggggcggagctgcttcttgccctgtggaaatgtgggcccaggttggtgagaccatcttcatcttttttttttttttttccaggacagtgtctcactctgtcgcccaggctggagtgcagtgacgccatctcggctcactgtgacctctgcctgcctggttcaagcaattcttgcctgctgggttcaagcaattctcctgcctcagcctcccgagtggctgggactacaggtgcgcgccaccatgcccaactaattttttctgcatttagtagagatggggattcactatgctgaccaggctggtcttgaactcttgaccttgtgatccgcccactttggcctcccaaagtgctgggattacaggcgtaagccaccgcgcctggctgaccatcctgttttaagagtgacactgggaatccagatttttatatgacatgttgtgttaggattttgtgttgctataaagaaatacctgagactgggtaatttataaagaaaagaggtttaattggctcatgcttctgagggctgtgcgggaagcgtggtgccagcatctgctcctggtcaggcctcaggaggcttccaattatggcagaaggcaaagggggagccagcacatcacacagtgagagtggaagcaagagagggatgaggaagggaggtgccaggcttttttaaacaaccagatcttttatgaactatcagaacgagaactccctcagcaccaagccattcatgaggaatccgcccccatgattcaaacacctcccacccagccccacctccaacattagggattccatttcaacatgagatttggaggggacaaatattcaaaccctatcggatatgatttttaaatattgacaagtttatctattagggattgggttgactttatgtaatagaaaacctaaataacactggcttaaagaagataaaggttttccttccaccagaagtccagacagcatgatggcgtccctgtcgtagggtgggacgttcagtgaatttcatactgaattctggttgcaacatggttgcttcacctccagcaacaagtacattttctaggcaggacaaagagggtagggagaggcacaggggtgtccacctgccgagtttgacattgccttcttgggagcactgcccagtgacacccacttatacctccttggtcttaggacatcaaaaggctactcccagctgccagggagcctgggaagtgtagctttttctttttgtttgtttgtttgtttgcttaagataggtgtattgctactctaacaagagcaggttccgcggaaggggagggtgagaatgactatcaggtagtgaactacagtctctgccatatcaactttataaaagcacaatgtgatcaaaacaaaacatgtctgggagctgcatgtggcctgtagttgccctttcaaacctcagatagaaagaatctcatgggaagactgaagcagtttttatgttttgtgccattactaagaaattaaaggttggactaagatatgtgatccaagcctaaacattatgtccattcaaattttatttaacaatatccagggaacaagataggcagggtcactgttcctcacagagccaatcatctggtcagcgatcaacggctggagtgaaaatgtgcttattgtcaactcttgttataaaaggagccatcatacttccttttattgaatagtcctctaaacccttgaggtagggccagaaagctagcgaggctgagtaaccggcccatggtcacatttatataaaggggaagcttaaagaggatcttgaatccaagtgagtctgaggcctggcccatccctatctgcaccacccagcttctgcctccctcatcctgcaacttactggaaagcggtcctctgtcctttacatggaatagatatgtgtgtttcacccccattcctggctccagccatctagctgacagacgtatacatacctgtagtcacaaaagcacacagaggcagatgtactctttcatttcccagttcatttaaccagaatggccactgggacaagatttatgtattgaaagtcaggcaaggcgatggcagagaatcagctgtctgtagagttgttgaaggtcccgtctttaatgggctgggactcgtgttcctgtttgttaaagcaagtcggttggatgggtagcttggcaacgcaccttatctaatggtcacgacatctgtagactttgacgttgattagttggcagccacgaaatggatcagccctgcactgagaagacgggagctgtggctatacgacctaagaagtgtgtttattatacatactatgctcctgtttgtaatacaacccttttaaaaagtcaccattggtcttgcaatactcttcctaatgagttgtattgttatggcattactttttggttcaattatctcttgaaagtttgtatccatatatagaaaaaattgttgccttattgtaatcactagctctggagtttcaatgaagtcaggaagatatgccaaaaatgatctttctgcttccctttggcaggaaggcattgtcttaggcagcgttactcctggggtgactctgcgtttcttgagtcacgtgagtcaaatggttgctgactttggcacgtttattggccgggttttttgtgcaaagcttctgagatctgatgacctccacggtgtcaggactgtcttgtcacctgtttttcggggatctgcctggcccctaccccacattctttattttcctgttattctctatatacaaccagagatacaggttttccatcaagagggggcctatagaagtgttctttccaatcaagcttatttacataaaaaagaacatgacttgaaaatagtaataatgtagtggtggtaatacacagaaatatgcgaagaaaccatgaaggtagtgcttggaagacacaggcatgccaaaaaccacaaagctggtgtacaggtttcagtgaaatggggaaatgctgttataaattttcatcttggtcttgtggcccggccatgattacttacctatttgctgacgcattaagcactacagtgtgcatggagcatggtgtgagggtatgcaaaggggcatcgtgcatccgggaagctcatggtctggctaggggcataacattttgacaagtaaaatgacagggcacatatgtaataagtgccaggcctctcaaacttgtccccttctgtgctgtatcccattcattctctgccaggtatcacaggcttctgcaaaagcattctccagacctccgtggccctacagcattgagctttcagtccttgggtttctgaaggttggcagggtcgaaggtccaggctggctcttctccgtgcatctcttatccttcttggacctgcagtctaaaccagccatgttagtcttgtgtagtggtgaagatacatgggacctcttagggcctaggctggaaaccttcacttatgctgattctgttagcctattggccaacttcaggtcaaagagagggaaatacacttgacccctttggttgggggagcaggaaagtcatatgtagatacaggagaggtggagaattggggccagtcttgtaatccacacattaggcttatttccctatgtagtctgtgggctcctggagtcagaatcaccttggaatctcctgccacctctgataaggtgatgccttgacattggatgccaacagacaaggtctgtggggtgcttgcagatgtgtggtctctggtgtcagactgcctgggttcactgtgtggctttggaagatctacctaacatctctgatccacagttttcccatctgcagaatgaggattactttacttatattaatacccccttagacgagcagttatgatgctgagatgagatgaattctgtaaagcgtttagcacagttcctgggacacaggaagatcctggtcaccatgagctagcattcgcctcctcctatcactgtggagaagttttcaccaaaggccatgtcttggtggataagagcaggaggttctgatctggtgcagttttgaggctcccagatgcccttgtcttcctttgggcctcaagatgcaggagggagggctttcctggtctgagctgctgggtgaaatcaggcatccctctagaacttcctcccttcaccctgtactgccctggagctggttcaggagactgctggcatgcaccgggaagctccgctcaaggcgttgccccctgatttcctagtgggggagctggcttgaggcagtcagaatactgagttgggtaaaagacccagggtcagaggctgagtctcattccagctgggacgtgaggctgtggctgcgctgagctgaccaccagcccctgggttccttagggttgcctctgggctcaggaaggaaactgcatgtagacactgagctaagggagcactagctgtttgctttggttagttctttcccctaatccttgcaagtagctggttctgctttgatgtgaaataacaaaagatttagggagaatttataatttagctcatttttttttaatgggaagggtgagttttggagcacatttaataccatgccatgtggggtaagctcagagcgttgcctgcactctcattcacctgggctggctttccccgctcgcttccccgttgggagtctaatacagcctgccttttccttaagatcattacttcaaacagtgttgacattttaatgtgattattttcctgtaatatttttccagcccttttctacttggggagtatatttgcatcctttttctttagggatttgtgttgttccagctccatcctggtctgtagaatagagctatgctcatagtaggtgcatggtaaatattgattgactcttgggtacgtgatagtgacgtctagcacccctcctcatacctattcccatgttcccataaaaaaattaaaatcgagggagaaaaacccaaaaaaaacaacaataaacaaagagttccatgatggcttcaggttaaatagtctcaccctgttggaaattcctggagcaaatgagcaagccagtgggcaggagcccgagtgtgagttctcaggaatatacatcactgaaagtgagcccacacatttgttaatgattggtctctgtgtggtgttaaaaaattaactaataacaatttattccagaggatattagtgtagagcagctattttcttataggaaaagagggattccagtcatttttttttttctgttttgttgaactgatgtttgcatcttgcctggtgaaatctttagcaaggaggaggtggaagttgttcactttagcacccaggggctcagctaacatttcgtggggctgacattctgggtgcctgtgctaggtgtggaaggagaattaagcggcttctgtccacaattgagagtctgagtagaaaaaagaggcatagctcacggcacgtgtcatttctcccttcgtccctccttccatccctccctctgtccttcttctttctccttcccttccagcaaatttagtgcctatgataatgtcaggggtgaggctgggcttggggaatagcgcagcaaaccgacctgttgcctcatcctcgtggtagatcgtctggtgagtgatgggcttggatcacatcagctcataggcgaatgccccatccagctgtggggaggctgccctggagccctgcgggcttgtggaggggttggcatatctggggatctgagggaagggtccaggggagggcacttgagttagagccaaaaggtggcttcgaattaactagcccagcaggaaagggaaaggtatgctaggccgagagattggcagtgcaaaggccaggtggtgggggcagcttcggctggagccagaggcaagagagaagcaggagtatggcgggatggggctgcaggggagctgggagccagacggttggggcctcctggactggggaggagcttgtctgccatgagggaaccatgggatgtctgaagagagggatgtgagtgtgtgtgtgcgtgagtgtgtgtgacagagaccaagagacagtgtgatcgggcacatttccaagccgtcactctggctggccaccccgggtggaaatgggtcccaggaaggcagcagagtgagaccagggaagagggtgtggcagccacagatggtggggcctgggctggggtttgcagagctcattcagaaaaggggctgggactacattgcccggaggaagatctgtgcaggagaggaggctcaatctcagcttggaagggaagggcaggagagggaagggaagggtatgtgccatgaggcacctacgtggtgtctgggcaccccatggtgcagccaaaggctcctcccaggatcctcatgcaggagccctgaaggctgtgcaagaggtgctgtctcaccctgagcagggccgagagcctgagaggtgctgtctcaccctgagcagggccgagagcctgagaggtgctgtctcaccctgagcagggccgagagcctgagaggtgctgtctcaccctgagcagggctgagagcctggaactgtttagagagagtctggggcagtgcaggatactcggagagattgcctggggtgccctaggatggactgtgttttcttctttatacatgagaagctggaaaatgggagttggacgtggattccgtgggcaaaggttcttttcctggcacagtggagcagggatgctggcaggggtggatgctcactacctcctgtgtgcttttcctactgtgagcaaatgtggaagggagaattgctatatgaagaccctccatgacccatatcctgtatagccccctcccctgagtgtggcaggaaccagtgactgtgacaggtttcgcctgcatgcctaggctatcttatatgcacaggagactttaagaaagtataagccttggtggccctgccctaatcagggaagccctaaaggggacaaaattcttcctggagattgagactggaagcacaggatggaagcgggggatgctggtttgaagatggaggggactatgtggaagggaatgtgagtgacctctaggagctgagagtggcccctgctgatggtcaacagagagatagggatcttagtgccatagctgcagggatctgactcttgctaacaccctgagtgagcacggaagtagagtttccccttgagggaagatgagaaggcaccccactgctacactgatttcagcctttcggaccccgagcagatgagaaggcacctgggctgacacaccgatttcagcctttgagaccccaagcagaggacccagtcctgccatgtcctgacttctgacttacggaactaggagctaataagtgggtgttatttgaagccagtaagcttatggttttgtgttatgcagcaatagaaaactaatacggggagggaagtttattgcttccatattacaggggaaagcctcaggttcagagaggtgaagggatcgtcctggtcacctggctaccctggcggagctgagaagcaaagctgtgtggccagactctgatgctcctgctgtgtgctgcctcggtttcctgatctgcgaaatgggctggtcatggcattgtcctgaggccgcaggaggagtggcctggaggctgtgccagctgtgaaagtgtcagggcccttgtgactgttttcaccctccctgttggcacacaggacctggaggggtgcccctccgaggccctccctggcttctcacactcaccctaaacccggtgtgtttccatggttactggtggctttactagtgtgactctcaagctggccccatagccactcctttttatgtgtatttctaatttcctttagagcatttttaaacttttcgctttgaaatattttagacatctaaaaatgtcacaaaatagtaaaaaaataactcctgcgtacctttcacctatattccccaaataacatcccacttaactacagtaagtcatcaaaaagaagaaattagctttggtacaatacaattaactcatctaccaaccttatctgaattgagtccatttttctgctaacatgcttttctatcctgtgatccacccaggatcccacgtggcacgcggccagcatgtctccttagcgtccgccaatgtggaacagttccttagtgtcttcatagcctgatgcctttgaagagtgctttcagttattttgtagactgtccctaaatgaggggttgtctgatgtttccttctttttaaatcgagtatatgcgtttttggcacaaatcccccataagcgatgtcgctggagatccctaggtcagttggaccaatcctggtgatgttgactgtggttgctcagccaggtgcctctgctctaaagttaacactttcttcctctttgtaattcgtcagcgttttgtgggaaaccttgagactgtcagacatcgtttctcatcacaccctttcccaccctgggaatcctcgcctgccagttgtcaccatggtgcgtgttcaggggtggctgtctttccgtcatttctcttaaatgtattagtgagttccattactcactaataagggaaagcttcccccacgctcccatgtatttattcacctgtttacttacactagtgtggacgcctgcatgtatgtttatcctgtggagtagagtccactgctgtcatcttcttgttgctggaactgtcccagacgtggccactgggagctccttcgagtcggtgtctgtgccagtggagtgctcccatcattgtctgagctctttcttgctttctggcagcataagacgctccaggcccccagggcctcgcctctgctgaggtgcttgctgtgcaggatttgggaaggtgctctcaggggctgtgggctcccatgcctgcttccgcctcatccttgcagacccctgtgcaggtaggttatttgtaggtgagcaccccagtgcacatagactgatgtagccgggttccccagggagcaggtggcagagttggggcttgcccagactcctgctcttgccctgtggaaggacctatgagtcggaccccacacagggattaggtggggccatgctgggcagcccatgtcagcctggcacatcttggggactgtccacagtgtcagggctgggagcatggtcttggcacatgtaacatgccccgtttctctctttcttctggggttcaggcatatttctggtccatgataagatctttgcctccttcctgtctttcttgccctcgtggatggcccagaatcctttgtagatttcccacagtggcctttcccaggcaggcactggctggcagtggcagtctagacttcctgcctgcctcagtggccttccctgaaggagctgtacaaaagtgacagggagcacaggccactggcccctggggaggtgtggggcatggtgagccacgtccaccacatactgtgtgccaagctggaaaagagtttgggggtgcagaggacaaaggaagggaggtcacctctacagaatcacatggcacttaatttgtctttcctcttccctacccactcccctcctttcttcccagagacaagaggcagctcctgggagaaggcacagcctctgagactcacaagcagatcttttaaggtcaactttgccatctgtcttttaggcaataaccttcactacagctttttctgcttatttttgtcgaaagtcattgggagaatgagtcattgcgtgtgtatgcctgtgtgtttgtgcatatatatatgtgtgtgtatgtgcatgtacaagtatgtgtttgtgtgtgcaggtgtgcacgtgtgggtacttcccctgatttttttttttttgtgacataacttcccctcatttttttgaaaggctgaaagggactcagggtcaaggccatggtgcatccctcctgcagggagctggagctgggtgcctggaagctggcctttgggtcaggcttcagcctcagccgtactgactgtgcctggccaacctctgtcagtcccttcatcaggccatgctttaaggtcctcctctataaactgggggcaatgctagttcctactcctggggtgggtatgagttccagatgaggcacgtgacctttgcaggattttaacattacagtgacataactgtaatttacctactggtaaatgctctgttcatgtcagttagtagaatagaaagtgctggccctgctgacacagcagccatctcctggtttgcgatggacactatctcaggaggaggctgccgtgtgcctgctgcgaggggtgctccctgtttgctagggaggcccagagactgccccggcacctcgctgcacacagagaggccgtgtgtgtctcttgacccttcagctccacactgggaatgagggagaccaggggttagagatgcctcgggacctgagccgggcaccagctcccatctgtccatctgtcctgggctgctgggggagccggctctggccaggactgatgattcctggcacccaccaggagatgcacatcctgcttgaaagctgtgaactgctatccagagtgtctgggcttatcctgttggagcaaaacccctgggctaatatgtaatcccattgtgaaatgtatttcaaggagggcttctacaaggattctaattttacagcagctttaaccaaaaaaaaaaaaaaaaaaaacccaaatcttcagcaaacactcagaaccatggttcctgtatgatgtatagctttcaaaaacactcccccaccccttggaaatataggcagggaagggaaaataaatgtttttttgtgggaggcaggagcattattgaaaaaaactcaacaggctttttaaaactggaaaagtagaacgcgcgcatgttgaaaaattccagggcggctggagacaggatggggtggggcaggtatgtcggctccgcatggatcaggcttggtccagcccgtgttatgaccttccagctgtctgcttctcctctttggcctcagtttcctcatctataaaatgggaactatagtattgtacgcaccatgcagctgttgtgggggttaaatgatatgatctgtcacattcctgttacatgtatgtattcaacaaacatcgactgtctttttcattagtgaaaaccaggtctctctggctgtgcacccgtctctcgtcccacgacagctgctgatggctttcttgtgtacgctctcaggaaatttctatgcattcttttcttcttcgtttgtttgtaatatgaagggaaacacgctagcccctgttctgtgcctggcttttccctcttaaaactgcatctgtgggatgtagatatgaagtttgaaggatacgtgggaatggaccagatgaaggtggggtggggatggtgaccactgtccctggcagaggaacagcggatgtggtggccatgtggtgggaggggcaccgtgtgagcatgggctgaacggctggtgcgtggggatggggaggtggcttgggcctgccacgcgggacagggaagaccaggttgagggtttttgtctgtatcctatggagtgatggagacctgctgacacttatggagcagagggtgacccactgatctgggactcggaaaggtcaccccacttctgctttggtgcccatgggcgttgtgtagagaaggtgtcctgttttggtttcccaagagaggaaatggacctgctggcaggagaagtgggggagagtggttgggagctgctggtgtgtcgcctctcgatttggagggtggggacataagagtgggaaatggctggggcagtgtctctagagggtggctttcttcgatgtgagcctggaagttggtgaaaattgcccctcttttggtgctctcatgggtgtttggatattttgatccccaggtcatctttcaagccaagtacagcatgcaccaacccctccgtggctgcatcctacagcccctgatccactggtggactgctccacacctgctccctgttggggtctctgtcctcctgggtgatcttctagagcaggagtctcaagctttagggtatatgagactcgccgggggtcttgtctatgcagcatgctgggtcccttcccagagctcctgacttgacgcatctgccatgaagccagtatgaacatgcatttttagcaagatctcaggtgccgctgatgctgctgatctgaggacaccctgctctggagactagaaacatctctggcctggtctccctcccatgctgctcctgtgtagcctgcaggagacacctcctggcagccgggtgtgcaggctggtccagcgcagccacctcagtccctaccggagtggtctctggcaactcgggtaccattctctgggcctacccaaggaacatattacaggggctggagctgacctgctggagccccctaactcagtctgatggaaagaagacttaaaaaaaaacttgtgatgttaatttaaattttacagaaaaattgtgaagctagtacaaagactttatgtaaacctgcaccctggttccctttcactcttatagtagatttgtatcactaatgaaccactcttgaaacattattattaactcaagttcatactttattccaacatccttagtatttttctaatgccctttttccatcccaggatgccatccagatcccgcatgacatctggacatcatgtaccttcaggctgtcttgctgtgacgccttttctgactttgcttgttcttagtgaccttagcagttttgaggagcacctgtagggtgttctgtagaatgtccttcaatccagaacttctttttaaattcctcttctgcttgcggggcatcttgagtcatggaaatagattctcatttgttttctttgtaaattctgcctagagccagggtctgcagagatctctctggaatctgatagctagaggcctcagttgaccctgaggcaggccccattcctgttagagaaggtgcgtggaactggtgtggttgggaggagtggttgagaatggtctctgtgggcacggggtttgcccggcaggcagctgcccagtacggctgcctgtgtggctgatgtcatgttctcatcccatctgatgcactctccgcaagtcactttcagaaactggaagatcccacttaattctgctctggaatatatttagaaatctattcatggccctctcccaaagctgatgttaaaattaagagatatcatttgtaggatgtcatggctgtgcaggaggaacatgctgatgtctccctggccgcctttggtttcttctcttgcttagggatttgcccaactcccattgcccatctgagcccagctttccccctctgagcccagttttcctcctctcaccccaatgtcagagtgggcacatcctccctgcggaggcatgcaggcttttcctctgcatgcaccgtctctgtcttgcgtgacagcccggggctgtttctcacccttgttacgctggggttcttggctgagagctcctgggcaggggctgactttgagatgaggcttctctgttcgtttctggctggttctagatctgggtggcatttggagggtgcaccgcttgtatctgtgaccgaatacctcagggtttgtggtgagggacgtggagatttctgtgctgcaagagatcttagtgcttctattgtgctggggagaggccagcccatcttggggtaccagggctggaccaaactttagagggggtctgacccaggtgttcagagccagaaatattatttgcaatcctctgcagggaatttaaaaatgaaaccattctgaactctccctccagaattcatggtcgtcagccattcaacaaatatttactggacacctgttttaagcctgtcaccgttttttgagtatgcatatagctatatatggcaggttgcagtgacgactcatgtctctgccttcatggaatgagtagtctcgtgggatgaggggaaacagacagcatagaaatagatgtatgatgggactctaggtggttatagatgcctggagtgatgataaagtgaggctggaggaatgagactggcagggaggagagcccaactgtctgtgatagatggtcagagaggacctcagagcagggcatctgtgcagagaccaggcaaagtgagggagctggtcatgtgactaccctcgagaagagcactagggcagcaggaacagcaggtgcaatggccctgcagcaggcatgtgcttgggtgtggtaggaacaaggagaccagtgaggctgagtgagtgatggaaaggggcaagtttttgatgcccacaatgccaagaggtggccaggggaggatcccagggaggtgccgaggcctgggggaagacttgggctttattttcagagctgcccgttgaagatttgaatggctgcagagtgagatgagattgtgctggaggattcgaaggtcatttagtcagagatgctggtggtttggagcaggttgttcacagcagatgttctttgtgcctgcatcacaattccttggaccagctctgccttggtcttcagctgtggcttcaatcaaccagcatgttgggtgatgagcgctgtattggagcaggtggctacactttcaggaatgctgcaagctggctgcagtgggaagtatttacaccatggcaattggcaaatgtacatatcagctcccttataccacccaaacactttccagcacagcacagccatgagcccagtgctgtggatattctcccaagcatcaaagtgcagccaggacatgaggggagctaatgtctgaaggacaatcctcagctgacgaaatgggagtaaacatcccaggcatgcatcctttaggtgggtgcttcttggagctttcagagaatgcaaccttgctgcctacagctgtgaccctggaaatgcacgtgtgtgggtttgcccttcctccctccctcactctcattgctcccttgcttctgcttcctgagatacctcccaaataagctaccttcacctaagcccgcctgcagctctgcttttaggagaatccaattaagatggtggtagagctagatgtggtgtgagagggatcagatggctgggatgagacagaagagtcctggatgactccaagcgttccagcctgagcagctggaaggatggagaggttctggcggcaatggggaggaaccattgagatgagcaggatgggggttgggcaaatcaatgctctgttcagctgtggacaggttctgtttgagagacctatcagatccccaggtggaaattgtacctggagttagggagaggtgtgtggttggatagagatatctgggactggacaacactgattaggtcaggtgcccacctgcatctgtgattcagttgtgccctcctgcttaggaagcgtctgtgtatctatgtatgtatctatcatccatctatttatcatttatctctcttttttatttatctctcaatatatctatcatctataaatatatgtatattctagcatctagtcatcaatcatttatctatttttatttatgtatcaatatatctataatctatttttcaatatatctataatctgtcatccatctgctaatcgatcatctaccattatctatcaatctgtgtatctatcgtctctctctctgtccatccatccatccatctatccaggcagtgcttgcttccttctgccccctccttagcccatccctgcccaggaaaattctcgtccctgctcaaatgccttcagtgacaggaaactcaccaacctcttaaggcttcggcatggaagtttccaactcatgtggccactccagaatgctgtcctccagggactgtgtttctctctcatgtcctcctcccaagatttatttacactcctcacttgccaggagagagtacttgggagctccgagccatgcgtgttccctggcagggtcgcctgtgtgctggggaagaatgggcccagtcatggggtggagacgccccccagctgcagccctggctcccgagcagaggcggctttgtgcttctcggggacaagggttgccattgaggcaggccagggatgctgtgcaagctagcgatggctgcaggctgaaatcgggcatttcacagagagcaagcactgcactgtccccgcagcctgcacgtgaatggaggctttggccctcggagtgcagccgtgcatggggccacgtgcaggcatttctggctcctggctcccagggagagaggcgagccctgttctctccccgagttctgtttgacaaaattcacaaaaacacaaagaaacaaaaagtacgggagaggatcagttcattctcctgactcctggttggtctcaagacctcccctgttgcctgtgctctggaagattccccatagtacctactaggtgggccagagaaggatggatttgtgggaccctggaaggctgggaagaggactgagaagccacagccctgcgctgggaagagccacggaggttagatcttgttttttgtttgtttttaatacaattgttcacactttctaaacttttttgaaataattttagactcacgtgggggttgcagagcttccctcaatgacagcatccacctttccatggttcactggttggcaccaggaggtggacattggtacagtgaggttaactaaaccaactaaaccagaggccttagcgaattccaccaggttttgcaagcacttttgctgttttttcagtgaataattgaatgaaattttatcacacctatagcttcacgacaaccaggtgagacttgacttttaaataatgaggcgccaggccccttggctcctgaagtggcatgggcgacgtgtgtggatgctgactggatgcccacctgcttccttttctctacgttgtgcccccaccatgctccagtggcaggggcagcctcctcctggcccccaggcctctgcttctctggtgcctgtggaggctcaagcctttaccccacctcccttcttcccaggaaggccctggctgcctgagaaggcccagccttccccttctccctccgctgttctggctgagctcatctcctgtggctgccctagcatgtgctgcagactgggggattccacagcagaaacctactctctcgcagtgctggaggctggaggtctgagatcaaggtgccagcagggcgggttccttctgagggctgtgagggcaggacccgtcccaggactctctctgtggctgtgagtggccgccttctccctggttctcttcacatgatcatcctgcccttccagggtatgagctccatgcctgtccccagaagatctggaggcttccatcttctgctccttatcagacaatggagcggaataaacacggttgcctctctggaattggagcttagtgctcatgaaataaaattctcttaatctcacaattgtcctcaatacagttgcagtgggtggcaccgaatgagtgtcgtgcttgtcaagacagccactgtggccttccgtcttcccactgactgatggcaagtcactagaaggaagcacccaactccccgtgatggcattaaatgacacccgtgggtgtggctgtagaccaggggttctaggcagccaagggggttccatgcagccaaaggaaagaagaaactttcctgcagaatgcatgaatatagggccaggtcctaaagcccagcccacgggcaagtgtgtcctggtggttgccactttccagtcaactgattagtgtcaatcatgacactgatttcctggcaatgtgtgagatgattttaggtggtaaatgaactattaattttataaagaacgttcatatcaggtatatgtctgtttaatttttcttttttcttttttttgagatggagtctcactctgtcccccaggctggagtgcagtggtatggtcttggctcactgcaacctctgcctcccaggttcaagtgattctcctgcctcagcctcccgagtagctgggattacaggtgcccaccaccacacctggctaatttttatatttttagtagagacagggtttcaccctgttggctaggctggtcttaaactcctaacctcaggtgatccgcccgcctaggcctcccaaagtgctgggattacaggcttgagccaccgttcccagcctgtttaatttttcattagaaaaatattgcatttccattaaagtagacgtcaagttttcattttaaactttcttaagaaaacattatattcattttagaccaagtggttctattagagcaacatccataagagtggtgacgtgtgagtgaagttggggagacaccgggtggtgcagttacccagcaccatctagaggaagtaccactggggtgggcggttacctggcaccatctagaggaagtgccactgggtgggggtcccttcacagaggcagggtccagtcccggccaccctcaaggagcttgtactgtcgaagtggggagggggacatgagaaatgttgactcaggggcagagggttcttaggcttatcaaggaagctctaggattctcggtgttctaggggattcgaggaggaaagttacacctgatgggtagacaggggtggttggagggatttggtaaaacgttcatgaagaaggggtgggtctgtggggtttctggagttgaagtgaccaccaccagggatgctggcatgtggagctagcttcatggctgttagctgtcattgtggaatggaagttaaagtgtgcgttgagcagggctgaaagaggcatagacctcccatactgggagagaagccatgctcagggaagaatgcccagaggctaaaagtcagggtcagatgcccatcttaggggcccttggttgccataattatcaaggcaaggtccttggataaagtctggtccggtgcctctgaaacttctatgtgcatacatgtcactgggagtctggttaaaatgtggattctgacgcttgggtagggcctgaaactctgcatttttaatgagctcctgggggatgctgctcctcagatgccccgctcttctgtcccctagcccccagcaacagcaaacacttagtgcctgcctttctgcagggacaggggagggaggtttgtttgcagtgacagtttttgggtagctatggagggaggagagaggtaggactttgtcttggtccagtttacaggggccttgacagaggcaggaggggtgggcaggagttgccaacttttatattttggtcaactagggatgtttaaaaacaacaatgaagaaaaacccgaacatccttggtttcacaacagtataataataacactattaacaccagtatttcccaaaagaaatggaatttcaaatccaaagagtcaggaaggccatatactccaacagaagacagtcttttcaaggacacagagccagcccccaaaacacctcactgcattgtcctcatttttcaaaggacttgggaaacatcaccccaggctggcatggatgactgggctgaggcttgggggctgcggctgtatgaacgggaatgcctgtggtcctcagagctgaggtctgtgttcccagaagcccctgtagagtggcatctggccccggcctgtggtagcctctgtcctttcccaggagagaggttgccagggcctgagcaaacactgacctggagtgtccctgcttctgaacctgcctccctatcgtcctcaccttgtggtgtacgggacgtgtggggactgtatcatctgggctgtggctggcggcctctcgtctaatgctaccacatgcccttcataggccatgatgagccatggcagtgctgactgtgttctaccactgctccaggttcctgagatgctcacatcctgggatgtgctggggttgagcaccaaagctaggggaggtcctagtagcccactcctgttcctcagtccccttgcgtctggctgggaaaaggtgcacctcctccgtctctgtccacgtggaattgaccatcatcctgcacagtctctgcccctggtaattggttctcagatgggctcatgactcaggcttcacgaatgagaatctgttctaggacttcagttgaagcgcttggaaagagttgttttccctccacaagaagtcacagagctggtcggctgtgggcttggagtgctggtggccattttccccaacccagctggagcctgagaatggaactagcccaaaggaaagctgagcaaagacaattttgaaggttgatttcccgatggcattatttgcatccctggatccagcgtgtgtgaagctggcgcacccccgggcttctcagttaaacacttcctccctttcaggcttcagcagctttgattgggcttctgccatttctgattattacagggacttagaggaaggaaatggctttgcccagatcacagggctcatgaaagtgcccaggctggaatgcaaatgcccacctacttcccctcacatcactctccctcacctgctttaagtgcatgcccagtcccagggagatcttcccatcactctttggggattctgcctcactgaaagctcttgaagctgcttcaaagtggagtatcatggtgtttcccgggagggtggttgccgggtgctgagaaagactggcctgcagtgctcttgcttttgcacttccgtcccccaccttgatcctggggtgcacgggggcaggaaggagaggagtgtgggagttgatggggagatgagaggagacatctacccatggcctctgcttctgggaggacctgtcacactcccagtgacacagcgtgtgctagagattaggcttttctcgtgaaagtagggttttgaaatataaatcattctataaagacatatgcatacgtgtgtttattgcagcactattaacaatagcaaagacatggaaacaacccaaatgcccatcaatgatagattggataaagaaaacgtggtacatatacaccatggaatactatgcagccataaaaaggaatgagatcatgtcctttgtggggacacggatgaaggtggaagccatcatcctcagcaaactaacacaggaacagaaaaccaaataccacatgctctcacttataagtgggagttgaacattgagaacacatggtcacagagaggggaacaacccacaccagggcctgttgagtggtgggggtgaggggagggatcttagaggacaggtcaataggtgcagcaagccaccatggcacatgtatacctatgtaacaaacctgcacgttctgcatatgtatcccgcttttcttttgtttttgtttttagaagaaataaaagaaaatagaagctcacttgcctggatactttaatattgcctgggtttttgtgttgtggagggctctgtaagtcatggaaaaggtattctcaggagctgctaatgacatatttaattttaataatgagtcacccatgcccacaatttattacctcctgtggctctggactctggttctttgagtggtataatagggcggaggttaatggataacacaattaattatttaggaggttcttacaaagccaaagactttgtaacagattaactaataggttcctaacttcattatcattttgatttttccaaagaatattttctcccaaaccactcaactgtataacattactgggaaatgtctaatttttacacgattcctctgctcagtttaaatactaatgttctgcttactccgtcactgttcagcgcccagctttcggtcttcaccttattgcctgggagatagatataatggattcagatgttatgagccctggaagggtttgtaacataaggcagtattttaatgctttaggggctggaaatatttaaggcaatattttaattctcatgagggacgaagtgttgtggttgcaagtgcagcctctgaaatcaggcggagctgggtgtgaatcccagcctctgcacttaggttggttacatcacctctccaactccgttccctccttcataaaatgggcacactagtagtattaacctggttgcattgcagtgaagattcaatgagaaaatgcaggtaaaacacttaatgtggtgtccagcacagagtaacaggttaggagtgttggccgtgaacggtggtgatggtcatctaatcacagcatggaatgaggaggagcaagccctcaccctggcctgctgctcctttgttgatgaaatgcctgtggttgttttcacaccgcagcaacagaattgagcattttcccagaaaaatttcccggtctaaactgtttactctctggcccttcatagaaaaagaatcgctgctccctgccctcaaggcagcctcctgtgcttttatcttctcgggtctcctttcagaggcctcattataggtgagcgccatccagcagaacgtcctgtgatgatggaaatggtctaggtctgcgccatgccgcccgggattgcgccgctggccgcagatggttgctgaacactcgaaatgtggctcatgcaacctcagaatggaatttttaaattttacttagctgtaattgatttaaatttaaatagccacctgtggctaatggcaaccacatcgggcagtgcagtgacaccacaccggctcagagtagagaaccagtcacctccattctagcatcctttctgagagtgccgggtggagggtgctggctttggctgaaataaaggaaagggagaaggctgctccttgcattttctttttctgttcttttttctttctttctttctctctctttctttctttctttctttctttctttctttctttctttctttctttttctttctttctttctttcctttctttctttctttctttctttctctttctttctttccttccttccttccttctttctttctttctttttttttttttttgagatagagttttgctcttgttgcccaggctggagtgcaatggcgcaatctcggctcactgcaacctccacctcccaggtacaagcaattcttttgtctcagcatcccaatagttgggattacgggcgtgcaccaccacactcggctaatttttttgtatttattagagacggggtttcaccatgttagtcaggctggtcgtgaactcctgacctcaggtgatccatctgcctcagcctcccaaagtgctgggattacaggcatgtgccatcgtgcccggcctgctccttgctttttattatgtttttgctgattcaaagcatctgtaaatataaaaattgaacttactcttttgtgtgaactatttggtaaacattcacaagcatgaagaaggaagttaagatgtcttaatcccatgctgtagagataaaggattttgggcagtacatttgctgtcactttcaaatatttgtatggcgcgtaagaggggagtcataatgtctgcatggggtgtgcccccacttttctgctgggacagggactacacaaagcttcatattatcctgattaatggctgcagggtgctcggtgtgcagtggcctctctgggcaggtctccgggctgcacacagttggggactgttttaagctgctcagtgatgagtgtccttgctgtgaagtatttctgtgtttttcatgtttgtccagagtggccacgaggtcctcctaagagactttgatcaatgtatgtttctacagaaaatgttagaagctgctgctccttcacattagctaatgctggatcttgcccatctttcttccttgtgccaatctgctggcgaaaaattgcttgtctatattttcatcacttttatgtatttatttttttaaaaaagacatgttcccagaagtcactgcttggaaatatctctggtcatttctcttgcttcttttagtttctgggtgaggccagtggttataagccagttcctgagtctttggacagtttaatgggggcatggatcaggtcgcagatagcagactttgatagcactttgattcaatgagggcctactatgagctttgcaggttttatctcattcaatattcataaccacctgaggagctgggtgctatttatccccattttacaggtgaagaaactgagaactctctcaagtcctggtggatgagggacatagtctggatttgaacagagcatgtggccacctgagctcacactcctggtcagcacaccatgggaggcatggggaggggaaggggtgtgggagatggccaggaagacctggtctggatcggggctctgcttactggctgtgaggctctggacaaagttatgtgacctctcagagcctaaatttccccagctctcaaatggatatcaggatatttaccttgaggttgttgtaaatagaaatggagatgtgtatgaaggccctggcataattcctatacttcactgatgcttgataaatgatggctgttttctgtactattagcaatgattattaatacagtgatgaaaaatacagagcaaagatgataaacagaaagtgtctagaagatagttgctacctgagagttagctattgtttattctgttaatgtgttacagtgtaggtatttctacattcagtaacatcataagcaaagaagactttgcttgccaagggccctattgaaagccctcgatgggtacaggctgttatctcaccaacacagactctgatccaaggtgaccaggagaattttagaatgatctaggcaaggaaattgccgtgcttccaaagcaacctgctcctcaggctccctgtggggctgtctgccccagcttgccacacctctgcaggtttgtggctttgtttcctgtatggggtctgaaggtgagcagtacctttgtttcctgtatggggtctgttctgtgttcagaagcaggactcagggctgctggagctggagctggagcctctgagtcctcagggttctccacagctctcctgaccagctctgctagagcgatgtctctggcagatgccttttccctgttgccctgtggtctggcctttctgctgtaggttaaagaaatcacagtgtgggcaggtggcctagtctgtaagtgtgtcctctagtgacctttgttttacctctagccatgcttgctgtttgtcctttcttgggattacatagttggccaggccaaaacatcttagctcacatgaaatccaagttcacagctggtaaaaatgccacagattaaatgctccatagaaattcatgtctataatggatgcatttctcctgggaattcactccttaaataggatgaccttgtcattgactcctgtccctaccctcaaccctaacgtgaacaaatatgaaatgatccttaaccaaccaacatgctagaataaagacacaaagcattaaaaaaaaaaaaaaaaccaacaaacaatgaggagggaggagtaattcttttggcaaaacttgattccctattgtggttgatgtggctgcattctttttgctcgttgagaagttgctagaagacagggtcagtggtggttctatgagggtggctaccatttttcttgagggactgcttttatctgccaagcacatagttctttacatactttatcttcctgaagcctcatgagagctctaagagattcccattattattatccccattttgagcatgaggaaactaaagctcagggaagtatgggaatagaaaactacatggccagggtctgaatccaggctgttttgctgctggccccaaggtcttagccccagtgcatactattaaatgctgcctgagttccttgacacctgcaccactacccctccttccaccaaccaggtggggttcactggtataagctgtcttagcatgttgaaagtgctcttgtagtacttagaaacactgtcatttaactgctatttaggttcttagtagttgtagctatgttagatggatgggccaagccatagccttgtgaggacagggacagtatccagtttgttatccatcccttatctatgccttatacacagtagagtctccataagtgctgggtggatggatgggtgggttggtggtggatggatggatggatggatgggcaggtgggtgggtggatgaatggatgatggatgatggctaagtagatatatgagtggataggtagatgggtggatggatggatggatggatggatagattgattggtagatgggtggatggattgatggatgattgctaggtagatatatgagtggataggtgggtgggtgggtgcgtgagtggatggatggatggagattgatagatggataggtggatggattggagaatgggtggatgggtgggtgaatggattgacggatgatggctaggtagatataccagtggataggtgggtggagggatgggtgggtggatggatggatggataaatggggatggatagatggatggatggatgggtagatgcacggatggataaatggagatggatagatggatggatggacgaatggatgggtagatggatggatgggttgatgatggctaggtagatatatgagtggataggtgggtgggtgggtgagtggatgggtggatggatggagattgatagatggataggaggatggattggagaatgggtggatgggtgggtgaatggattgatggatgacggctaggtagacataccagtggataggtgggtgggtggatgggtggggtggatggacagatggataaatggagatggatagatggatggatggatggatggatggatggatggatggatgggtagacggatgtatgggttgatgatggctaggtagatatatgagtgggtaggtgggtgggtgggtctgtggatggatggatgagtgggtagaaatccaggcagctggaaggacagtggtggaaggacaggtatttggaaggacagtcatttgaagaggaaacaaagacatagtatttgaggggggaattatctgcacagcccccaatttgctgacattagctcctggagaaaggagcacctgcaggatgagcatttcccacctgtctgttcttttctcttggccaagaggacctcacagcaatgctctggttacagtcaggggaaggctgtactgaccacacaaagttccaagaggggacaagcatggtgtgacctccagccaacttgactctctcatcttctccccacgttcctaccttggacctcttctgggctggccgattgaaagagaatattcataaagctgactttgaggagtgttttgggaggcaggcacaaagattattggtattgagtcccagttctataacttactagctgtgtggctttgggcaagttaatccctctctctgagcttcagttcccatcctgatgccaaccttgggtactgctgagggaggaggggagaagggggatggatgcacatgaatggaaggcagtagcagttgttaattccccttatctgactttccattttactaccttcatttcttttctcttagactcttggaagagatgtactgtgctgggatataaatttttgaaacctgttctctttcctcttccatgttctccgtgataatgcaggaaaaaaactcgcaaacctggccatgatgcccctaggccgacagaggctttcctagttccaattctggcattgtaagagagagctctatggaatagcaaaaaacaggcacacttcatcctgtgcatgctggggttgaggctgtgaggtgtgcaacaggacagtagagcatagcagatgggttgatgagctgtgatctggattcagacctacttgtctcagaccctgggtcagcccgtcagcagctgagcaatattgggaaagattcttaaccttggatggttggtaggatcaagtacagtcagtgtagaaatgcttagctcaccacatggactcaggacatgtcaactctccctgctttggctataattactatcctactgtcaaggaactttctctctagttgggctaggtcatgtgcgcagaagggttggaggacaaggtgttgaagaaagatttctccaaagatcctggttggatgtgagctggatagagcaaggctggagagtgcagatgcccctggggccaggcggtcttcaaccagtcttggtgagaaatagtagctcgactcagctttggggtgcagagacactggggaggggcggggactgtagcaacctaaagtgctcctgccctgcctgcagaggatgatctgcacagccctgctcattatgatgacatgggcatgtgcgtgactgtcagctctttggttttcaagagaatttggaagtctaggtttccatgcatcaaaccagtagtagagaaggcaaccatggggagaacctaagtcttgtttctagagagatcatagggttgtaaattttaccttgcatctcagagaagggcagtgctattttagattagggaggttgcaaaggtgatgaactccaagaacactgacaaataccattatcattgcaaaagaatcttaaatgtgtctttgaaaagcaagcatttggcttctaagttgtaaaaatggaccaaaaatgaagcagtagagtagggactcataaccaagtttatgccattattgttacaggtttcttttactgtgtttctctctatatatatgcacatctatataaatatagatacatagatatatggggagaagatatagatagagataatgtatgcatatatatacatattatatttgtctgggttctccagaggaacaccatcaataggatatagagatttatctattgcctatctattcatctatttatctatctaccaatccatccatccatccacctctgttcatctatccatccattatcgtatctatcatctatccattcatccatccatgtatgtatgcatgtatgtatgtctctctctctctatcattttcatccattcatccattgtctgtctatctgtctatctagatgtattagaaggaattggcctatgtgttgtggagtctaaaaagtcccagcagtcagcaagctgaagacctgagagagccaatggtgtagttctagtgcgagtttgaaggcctgagaaacaggagagctaatggtgtaaatttcagtctgagtctgcagaagactgatgattcagctcgaagacagatagagagaattctttcttattccgtcttcctgctctattcagtccctcaatggattggatgaggcccactcatgctagggaaggccatctgctttacccagcctattgattcaaatgtcagtctcatccagaaactccctcatgggcacccaaaataatgtttcaccaaatgtgtgggcaccctcaggcccagtcaagttgacacattaaaggaaccatcccatgcatatctatagattgtgtgtgtatgtacatttgtgtatatataatatataattatcctgttaaggatgtctcacagccttgaggcagagattaattgtgacctggtggtttccaatgtttctgtatatacaaataaattatgcagcaatgataccctagtctcattttattaattgctcttctattagtctgtttaaagtcaattaaacctcccaaggcccctcacggaggaacctctcacaaaatcagtctctgtcacttaggaatcctgagtggatgtcacatggctgtcctagctcctggggagggtgcagacaacatctctgttggaactcctgggtctgtgggtgatcattggcttgcattttgtagtggcatggcccgtggaggtccggatgtagagaaggcagcctttctgcagagcgttagaatttgggaagaagtggtcaggattagagaggaaaaaaaagacttagacatggacaaggatgccaccccagcttacccttcctctagtttcctggacttttgcagggttcggtggataattagttatttgcttgcttggttggtatctgttcacttttatttcttttagactttttttttttctgattagaacaaaaattatatttattattgaaaattcagaatacataggagattatcaagaacatcaaaagcattcacaaatccccccacccccaccccagagataacccctgtggctacttttgtgtgtgttcctccagtacttttcctatagaaacatttttcccgtgtcgggattgttcagcctatatcctttattaaattaatacatcagaagcttttctccacactgcttaggacacttgggaccaaatgctccagaataggaatttgccaccatttattttcccattctgctttcattggaaactgagtctggcttgaggcttttgtttgcttctttcttgctatagtaattgggatggacttaaggctgcctgcctttttgtgtacatctctgattatttctttaggctaaattcctagaagctggaacccggggcagaaggaatgaagattggaaacccttggtgcatgacagcaacttgctgtcctgccaacattggggcgtttgcctacagaaagagctctctggttgaatcaaagaattttaagaatttaattcttcttcttgttttttgtttgtttgtttgtttgtttttgagacagagtctcactctgtcgcccaggctggagtgcagtggcacgatcttggctcactgcaagcaccacctcccaggttcacaccattctcctgcctcagcttcctgagtagctgggactacaggtgcccgccaccatgcccagctaattttttgtatttttagtagagacggggtttcaccatgttagccaggatggtctcgatctcatgaccttgtgatccgcccgcctcggcctcccaaagtgctgggattacaggcgtgagccactgcgccggcctaattcttcttttaaaagttggggatcagagtaaggtgagaaggtatcctgcacagcatcaatgcacacagcgcacattaaatgagtgctattccacttcatttgtagtattttttttcccatttgtaggaactacttttgtgcctgacttccttgttcctttaaatgagccttaaggaagtagtgttgggggaattcaacacacacagagcagttggtctttattatgattttaagcatcttgttttcatgtgagcaccccaactttgccttttgctaaattttgcaacaagttttgagtaattctgcacaaaacagtgcccttgctccaggaggagaacagacatttgctcgttcttcacaggataattagactctaaaattagaagtcaaacactgcatgttaaaatgcatctggataaaatcccagtgggagaattaatccttcttggcagtgcaggggaacttgggtgcacgcctgatggagcggcgagaagctgagagggagtgaggcagcccctctgtgtggagtgttcagggcaaatgcacgggtgctggtgacgcagtccctttacttgtctaaaagtattggattctaagtgaaaaggggggtggggatagaaggccttctgcctcgcctcctgtagtcacagtttggatatcctgtgaaagtagcacttaggcaggcattcggtcctgcttggcgttgtttggtggacttgttagagaacactactgactgtgtttgaggaaggaggtggagcagagggctcagggcttaagcggcatctcctcaagggcagcaagagacctggaacgttccagagtaacccctgcctgcatccgtcggacttgccaatacacactgagaaactgctaaaggttatggatgcaatggaggcttctggtatagtggggaggaaaagcctccattatgaagtcaaaggccattgcgtgcctgcagtgtgcgacaagagctagtggttgcagcaccctgatgggcagaagcttccctcacagagctatggtgatggagaaggcagctgcaaatcaagtcattaccagcaaggttataaaattatttgattgcatttcgaagtgaaaaacagttttgaattaacttctatttgttgtgatataaacaacagatataaaaagatataaaaggaaataaacagtgaccatgacattggttgttcagtttcaacactatcttcgggttccctggtccttgtcctccctcattcgcctcccccaccactgaattgtagactccaacagggggcgggagctgagtttgtttttgctcccagctgggactccagggtctagcactggcctggtgcttagcagcctgtagcaagtatgtgttgaatgggcaaatgtatcctttggcggtacgagacagaagctggtggtcctgtgctgcctgtggccagagcacttccagcatacggggccaggacacatttgccctggtgtcccaggttgctccaggcacaggctgcacctcctgggggctctccctgcaccagcctggtggttctctgtcgcttctcctgcaccctgcgccttccctttgtgtcacatccctacctcatcgctactcatttgttggccagtgttttttttagaggatctctttttataaaatttcagtttttattttaggttctggaggtacatgtgcaggtttgttaccagggcacatcgcctgatgctgaggctggggcttctgttcattctgtcacccagatagtaaacatagggcctgacagcacgtttttcagcccttgtccccctccttcgctccctccctttctctttcggagtcccctgtgtctgttgttctgtatgtttgtgtgtactcaagatttagctcccactcatgagtgagaataggcagtatttggttttctatttctgcgttaattcactcaggatagtggcctccagctgcatccatgttgctgcaaaggatatgattttgttcttttttatgttagcagatctttttttttttttttttttttacccactctctgattctccatgcatcatgagtcccccaaaggcagggctgggttaacctccctgggcccagagaacaggtgctcagtatttttagaatgaacaaaagttctcttgtggaatcatgagggaggtggagggaggaaggaaggagggaagacctctgccctggctctttctcctgcctgaaacagcctccctcagatcccagcctgtggcgcctttctcgtcacgtgtgtgtccgccccacactgccctccctggcctcggaggctaaagcgctggcccctgccagcctggacctctcctcgtcctgcttgatttgattctgagcgtgctcatcaccatctggacatatgttattcacgcacaattaaatgttgcttatattgcatataaaacataaatttatataatgatatacatgtacatatgtgtgtgtggcgtgtgtgtgtgtgcatatccctgtcgacaccaccagaatatgttttaatgaaaccgtcatgttttaatgaaaacagaaagccttctgtttcatgtcgtgacgctggaatgaaaacagtctctcccagcatctagctcagtgcctggcacatcatgaaagcttaataaatacggctagaattaatgaatgagtttctttcccctcccctgtcctgtatttttaataaggctgttgagcctggggcctctgccctctgctggtcactatcatcacacagcctcactcaggaggcccctggccccgttctgcctggagtgttggcaggtggcaagggttgtaagctcctgcccagtcccgtgggcagttctaggatcttacccccagcccctgcgattctgaggggacgtgtcagtcattcagcctccagccagtccctggggatgtctgagggaggaagtaaggctcaagtcccctgaagtgggcagctcctgtcatccacagctgctgcttgttagtgggagccctggggccctgggtaaatgtcctgccagagctgggctcactctggcctcctttgtatacctgggggcaaggtttagctattcagcaagggctgttttaaaaaattgggttggttctggatattataatacctttttataaaagaccacgaagaaaactacattttcttggtgacttttacaataggagcaagttaaattttctttcttcactgagttgtcattgttgccttttttttaaaatcagtttttccctgtcaaaagaaagtaccttaccatgtgatctactgaaatataggagttacactgaacgaagtgaaaatgaagcttgtttgtcagtccttcctgctgactttctcaatctgggcccagtgtaccctgggaggcacagccagagcccagggagtgaatccgattgttcagtagatgcagttccccagttcaggccctgcaactaccagtccaggcctggaggggagcatgcatcccccaggaacatgactcggagctggaatctgactaggcataggagttaattgggcctgaggcagggagggtgctgggaagaacattctagggagagcagacagcatgtatgcatgcacacatgttctgtggcagaagactgtgtgagtgtttggggaggtatgagtgactctgaaagggtttttcccagtggagcacaaagatgcccgtgttgtgggaggaagcccaaggtgggaccaggcagggctcattaaagggatttttgtctttaaatgaagagcaccaggaaagcctctgaggattttaaacatggtggttgcagtcgggcagatcagcttggcaaagatttgatgactagggtattagtctgttctcatgctgctaatacagacatatctaggactgggtaatttataaaggaaagaagtttaatggactccacagttccacatggctggggaggcctcacaatcatggcggaaggcaaaggagaagcaaaggcatgtcttacatggcagcaggcaagagagagcttgtgcagggaaactcccatttataaaaccatccaatatcgtgagacttactaccatgaaaacagtaggggggaaccacccacatgattcaattatctccatctggccccacccttgacatgtggagattattacaattcaaggtgagatttgggtggggacacagccaaaccatatcaactagcatggagaggccagtgtggagtttagggtaccaggtggaaggccccctgaggttggggagggtggtgcagggcagcaggtggcagccaggcccttggaggtccattggcaggactgagcagcagggtgttggagtgacatgcaggtgggggtacagtcctcttcattcttattcacatcttttctgttgatccctttccatctctttccccactagtttcctgtgttcttttgatccacaagctccacatttcctgaaagaaatgaatgccattattatcacatacagccacacacacaccctgtacaaactcatctcccacaacgcccaactccctaacatggttgcctaaatcagaattaagctccctggattcaggtcccagtcccacccttaatgtgcttgtgaatctcaatgaggtgcttggcctttcttggctgggtttcctcatctgtgaaatgggggattttgcactgttttatttttctactttttgccagccttgcaactttccataggactttgcttcatctagactgttggtgtaggaaaacatccttttggttaatggatagatgttataggctaggtgccttccctccaggaggttcctcatcttattagtgaagattctgtagttgcatatggctttagttgctgttgagaaacctacccagactggcttcaccatcaaaggtatttattgactgacaccgttttgtgattagtccagggggagtttggcttcaggcccattgaccacagggtctaattatactgttcaccattgcttctcgtccctctcactgcctggttctctgctggcctgctgtgaggccacatttccttctcctctgttcccccaggctccagccattttgaggaaggaggtgagtttctctttcctattagtgaagaataccaaagctgtaggaatcatatcttactggcctggaggtggtcagcttctttaaaatcacatggcctgattgggcaaggggtaggtcccttgagggaaatcaaggtgctgaaccagaaaaggtggtgatggcaattgggtaggaaaaaataagtccatctcagagtctttaaaaaacatctttaaaatctcctcgtgatttcttaatcagcaagagggtggcttaatctgtttatcccagaggccagggatggagggtcagggaggggttgaccttctggggctgatgatagcatttgtttttcttcccagtccaggcttacgctgaccttggtacttaaggcagggcctgtcctttcctctgctcagcaacatccatcactgccatgtccttttggcactaattaaagaggacacacttggattaggaaaatgatggattgggttgatgtgatttgatgtgaggtggagtgaataagtgacaagctcgcccttagagaaaccacctcggagtagccacaggcagcctgtgtcccccataggagggactgggacagcttggcaaccacctaccccagaacacctgctaggaggagagagtcctgttgttccggcttgggaatgtctgtgtttacatgatgaggctgggaatataggcatcgaagcatcagtttcctttgctccatctagatcagcgttgttgatggatgagtatggtaaagagttggatgattttcccccagagtttccatgctggacaattgtttatttacttgagctaattactgaaatttttttccatgacttggcctaatataaaaaaagacactaatgagagtgaggttttatggtaagcaaattgaaaagcaaatagcaaataactcatctatgaaatagttataagaaaagttattatggtaatggttagggcaaaacaactctatttaattcttgatgcttatggagattccagccaagatatgtgtattttccttaaaaagatttctttaaagcatgtgtcttaatttaatcctgttatacacaggcacatctattaatgaagtaaattcaacaaagagttaattataaatagcagcaacatgttttctttctttaaatattgtatatatttcatgttgtaactcgggggataaattatactaggtggattttgtggtaatataaaggacggttggaattttattgagtatttacttttatttggttttgaagaagagcttctccatacctcagactatcaaaaatcattctgttagagtcacagaaattccaattaagagcttagatgccaatacagactgattattttgaagacttttttcagttcatgactcagttaatattcagtggtgtattttctgtagtttaaaagtatcactgataagttgggagtatgccttccatatgagatacaaattgtccctaaccactcaatcaatgtttactttacatgttaaaaataagaaactaagacctcataatgtggttttaaaggttcctgttttttgccctgaaggtccaaaggtaaatttggcacatttgtcaaaatatagatgaataatttatagatgtgcatccattttatttttataagtatggaaatagatataaagggatttgctggaagaatttcttttggcaaatgagcaaaaaatttaactataaagaatgaaatactaggctctagatataaaataatattcacaatgcaatacaaaatgtgcaggcatttttggtcatattttctatgacaggtttcttagaaatctgtgtttctactatgaaacacatgaaacaaagaaatatttatacatcagcagaactataaattcaaaaattcagagaaaattccaaatgggtgtgatgttgatacttgcatttttctctaaaattaataaggtatgtgtgtatatatctgcatatacctatgattcatgtaaagggttgcagatacaaagattctaagttcataggtataagaataaatatatgaagctgtatcctgtcttttgcattatattgattgttctcgttggggggagggcgttaattttaaaaagtcaagtgaaagtaaattttcccatcaaaggaaggcactattgctttcaaacatcatcatattcaatacaaattaaaacaatgaactactgtatctacccatcagactagcaaaaatcaaagcatataacaatggcaagtgttgccaaaggatggagacctgctgatgttagtgtaaatgggtgtgaccgctttggagagcaatatgacctatcccgttgagctggggacactatgactcagcaatgcttctccaggccttttccctggagaaaatcacatttgtaagtggcaagagaattatccaggaatgttttccaatgcgttgatagcaaaaaaaaaaaaaaaaaaaaagtctcaggggttgggggtggtgggacagaccgttgatagtggaatgagaaatcgtaaacaagaaggatctacccagaagttgccctagttgttacctctgcagtgtggcagggttgggggctatgatagggcttctgaggtgactgtggaggcttacatttgatctataatgttttgtttttttcttgtgtcttttaacaaaaagaaaacctgatttaagcaagatgtcaagatgttaatctttgttaattctggctgttgaatgcatgaatgttgtgtgtgtgtgtgttgaaactgttaaaaaaaaatcatctttgggttgaccatggtggtgtacacctgtaatcccagcactttaggaggccaaggtgggagaatcatttgaatcaggagttcgaggctgcagtgagctatgattgcaccactgcccttcagcctgggtgagagtgagactttgtctaaagtaaaaaatgtaaatgaataaatacatcctcccattacattacattttctaaagtagcgtaacttttcatgtcagaaactagaataaattaagtcactgaatcatgtagtaaattatgaactattgcctctatagttggttgccaaaatggcctgccagtgtctattaatcaatataaaatataaaaatagaacatttaaaaattaaagcatcatgttatattgccattaccagctagccatatgaaccttatggaaggaaatctggctatatttagcaaaattacataaatagtccccctttggaccagtaatcccacttctaggaatctatcccaaaatatcttggcaaatggtaaaatagcacacaggcaatggtatttgttttgccattattcattatagcaaagtgttggaaacaatgcacatatcacgaagagtggactggctggataaataatggcatagccagacaaaggggtatcggaagacaataaaagaaatgagcgtgttctctctactcacatggaagtcatctccaggatatatcatagtattcattagtcagagttttccagagaaacccaaccaacaggatctttttggtaggtaggtaggtaggtaggtaggtaggtaggtaggtaggtaggtaggtagatagacggatagatatggagatacatacagatataaaaggagatttattatgaggaattgactcaagtgattatgaaggctgagaagttctacaatctgctgtctgcaagatggagctccaggaaagctgatggtgtaattctagtctgagtctgaaggcctgagaaccaggggaactggtaatgtaacttccagtctaagggcaggagaaggtccctatgctagctcaagcaggcagacaggaaggaaaaaaggctgacttcctcctttatctacctttttgttctattcaggcctctatcaggtcggatgttgctcactcacatgagggaaggcatgtgctttactgagttcaccaattcaaatgctagtctctgatagatgtggtggctcacacctgtaatcccagcactttggggtgggggcacctagcagggaggatcacttgaggccaggagttccagactagcctgggaaacataacaagaccccatctctgaaaaacaaaagtaaaaaattagctgggcatggtggcacacacttgtctgtagtgccagctactcaggaggctgaggcaggaggatccattgagccctaaagttcaaggctgtagtgaggtatgattgcactttgtgccactgcactccagcctgggcaacagagtgagaccttatctcttaaaataaaaaatgctaatctcatcaaaattagcattaatctactctataatttccattagattcttttaaataattagataatttctgtctctttattgacattatctgtcatcataccttctctttcctctttaagagtgtacattttttcatcgagattagcattttttaagatctggaaatacccttgtagacacgtccacaatccataatatcatttaatctggaaacctgtggccagattgacacataaaattaacatcacaatcattgagtgaaaaaaaaatcgggatatttttatagaatactgcctttcatgtaaaaaagagatgtgttcacgtgtgcattttcatgtgtgtgtgtacttagattgtttaaaataaatgctgggagtaaaaagcgagcactaacggttgcctatagtggaggaagtaacagaggggagggcagaaatagaagtgagacttctatgagtgtactttgttatatgattctgaattttaaagtgtgtaaatatttttacatattcaaaaaattaaaagggaaaatattcttataattgaagacagatggaaataattgaacctaactatatatcaagttggtagcttaacccgagaaagtaattttttttttttttttgagatggagtcttgctctggcacccaggctggagtgcagtggcaccatctctgctcactgcaaccttcgcctcccgggttcaagcgattttcctgtctcagccttctaagtagctgggattagaggtgcttgccaccatgcctggttaatttttgtaattttaatagagacggggtttcactatgttggtcaggctggtctcgaactcctgatcctgtgatccacctgccttggcctcccaaaagtgctaggattacaggcgtgagccactgcactcggctgtgagaaagtaatttctttaagtaacactaaaacccagtattttaactgtatatccatagtggggtggaatttaaggatgctagcatatgtaaataaaaagaatcatatatttcatgattagtgttattattagctgtaatatggatgttattattttgaaattataggactaacttggagaaagcaattaagcaatatgttaatgttgttatgaatcaagattcttattatgaaagaaaagagataaggtataatattttttaaagttatctgaaatcctaaaatcttacatttaaattagaaatattaatattcatgatattctttgctcttaaaatatctatttcataactctgtctactgaaaaagcctaaaagcagtgaaaaccctatagcaacgaacgctttctacacccagattttgtgtactaaataccattccccactaaaacgaagcagagttccttggagaagtgactgcttcctggtctaggatactttattatgccagaaagcaaataagctatcaaaggttaatgagatgattgcaaaagaattgaatgattttctgctggctaagaggaattgcttaatacatttccaacaggataatgactagaattgattgaaacacatcagaattataaaaatctgtgccttcagatggtacttcaaaaaataattggtcaccgttgtatattgctagaacaccagctctctattctgaaagttgctaaaaaaggaataagaaacaagcttttattctgccttcctgttttatttatatttcagggtaaccaaatagctgatgattgaacgtcttctttatagaaaaattttaattaataaatgcaaaaggaaagaatgagaaaattaccatttgacaacccaaatgaaataacaggtgtaggcaattattatcaataggtgttaacagcattaggtaactatcaatggggaattttataatggataaatcaggctgatataacctgaatgtactgatctcattttacctctctaaaggtaggacaaccagaagttatatgcctcctaatatgtaattggaaatataaaccactgcctctaaaggattctttcctaaaaaattaagcctgaatgtgaccaagcttttaaattttactaccagttttcaggaaatatggaggctaaaggaacgtgttaacaaattgaccagcttctcaaataaaatatggaaaagtcacatcactccagaaattttcccagtttactcttcgagccaattcctccttagctcacagagacaattactttccatagatctgtcaccatagattatcacataagtgcagtcatacagttggcatttgtgtgtgtgtgtctggattccttcactgaacataatattttagaaattcattcagtgtgtgtatgtgtgtgtgtgtatgtgttggtttctttgttttattgagtacttcattgcatgaatatcccataatttgtccagtctctcgttgcatatttgtgttttttccattttctggctgatgtaaataaagcttctgtgaggattcttgtacaagtccttttgcggatctatgtttttattttaattgtgtaaattataaaagtgaaattgctggaacatagggtaggtttatgtttaaaaagaacttccaaatagttctaagtggcatgagttctagttgcttcacacctttttcaaaagtgagtgttatctttcatttaattttcccagtcaggctgatatgaaatggtatctcattatggtttttaaatttttttatatatagctttattgagatacaattcacatactatacacttcacacttttgaaatgtaaactttaattgttttaaatatctttccagagttgtgcaactatcatcacaattggtagtctttggctttctaggagtttgtccatttcatctgagttactaatttattggcatgcagttatttatagtattcccttataatttatttctgtgatattggtagtgttggccccttttacactcttgattttagtaatttgagtcttctctctctcttctttatcagtctagctaaagatttataagtttattgatccttcaaagaaccaactctttattttattgattttctctgttgtttttctattctctatttcattaatttctgccctagcctttaattccttccttctgaatgttccaggcttagtttgttcttctttttctactcttttcgagtggaggatttggcttttattttgagatttttcttttaaatataggaatttagagctataggcttctatttaagcatttctgtgactctgtttcataaattttgcttcattgtttcttcattttcattcatctcaaagtactttctaatctcactcatgatttattctttgactcattggttatttagggccatattgtttaatttccatatgtttgtgaatcccctaagtttctttctgttattgctttctaatttcattccattgtggtcagaaattatactttttatgatttcaattattttgaatttattgtggtttgttttatggcccagcctatgatctgtcctggagaatgtcccatgtgcatttgagaatgtgtattctgctgtttctgggtaaagtgttctatagatgtctgtcatatggtatatagttcatttatactgttgttcatcttttcttttttctccttaatcttctgcccacttattctattcatgagtgaaagtgggatattgaagtctccgatttttattattgagttattttccctttaactctatcaatatttgcttcatatattttgggggtcttatattaggtacatatatatttatcatttttatgcctccctgatggattgactctttcatcactgtttcaccatcatctctctatatctatatctctagttttagagtagctttatctgatattggaatagccactctagcttttgtatgattgctgtttgcatgctatatctttttccattctttacttcaaactgtttgtatctttgaatctaaagtgttttctcttgtagctagcatatagtagtatcagatttttattcagtctgacagtctttacttttgttggattgtctaatccattcacatttattgttataatggatatagttagatttgcatctaccattttatttttcattttctatatctctcatgccttttttgttcctctatttttcctttactgctttatttggccttaaatgagtatttttagtgtaacattttaatttctttaatcattttttaaaaatttattttcttagtggttgctgtggggattaccatatacatcttaacttatcagaattcttcagattcatactaacttaatttcagttagatatagaaacattactcctgaatagcatgattttttcttctacctcatttttgcgctataattttatacatattacatctatatgctacaaactttacaatacattgttacaattaattattactttatatgaatttatgtctttcaaggaagctgagaaaataaagagcaagtgctcatttacagagtctgttatcttaaccttttaatttaccatttccggttctcttcatttgttcttgtggattcaagttactgtcttgtgtcattttcttactccaattcatctttgctcccatatacttcctttgcgttattgtcaaacattttacatttctgtatgttataggcacaatgatagaagtgtgttgtgtgtgtgtgtgtgtgtgtgtgtgtttgtgtgttattttatgcaattgtttattaaatcagtgaacagaataaagcagaggaaatatgcattcaggctgtctttcataattacatcattacctttactggagctccttgttttgtgtgtgtgtaaatttgaattactgtttggtgtcacttgatttcagcctcaaaactttcctagcttttcttatatggcagatcttttagcaatacattatcctattttatttatctatgaatgtcttgaattcactttcatttttgaaagatacttttgctgggcataacattcttggttaacagttgttttattttctccttcagcactttgaatatatttcatcccactgccttttggactccattacttctgatagaagtctgctgttaatcctattgaggcatccttgcagtgactagtcagttttctcttgctattttcatgatttttctctttgttgtttctcaacattttgatttttatgtgcttgggtgcaggtctctttgcatttatactatttagaatttgttgagtacctgggatgtatagattagggttttttcgcactaaatttggtaggctttagccattatttctttgaaaaaaatttctgcttctttttcactcttctcttattctggtactcccattatacatatgttggtccacttaatggtgtctacaatttactaagcctatgttcattttacttcattctttccctctgctcttcagattgaataatctctgactgtcttcaagttcaatgattcttttttctaccaattcaacaaagccactgttgatcccctctagtgaattttgaactttaattattataattttctactgtataatttacattagattattttaaataatttctatctctttattgacattatctatttgccaacataccttctctttcctctttaacagtgtacatatttataatattttggacatatttataatagttactttgaaatctttctaagtctgacacctgggccctttcataggcagcttcttttgaatgcttttttttaaatgtatttgttgcactttcctgtgtttttatacatactagatttttttcaaagctggacgttttagtagataatatattttagcaactctggatacttgttttcttttcctctgagcttgccattgttgtttgtttatgtgttttgtgacaggaataggctattttagtgtttatttctacccacagtgtggagcctttggtgttacttttctgacgctgcagccttgggagtgtgcacagtcaccttgagatgatagtagttttagcatgtgtctctttgacttctctcttctgcctccttccttaatctccctgttaatctgtctgcctctgttggtatcataccaagctattaggctccactaactgccaaattattgctccattatttttgacaatgtccagggcgcatgcattcctctacaacctgatccagttaaatttgaacccctttgcaaaggtattttttgaggtcagtctttgaggtttgaccaagagggctcttcttagctgtcttgctctgatcctctctgataaactatctggcctacaatttagcttgttgccatcatggagctgtcagccttctatacctgttttcatgcttacttgtcttttttttttttttttctctgcctattctgtcattaagaccatctaatgaatgttttaaatgataatatatttttcattatagcatttccatttggatatctattgcagtttccatgtggttcattttaaaaatctcttcatacatgtttacctttcacacactatttttaaaaactgctatcacgattatttcaaagttgtgtgataatttcaatagctgggctatttatgaatcttcttctattgtctgtttcctctttttgatcacaaatcaaatgttcttgcttcttcaggcatcatagtttatactacatgtcaggcattctgtgtcaaataacagcacattctttttctttccacttatcagagttggaacactgagtcagtcgtacctgtagatcagctgggtctgggactttttttttttttttttttttttgagacagtctcgctctgtcaccaggctggagtccagttgtgcaatctcagctgactgcaacctctgcctcctggattcaagtgattctcctgcctcagcctcccaagtagctgggactacaggcacgcaccaccatgcccagctactttttgtatttttagtagagacagggtttcaccatattggctaggatgatctggatctcttgacctcatgatttgcctgcctcagcctcccaaagtgctgggattacaggtgtgagccaccgcaactggccgggtctggagctttttgtagctttagtttcattccatgtattaccagcttcgagtgcttagagggaagggtcaggatttttcccttaccatagcttaggctctgagcactgagtggtttctttgtactttatatctgcagtactagctttctgaaccttggagtgctttgaccatgccacagcccggccagcagatgcaggggtcacagagagctacgtttgttttctagtcccactggagtgctccctctgccctgctactcagactttgtagggcatctgtcctgccctcagtaaagacttgcaatgccctggagaggtttctcccagctgtcttccctgcccccagccttcaataattgaatgtccggagttcccaggatagatttctcttgagtttcctccttagccccccactttcagaggacactgccttttacttaggtgaggccccacatatctctggggttcttgcaggtttcttgctttacctccaggaagacctgtacaaaacagtatccagtggttaaaaactcactctgggctgggcgcagtggctcacgcctgtaatcccagcactttgggaggctgaggtgggcagatcacgaggtcagaagatcgagatcatcctggctaacatggtgaaaccccgtctctactaaaaatacaaaaaattagccgggcatggtggcggatgcctgtagtcccagctactctggaggctgaggcaggagaatggcgtgaatccgggaggcggagcttgcagtgagccgagattgcgccactgcactccagcctgggggacagcgagactccgtctcaaaaaacaaacaaacaaacaaaaaactcactctgtggcttgggcttcttcacattctaatctgtcatctggccaccagaatttcattaaagtatcagcaagtttctccttcctccaatctatggcaattccctgttattgcactactgtcaggggtgaaagcagtcagctggcaaatgccttaaatagtgttttctatcacttcatctccataatctggatttcatacaaaagttagtcatatataaacactgagtatctacagcaagaacatcattctcttggagagccagaaagtgagttgttttatgaaacatttctaatttagtcaattttccaaaaatagggaaattatacaatagtcattgcctttgcctatgaaaagtagaaagaagggaaatcaggagaccattgcttcatctgtgggaaacactttctatttgtccttacatatattctttgtttttccataattctgagggataaggaagagaatgtggcagcctgaatgtctgtttgactgtatctcttcacactgtgattctcattttcctaatgtctgtttcagaattttaaagtgggcagtggattatgccagtttctagatcctcctattaccttccagggaaaggaaaattggattcgattctaggggcatgattagcagaagggcacgcccgggtaccgtgactttgttctgaattaaggaagtttgagtaagagaaagcactttttcctgctggactgggctgcttgttgatggctgtgccgttaggagtgtggagcaggatggtgtttcagacagaggtcctgagcaggagagagcaggatgtatggaccaacgacaggcccatgagtctggaaggtggggaaggggggagcatgcacgttgctaatggagagagcacgtctcagaggctgcatcctggcggctttgtggtcatttgttataacagccctaggagactcacatactctccttcaccctctcacagccattccctgtgagaaccagacagagtggctgagttcatcctgatactcaatggacaatggacaggaccccctttttaggacttggttcttcagccccatggcacaatgtgtaccagcaaatgggtttggccaggtcctcttaaacaagcttcaaaattgtccaacttggacttccacagggcttctttctgtggccagagatgccaatacatgtgattttctgcatgcatgtggtcttggctccttggactccaggttggccacgcagcgacagacctgcctctcggtgggagttctcaggaagtcaaatcagatggaaacctgatctgtgtgcacgactggcttcggcagttaggtggtgtgaaaaatgaaatttctactggcttctcttgtccacagggtgaccgctagtggcagggctgcttgctgcggctcctaatctccttgtgggatgccttgggttggatcagtttctcttggcccctgtgaaaggaactcgcggtggaatattgtattcggtgctgcacaggagaccccatttagagacaggaaacttgtgcttgaagggcactctttgtgcagctacagacgattcattcattccttcatttattctgtcaccccaaatctgtctgcatctactgtgttccaggcaccgcacagggcactaggattctggtggtgaacaagaggccggtctcaccctcaaaggcatgtagtcttgagagacacagacactagacaaggaatgacacatgggtgtatgtgaagatgcttaggatatggtgggggcatttagcagggagatttgacccagcttggggtggggtgggggacacagaggcggattctatgaggaagcagcctttaccctgagacctgcagtgggggagcattccctagatgaggaatgagaggtggagaggaatgtggagcaggatggtgtttcagacaggggtcctgagcaggagagagcaggatgtatggaccaacgaaaggcccatgagtctggaaggtggggaagggggaagcatgcacgttgctaatggagacagcacgtctcagaggctgcatcctggtggctttgtagctttgtgaagaaagtgggattttatccttaaaacgaaagggaagaagttggagctgttaagtagggagtgacatgatttgattgcttttttaagagagccctctggaggaaaaggggctggagggggcagggggtacagggcacggtggccgtttctgcaatcgctgaggcaggaggtgctgggggccagtcctgggctggaaatggggagtgggtgagggaactggactaacccagagtgttgcatgaggtgacattcatgccacatggtgacggacttcacagggagggtgaaggagagtatgtgagtctcctagggctgctataacaaatgaccacaaactggggggctttaaaccatggagatgtgttccctcgcagttcacggctctgcaggccagaggtctgaagtcaaggcatcagtagggctgaaacctgcccttgaaagtttctggggcaggatgcccctgggcctctctagcgtctgggggctgcaagccctgcttggctgcagccgtgtcaccgcagcctctgggcgccttcacgtggcctttactgtgcatgtctctgcacatcctctcctcctcttagaatgacacagtcattgggtttaggacccaccataggctagcatggtctcattttaacgaatgacatctgcaaaaatcctacttctaggcaaggttctgggtagacatgaatcttggcaggggaactattcaacctgctacagagagggaggcggatttgctaaggatggctccggctggctgtagcaactgggtggagacgtggaggacagaccgacgccagcagaaggacatcagggccactgaaccagaaacacacatggacgtgtgagtaagtgaggtgaccagacctagtgaggcccccagttcttttcaggttttttgtttgtttttaacaaatgagactgaaaatgtttcggttcactcttacttagtgaaagccgttcttgtgaagctgacatgtagtccagcgacagtgactcaggttagtaagggtgtgtgcttttcatggcgtgtcgacaccaagccctcacgcagagcaggctgactgacgatgccgcgtgcaggaggttccctggctctggggccggctgacctgggctgtcacctcagtgctgctgctttcgagctgtgtggccttgaggagggttctgggcttctctgagctgaagttatttccttgtgcaacggagatgaaaacacttgggaacaaggctgtggaaagacttatagcatggttgcacgtgcttggcaaagaaccagtctgtttagcttgcttgtttattttactgaaggcattatgtataacgattatattgtatattctaccaaacataccaacaagagtgtccaagatgttgatgcatattgaaacgtccatgttactctttagcataatttattgacaactgcttgttttcttgtgattctccctttttcctaaacacttatgagagaaaagccacacttaactgtaagttcttacttattaaggatagtctttatttagtagactgggaaagtggtggtagatggataagtaattaacaaatggataagaaaaatagtaggcttccccacaggaaggagataaggctgtgaacaatccacaaaaggagtgagtgtaaggactttttaattttgagagatattggatacatagttgttatctttctgttttcaaattcccccagcaacccacctccatggccatatccttgttccttgcatcaagcagaatggctcttcctccaaagtgaaccttgggcagcctactctggttacagtcctgcctgccaccgcctccttgtgaccttgtcctcccgccctcctggaggctcctccagggctgcttctcgtagccgtttcctggtgtggcttcagccacttgctgaccctgtctgggtccccaggatcatgcttggcttcactccccattggaccacagccttgaccttctcctacacctcccttcccaactccagacatccccctcctgatcccgggagccagtgcctcactgctggcagaaatcacataaccaagcttcaatacattttccacagccttggcaaaggccaaagggctgcttgccaatccttttgtgtatctcagtgtggcaaagttgttaagaccgtggttcaagtctcacctccacccctcactggaggcaccatacgtcttctgccaacctgccagatgccgcctttcacaagtcagcccctgaaatctgacattgtctgtgaagccttctgtctgattcatcagacgaaagtgaatacccgtgcggtatccattgcgggctgggtgcaggattctcctggacctttctgtgatctcaaccctctcgctggaattaggcacttgctcttgtctccttccctaatagtatactatgcttactttgcacctgatttatttggttttattttataatcaaatcaaataatttattccaagtagtctaaattgaagttttattttcaaaactacaggcataagcagtctttcagtagaatacccactgtagaaaaacttccttaacggttccccttgtgttgcagattttcaaggcttcaccattttcagtgtgattactaatatagcaggaaatccttcaagtatgtggctctctctctacctaggattctttctccaggacagattctcagacacgaatgtctgcagttaaatgccctgtgcttcttgagaaatgatgcagaattgccatttggaagggtcgtgctgacttgtgatgccaccaaagatactcaaaggtgtttgatttcactgcacctctgtgagaattgggaaatgggacagaacatcatctggggatacttaaagaacccgaaggtccttagcaccttgctcaagccaagtaaaatgaatttttcatattacgattttttttttccagcagattttaagctatctacttgggggcagaaataagaaaaagcagatggtaggggcaatgaggttgtggtggagttcgagggagtgattgaatcttgggtgctggttggaaatactgcccatgggggtctgggttgaattggatggaaacaacacttggagaagcctgcagaggggctgagaggggagggagagcctgtgtggactggaggctcaggagatgaagggcgagaggattgggtgcacgctgggactcagaggcttacattcttatgtgtggggagtacagaacccgccacaagctaactctatgttggccatgtttatggttatcagaagtggggttggcgttgaggacatcaaagcttcatgatgccaggggactgcaagagtcccctccgtgggcattgggcaacccaggagatggctaaggagactgaagccagctgctgggcactagtggtttgagtgaggaggaagagaccagagaggactggggcccaggggctgggacttagtggtggagggggctgtgaaggtctgtccagcttccatctgcctgttgtgcatgccttgcagggaggcatggcggcctgagctctctcctcacttggactttctgtggctgaggcagaaataaacagagatggacatcaatatgctggtgtgtgaaggcaccccatggggttagctccaggcagacctaggcattgtgtcctgccatctcctccctgcgccacatctcctgttcagctctatgcaagccacggccccacatgccctgtgagtctgccctctcccaccctgcctaaaccaggccactggtctattttacagaaagatagggttggacatagcatcaggggtcacttgaaagtcacagggctggaatgtcaggtggattcagggcctggggccaccattctgtgacagctgagctgtgggcacattgagctgtgggcaggtggagcagaaggagctcaatttcagaggaagagagagacagagacagaggtagagagagagagacaaagagagacagagacagagagacagggagagagagaaaggaagagaaagatggagagagacagagacagaggaagaaagagagagagagacaaagacagagagatagagaaacagggagagagagagagatagaaagagagtgacatttagagagacagagagagggagagagacctgatttccacatgcagactgaagcaggggcgggagcccactcccggagaggaaggggacatgcagggcaggctcgcggtccaggtcctgagatccagagaagtcccatcacgccccttctgatcaaactggtctgagtgggcttctggtccttacacggtgtaatctttaaaacagtaactgttattattatcacatgaaactgcagcacttccctttcattacctttgagggtcgtttattgaccaacagagagacccatgcttggggagcaacgtccaaggtgcccagcagaggcacagcagtgctgacagtcctgacaagtaacgtgggacacagaccacctggagatctcagcctggaggtgcctcagttgctcagggtgatgagattctattttaagttcccaggttgtcatttaaacctctctcttctgtcttgggatgggctaatggtgagatgaggtgatcgcagggcatgaggcaggggaggttgaggtaataacatcagaagtaaaagtaaaaaatcaaccaaccctctagcccagtgggcgtggctggcccaatgagctgtggggctcccacaataggagtataagcagcaggccctgccacctgggctgctttgccacagggcatttgctccagtgtactctgcctcccaactagcccgtctcattgtctcatttattgacttctcccacttgccttttcatgcatgtgacttgaagacccttggtctaagctgtgaatcctgaacacatgaggccttgtgatagatgcccctaaacatcacaggaaacaaagcagggacaccctcgccatgtaaattcagcttttctgattacaagacagaagggatttttctgactttcccctgtctccagaaattcatgcagaatcctgatttcatcacaactcaccagattttccttccaggccagcctgcctctggggcttaggttttagaccagagcgggtggaaatacagaggtggctccattgccaaggaagtcctgaaaggcttcctgtcctgcttcctttctcttgtgctgtggatggcctttctgtctaagcagatgtgtgtcacgagaaggggcaggtgtgtgtgatggccattcaggcactgctcatgcttccgagttaaaacctcctacttaatcactggctggaaataagcagtgaattctgcagggcgagccacaagggcagtgctaggaaagtcgctgtccttcctagaaccacagttgcttttgttagttttgtaaaggtgagtgtatacacctgtaccgaggcagaggtgggcatgtacacctgtacacagatagaggtgggcacatacacctgtacggacttagaggtgggcacatacacctgtatggggttagagatggacacgtatgcctgtacgggcttagaggtgggcacatacacctgtacggggttagaggtgggcacgtacgcctgtacagggttagaggtggacatgtatgcctgtacatggttagaggtgggcacatactcctgtatggggttagaggtgggcacgtacacctgtacggggttagaggtggacatatacgcctgtacatggttagaggtgggcacgtacgcctgtatgggcttagaggtgggcacgtacacccgtacggggttagaggtggacatgtacacctgtacataggctccaggctcttcctcctgcaacagtgagctgcctcgtttgggtcattggcctttctcacagtttgcaggggttgtgcagatacagctccttgctcagatgtcatttcaatttgtttcctgggaacaaagctctccaccatttaagatacatctcttttctctatgggaccctttgtccatattaggccaggtcctctcaaagctccttccagttaggcagttcaggaaatgacatgtgccttagatgacaattcaacagaacaattcaatgcctaagtttttaaaaaattattacttacttatgagccagagtttctttcttgttgcctaggctggagtgcaatggcatgatctcggctcactgcaactccgcctcctgggttcaagaggttctcctgcctcagcctcccaagtagctggaactacaggtgcccgtcaccacacacagctaatttttttattttattttattttattttattttattttattttattttattttgtatttttagtagagacagggtttcaccatgtcggccaggctggtcttgaactcctgaccttaaatgatcctcccaccttggcctcccaaagtgttgggattacaggtgtgaaccactgcgcccggcccaaagcctaagttttagtataagactgatgtgtcttcagatgctgcctctgccatttgcatgctgtgtgacttcagcctggcagctcaacctatctgagcctcagtttctgcagctgtaaaatggggaccagaactgtctctactccctagggttggagggagagccctcagtgtgacccccggtgtggagtagggagggtttcagcactgaggagttttctcagcattccctgtctcaagactgtgttaactactgaagatggggtcaattactgacccctggggacttaaaataatcagtgccgcttttcctcattgcctaatttattatactcaagaagtggcctccaaatgaggaaaacctgatccatggccaagctgccttgaaagttttctttcaattcttttggtaacagctgtattgagagataattcacatatcgtgcagctcacccattggcagtgtactgttcaatggttttgagtatgtgagcagtgttttgcaaccatcattgtggtgaaatttagaatattttcttctcctctaaagagaaccctgtgtccattaggaatcacttccattttcctttcccccggcccctggccacctgtaacccgctttctgtttctttagatttgcctattctggacacttcatagaaatggaatcacatgacatgtggcggttatgactggcttccttcatttggcatcatgttttcgaagctcatccgtgttgtagcatgtgtcagccctccattcctttttatgacagaatgatattccactgtctggatacatcacactttgtttccccattcatcaattgagggacgtttgtgttgtttctattaattgttttaacctaaattgcctttcacaacgttcttgttttgatgtaactgtctgcttatcaattgtagagttcattaattcatctctctatgtgcccagtgaatatttattgagtgcccagtaagtcttgggtgctgtgcaaggcattttgatgaatctgtgaactaggcaggtaagactcttgccatcacggaaggtcccattctagtgggggccatttaggtgctgctctttcttctgatctttagtggatgaccaacaacaaatagctattaatacacaccatgatgtcggtgatgacgaatgtggtgggaaatggagctgcctacagggaagaaggagtgatgggtgctgtttcagatgtgggcactgggaagatgtctctctgggcagggcaatgggtgcagagccatggatttcactggtctgggtcaagttcagaaatgggtggactatgatgaacctctgaagacctggagatggggccaccttttgaggcagaaacctctcttttgtcctgtgagaagtctgacttggcctcacagggtgcagtcgtcccctgccctggacaagctcatgtgaatggccagagtgtggacacacatccaccaacctgcattctcaattacgtggaagcctccatgttctctctgcatttgaccttctctggagggtaaatgaggacaggcatctgccgggggtggggggggggggcaggcacttttactgtttccatcctgcaaggtccggggagaccccaggcttttctgtcgttaaggtgtcctagagggagcattcaagcttatgtttgttggacctgtgacagcacgtggtgcttgtgtttacagcctgctccatgttccatcttctactgcacttggctatttacaggtccatagacccagatggtgctgtggtttctgtctccagaacgcctccccagtccggcacttattcccactctcactgccatctcctgggcgttgctcaccagcaccttaaatgttcttgccacttctcctctgcaatctcgtactttctgctcccagaccaagggctagaggcatgctttctgtgctcatgtgcgcatgctttctcagcaaccttgtgaggctgccccaccccctccacagctcctccctggtccaatgggagagagcatttggtttcagagagaaccatgtggttctccttctgtttattctgagcttttttttcttcatttagcatcaattcctgtcatggaaaatcacaggagccaactgaagggggatttccagaatatttggccttccttgggccttggtgaagtggcttccttggcctgggcaagtggggctgtgagcatctgtacattcacaagaaggctgggggtgcggctccatgctgggtgagcctcctctctccttgccggggaagggctagagtaagagtcggtttctccaaagtgatgatgcattctttctcttatgggtctggcttggaagccacagaattcaaaggcagtgctgggaggtggcttagccctcctctgctttagttggtggaaaggaaaggtagaaacctgaggtcaaaaacaggtggcccgtgggcctaggtcagcctgcagacttggttggtttgaacacagtgtttgtgtgtttcattgaaccaacatttaaatgtagggagatttcacaccaatatctggattttctttctggcttggcttgaaatactcagagctcgggtactgctggctattgccaggctagagggttcatgaggatggaattgtccagctgtgatattggctgtctccggggcctgcaccatgcctggtagatgaggtccatccacttaatgaaggaacggactggccatggctcttgccaggctgcgtggctgctgcctgctccaggcaggacctgccttctccagttaggccaagtccttgactacccacgtggagaatccacacctggttcacctcacctacttacctgtgtatccagcctggcctctctaggacatctgcatctggtccttgggagcaaccgtaggcatgaggaatgtgctgaaagggatcctcctttattctgaaatgtggcccatcaggcctcagctagagattcttccctaaggaagtctggagtcccgtggctgtaaccacagctttcagaagcggttctcaaatgtgggcagtttgggcaccgtctggaggcattttcagttgtcgcagctgggaggcatggtgccactggcatctcatgggcagaggccagggatactgctaagtacccccacagtgcccaggacggcccccgccacagagcatcatttagcttcaaatgtcagtattgctgaggctgcgcatccctgcgttggagtcacagtgccctgagtccctgtcccaatgctgcacttgcccttgaccttcctgcctcctcgaacctcagtttcccatctctaaagtggagtgatcctcacatgcacctctctcagctagatggagaggaaacgccatggcctgcatgtagaatcacactcagtggtcggggttgcagctctgatatttggggaggccctagccatgggggctaggatctgggctgtggaatccacctgtgtgactatgggtgggtcgtatgtcctcctgagcctcagtttcctcatctgggcatcaagagaggaatagggcagcctctaaggatgtgaggattaaatggtttaatgtctgcactcggcacatggaacctgataaacgtgcgtgagcagcgccatcctgactcagcggtgtggttctggggtctcctgagacaccactgtgtgcccgacacccagcttgcggcctccttccctccaccatctctctcctcatccacgagtcaggttaatcctcccccttgaccccacacaccgcagcaaagttttaggaagttgcctgtggttgccctttggtgtatggactccagggtggctcctgtggaggtgggaagagccttgggggcttccaggcaagagaggtgagtggggcttagcctaggctgtggtggtggggttggtgaagagggaaggaattggagagaggccctggacacagagcccagaggagttgcctgcaggttggatgtgtctgttacggtgagctgcaagcaatctgagggcaggagggtacctcatctccctcagcgtctctctagtgtgtgaggctgtgtagtttgtggatttgaatagacttggagcttttggggcatcttcctgggacaacctcaatttatttggcatcttctcagagtttatctgtgggcatggcaggagtgaccccagactgggttcagccctctcttcctggctgagcctctttgggtcttagtctgctcatctgtagaatgggaatagaatccttcactctgtggcctgttgttttaagttttcaataagacctggtattggaagcccccatcaaagtgaggagctcatgaagcacaggcgttgggcaccagatgcaggatctcttcctgatggccgagcaatgtggcgctaagcggggtgtctgcggttcgccccgcccaggtcagcagcacgacaaggggcaggccttggattctcttagacctgctcacagcctgggcttctggggccctgaatgtggccagtgctcaggtggttgggagctggcctggcagcacctggggctcccaaacacaagggaagacaggcagctgggatggtgaccctggggaccctgctatcctgtggaggccccaggattccgacttgtacccgggcttgcttggtgctgtcttgggactgtctctgggctgggacagtgagctcttggatgggccctcggctgtcagtgcctcagagctgcagaaggtcagagccaggcctggggtggaccaagtggtatctacacccctcccaaatgtgtccgaactgggtagttttgtgcagctcactctgcctctctgagccttggtttcctcacctgacctgcacagtggaagaggagaagagcctgacaggaaggccggatcaagctggtagggtttcagtgcaggccctggcagagcagccccgaagcttgggaaggccaggaaatcccgcgctggtctccagacctgcctgcccgaggagtcgagcttctgatgaaattcagctgagatttcggttttttgtgctctgtaccctgacaaggggcaggaatcgggagccagcctcggctgtcagtgtcctgggctggttccctcccacctcccgcttaaaggtgtcattagcaagggcaagacgtcttctaacaggtggaaacaacttgtcaagacagcctgtggctgctgcgtttagagacccagagaccctgaatgtggactaacgcccccagaatgttcagaattaatgtgctgccccaggcagtgctggggcggggggcatggctctgactcctgcccttgggtttgccccactctgccctcttccccttctcctgttccttccccttctcctgttcctccttctcctgttccttccccttctcctgtccccccttctcctgttccttccccttctcctgtcctctcttctcctgttcccccttgttctcgttccccttctcctgttcccccttctcctgtccccgcttcttctgtctccccttctgttccctccttctcctattccccgcttctcctgttccccccttctcctgtccccgcttctcctgttccccccttctcctgtccccgcttctcctgttcctctcccttctcctgttccccacttctcctcttcccaccttctcctgttcctgccttctcctgtccccccttctcctgttccccctcctcctgttccccccttctctggttccctccttctcctgttccccctccttctgtttccccccttctcctcttcccaccttctcctgtcccccacttctcctgtttctgccttctcctgccttctcctgttgccccttctcctgtcccccgcttctcctgtctctgccttctcctgccttctcctatccccccttctactgtccccccacttctcctgttcctcccccttctcctgttcctccccttctgttcccccctctcctgttcccccttctcctgttcctccccattctcctccctgttcctcccccttctcctccctgttcctccttttccccctctcttttcctccccttcctattcttttccctcttcccttccccctcctcccctccacttacccctctccctccctattcttttccctcttcccttccccctcctcccctccacttacccctctccctccctgtccttctccctcttcccagctaattgtattgaggctgtaccttgtgataggaactttgggtagctctcttagctcatatcacaccatccctggggaagggtaccccattgtacaggtgggtacacagaagaggggagagatgcccccactacaatgtgctgggagcagaatttggacctggatctgagtccagctcctccatcccctgcaggaaggatctgggctcttggggtgtcagggggcaactacctcttcatagcaaagcttcattcgttaagttcctggttctgggctattgtccctgtctccgaggatcagagaggtgaagtcccctgcctgggttcagatggttatggagtaggggtcctggttcagacccatggctgtctttcttgccagcagcacttctttctttggggtgatttttcccccaggggacactgcagtgcctggagacattctggttgttataactggggtggagggtgcttctggcctctggcatgtagctgtcagggatgcggctaaacctcctgcaatgcacagcacagcccccaccacagagaattgtgtggtcccaaatgtcaccagtgctgaggctgagaaaccctgcaccaggcccctccccagctgaccctatgttcctgcaactaagccagcagtagacatacctgcagcagcaggtgttggtgctacaggtgaccctaggtcctcgacctccccatctgtctgccacctgggcctgggcctgggcccggaataaaaggtgcaccaagggtccctggcttcagcattttttgttttcaggttgcatatcagactccttcttgcctcctgaggtcccttgggacttggctccaggcagcctccctgatctaagacttcagcagccgcctcaggactctgcatggccaaggtcccctctgccccaggtcaccaaggtcattgtggtagggaaggagaagagagggccctaagaaaaactccagtcccactagttcctggaacttgcctaaggccaggagaagttgctgccatcgtgggttctgtatatgggattcaggactttggttcaggtggtttctgccaggctctggccagatgccagcctaggcagtgtcctggcagtgctgagtgacacgtctcgggcacagagaggagtgggcgcctggccctgagcagaggggaggcttgttgggggccagcacttgatccactgagccggaccctcagaccctgggttgccctcctcacccccacccccacctcatctctgcttcctgcaacatctatatttaaaaatgttgacagataataatggtgttcagccccaaaatgcagacaggagcttcctgacaattgcagtgctgcgccgggttggaggttttctcagggagcggagcgagtccccaggagcaagtgagagtgccagggctgtgagggctctttgccaatcttgacctttcagggagatttgagagaaagactccagaagcccgcggggagagcaggggttctggggaagataaagcccttcatccaggatccctctgtgaccataaggtgagttgctttgccccacatctctggtgaggcagagggcagggactctgcttagggagcaggcttcttaaaggcaaagggtttgcaaattctagcagcagcagggccctaagagaatggctttttttttttgttcttgaatcggatgactgcatttggagtctggggtgaggggtgggggctgcccctcttggagccacagatgggtcatttttatgtatcaagggagtcagaccaggatcagccctgggtttctggcacagagtccagaaagagtcacgaaggtcttttgtttgcatgtgaatggtattttaacctattacttctgggctaaaaataaaaattcccctcagatgcctttttgtctgtagattgtaagatcgtttccaggaaataatagattgtcattgatgtgcgttttgactgcatggtgtcctattcttaagccaggttttataaaaattcaaagtagaggaggtttcccacagtggagattgaagccttcatttagtgtcaggaacatatgctccactatcaggagtcattgtccttccgggatctccaccactgaaccctgggtgggagtgtgggagtgggtgagggagaaggcacacttggcttttgtgtggttttacatttggtatcatttgtggacttttggttctgaaaaatggtttgcaagtgaagttggatgtctggagttggggcccaagaaggcgatggagaagtgaattctaattcacagttaatatgggtcatggttaagttcttggaagcaacattggtttccaaaggtgcctgctgcgtttttaagctgcaaggttttatgtttttttgacccagtggaaaatggcgattcaggatcccaaggacttcaggagaggttgtctgaatgctaaaaccccttccctgaaatgcttgctttctttttagaggacaggaaatatgggaaattaacagtccttttgtggagtgtggtttgcgtgttgttctttgaggaggaattacggaattatgtgcgtgtataatgatggtaaccacatacacaatcgaagaataacaagtcagaaaaatccatggtgaggttcattcagaaataatcaagagtgtattgtttaattaaggagaggatcagaggaatgcagtcccagagccaccatttcggttgtcacctaggtgcaactctcagcagaaggaagcattcccaataagatgttctgaaaacgtactgccgttgaatctcacaactttcaccccacaagctgcaataagaggccagtatgaaaatgcgctctttcttccccatacattttcttctgttcctgagccgagcccataggtagcttggcagtttgcaattctctgtctacacggaatagatatagatttttttttcctgtatgttttgggtattaactctttggttgccaagctgttgagccctgagtctatattatacaccttcagcccgtggcttacagggcttcaacacatcgttgttatataatgcagtagttttgcttgtggggtgactgttcatatcgtggatgctcagaaaattctatttttaaagtataaaataccactcttcagagcagcctgctcactcctgcctccctgggagccacacgctttgcaccgtggagttgttggcatgaaggcacatgacatatggatgggagtgcgttcctcctgtctagggcctcttaggacccgaggaatggctggaggcagtttctctccagtcctgaggttgatgatccgaagctcttggtgctgagcctgtgctgctatttttagcttcctttcttccctgcatcttgacataattcgacatgtcgcagctgaatctcatctacttgcagagcttaccgtgttttgtaatctgtgttttgtggggcagaaatagtccttgccagagcatattatatcattattattcagggggaaagttatgatactatcaattaactttagaagatgcaaaacacaattgatcctttgattttctttctactgctaatttcctggctgggagcacctggagggtaggcactcctcctccttctgccggaccagaaggcagcaagcagtggttctcacatcttgggaacctgtatcagaagcacctggaggggctgttacaaaggcaattgcagccccactggcagagtttctgagttagcaggtctgggtggggtgggggggcaagtaatttgcatctctcacaagttcccaggtgatgctgacgccggtccagcactgcactttgaatcacagatggagatcacggcagagggttggtaaatatttagggggtggacgatgcctacatgcagagagccaatttaagaaatatacagatggtggagcaggagattttcagttgttgtgtatcctgtccacgcggttgaagatggacttgattgaaaaagaaattaaagttgaaataaaattagctgactgagaggatggctcctgacagtgtccaatgctgtgatgttatttagggaggatgaagcatcacgactcagacaacttactttgagatggccaacagcacacacagacataaatgaagtgcgtgtacatgcacacacacgaaactcagcaaaatattaactgctgaaacaataggtgttcatattattctaatttcatactatttctatttctaatacttttcttcataacaaacattgtattaacatggcaaacacaataatagggcttaggacagcttttcttgtgtgtgtgcttaatagtaaatcaaggtcacccacatgttcacagctgtgttgctctgggtggcatgggcatcggtactgtattagtccatttttacactgctgataaagacgtacccaagactgggtaatttataaagaaaaagaggcttaatggactcacattaagcctctggggagccctcacaataatggcagaaggtgaaaggcatgtcttacgtggcagcagacaagagataatgaggaccaagtgaaaggggtttccccttataaaaccgtcagatctcatgagacttattcactaccacaagaacagtatgggggagactgcccccatgattcagttacctcctgctgggtccctcccgcaacacgtggaaactataggagctacaattcaagaagagatttgggtggggacacagccaaactgtatcaggcacacgcatcgctttagggagttctcatttccttccattcaacctgatcctttatctgcttgttctttcctcctttcccttccattctctttcactccctcctccctggcttccctctcttctgctctccctccctccttccttcttcctgtccccatctcctgtcttctggtgactctgggtcaaaggaccctggtccagaagggttccgtgtggggatgtgttgtgctgaacccctgttaacctcagtagggaaggtaccaggttcaagaggccaaagaagagacctggagccagcaaacaagacatacagttttattatggacttacatgcagggaagagagtccagtggtggcaggttgaagagaactgtcttaacatacagaaacggtccagtggtggcaggctggacaggagaactgccttaatgttcagaaacggtccagtggtggcaggctggacaacatatccaccttcctacagtctggtggtggcagactgggcaagaaaaccacaactgcaaccgcctgcgaacatcatgcagtttacgcagcattttcatttagcaccctcctcctaacagccctcacctggcaaccttcatgtaacccaagcttgtccaacccaaggcctgtgggacgcatgcagcccaggatggctttgaatgcggcgcaacacaaatttgtaaactttcttaaagtgttatgagatttttttttttagctcatcaactatcattagtgttagcgtattttatgtatggcccaagacaattcttctttttctaatgtggcccaaggaagccaaaagattggacacccctgatagtaacccaaaactcagggcctcaatcccctgtacagcccgtgttccacaggacaggccggaggctcagatgttgtggtagataggaacagatctctgggtgggccactcccggattccctagtttggaacacacattcaggtgcacctgtcatacagggtcattctaagggtatgcttaaaatattgatgtcaggtgtgtttaccctgcaggatgctgtggcatctgcccaggaaaaagttgaattatgccagttattgttttcccagggttttcaggctgcctccttgttttttaaataaagttttattagaacacactcacacccatttacttacacacttctctggctgctttccagcagcatagctgaggcagagaccatagatccacacaactgaaaatatttacttctggcctgttgcagaaaaaatttgcccatgctgatttgtttctgtgggctggctgtcttggagattccacacgtacacacatgtgcacatgtgcatacatactcatactaaggacatgcagcaagacgttaagggttgtggagtctagagtacatgtgattgttcattgtaccattttttttttctactttttcacgtgtccaaaaaatttgtaaaacattttgatgactgtggcagtgaccaccccagggtctctagaggaatgccacaggggtccatcccaggttctgagtcttcaacatttgcctcacccacttggcaggttaatcaaatgggtagatgacacaaatcaataaaagcattaacaaagtgtcccatatattcaagagccaaacagatatctcaacagactgttagggaggctgagtcaacaaggagaagtttaatgttcataagcttcaggtatccagctcagatttacaaagatctttgcccaggtcctgcaaggagcagactttgataggaatcaggcctctgggccaggcatggcggctcacccctgtaatctcagctctttgggaggccgaggtgggtggatcacctgaggtcgggagtttgagaccagcctgaccaacatggtgaaaccctgtctctactaaaaacacaaaattagctgggagtggtggcacatgcctttaatcccagctactcaggaggctgaggcaggagaatcatttgaacccagggggtggaggttgcggtgagcagagatcgtgccattgcaccccagactgggcaacaagagcgaaactctatctcaaaaaaaaaaaaagaaagaaagaaagaaaaaaataatcaggcctcttggctggacgcggtggctcatgcctgtaatcccagcattttgggaggccgaggcaggtggatcacttgaggccaggagttcgaggccagcctggccaacatggcaaaaccccgtctctactaaaaatacaaaaattagctgggtgtggtggcgtgcacctgtagtcccagctactcggcaggctgaggcaggagaatcgctccaacccaggaggcagaggttgcagtgagccaagatcatggtgctgcactccagcctgggcaacagagtgagactctgtctcaaaaacaaaaacaaacaaaacaaaaaaaagggaaagaaatctggcctcttaatggaaccaaagtctgcggggtccctagagtgtgtgcaaactgttccagtcactgggacatcagtgtgcaaagcctcctggagcttgtgtgctagtgggagaggacaatgaacggcacctataaccagtaggggatcgtcctgcatgttagtaataagtgttgtgggaaatgaacaggagaagtagggggaggtaagagaaggtataaatgtggtaggctgtagacatttgagtattacatggagtgtcaggattggcatcattacggaggtgacatttgagcaaagccgtgaaggcggtgaggaagtgagccatgtggatatctgaggcaagagcctttggggcaaagggaaccttcagtgaagacgccccgaataagagccggcctggtgggttccaggaacagggaggaggagcccgtggtggctggagtcacatgagattgctggggagggagacgggagagaagcagggacattgtagggaggggcctctgccagcacttgggcttttgctctgagtgtgacgggtcgggggggacattggagggtttgagatttaattatgattcatcaaataacttgagaacaggctagtgtccaggtggactgaccagcctagcagtcattgctgcaatccaggcgggagatgatgctaactggccacagtgaggttgtggacgtggacacttctagaaggtagaatgatgcagttggctgagggagcagatggggaaacagggacagtggagtttcaagggaggactctcaggttctgtcgtgagtaacagaaggatagagcgttggtcctggcctatgaggggaaggccgtggtggagcaggtttcagggagagagcagttcaattttggctacagtgaatttggagcatctatttgacatccgtgcaaagatgacaaattggcaattggctgcacaactctgtgcttgggagagaggtttgggctgaagctgtgcattcgggaggccgcagctgagcagaagctgaatgtgagctaacgcgctctctccctgacttagtcatttgtctgccacctgtagtctaatttgccaaatactttcttttaaaccaggtcttttttttttttttcaaatttaaactcattttaaaaggatatctatgttgcacttttaagtagaaatccaatattgcttgcctttgataaaaggtaaccataaaataaaacaatgacaacaaaacaacatttagttcaagttaggcatagtctctcactaaggattttgagccagagggtcttatgtattatccaaacacagagatcaacaagtgtcagatgccagggtcgtcataataccaaactaagactctcctcttgaagttcttggaagattggagggaaattggcaagaaattagcttctgttgctttgtcctgggtccacgaatcccttaaagtccccttttaccctgttatgtgcctggcccttggggagatgctgagctgagcagccgttatagtgggtagaagaaggaagcttggggtccagcttgaccctctgctagaggttgggtttgccttaggactatgtattttctgaaaggcaaactgcaatttgcaagaacgcagagaggggcaatggctgtttattctagaacagacttgggggatgagaaccttggaaagaaagggtgggatttttcctgcatggttctaggatgtggccctgcagccagctgggaaggataaaaggatacaagtgggttggtttcacttccctctgggcacaggctttctctctgagaattctcactggggctcatatcttttaaattaagtagtctgctcctgaataatatctttctttggggctgtttctttttcagtttatatattggggtccctttttgacattataggctttcctcaaatgcctggtgagccaggatcgaccttgttcattgcagaatgaagcagcaaagagctggtgtgtgctcacggtgtgtttcagctggtgggttttgtttcaggttgcccaggcctggaggtggccttggtgctgaggggcctttgcagaaccttctctttgtggctggtctggagacaggcaaggatgctcctgtactttttgcctggagatgggagttgtccatgttatctgcaatccaccctaggctgatggtgagggagggagtctgctgtcataggaagcatgtaaacagactcaggcttctctcagcatgagaagggattttggatctctgaggtccttcctactgtggatttgcagtttccctccacaacctcacccgcaggaatccggaagcgcctgatgccttccctgggctgggagcccctagagaggaggatctgctgagctgttatgacatcgtgcccacaactgtgcaggcatttgggagatgctctgaaaatgcccgatgaagggttgtgaggatgaaagaatctgctgctgaacacaaactgctgggctccaggctactgagcccaacttattccatggcccagcatgtcccacggctcagcatgtcctgtggctcagcacgtcccttggcttcccatggctcagcacgtcccgtggctcagctctcactcctttgcttctgcaggtcccttggtctggcgtgtcctccccactcttcctgagttctctgaattctacttgtggctccagggccccctctttcatgaaaccttgactcaccacctccacctctttccccacctcacccaccactgtcctgctcttggggccctgcacccacctcctgctgggcccctgcttctgccctgcagtgctgtggcccccttcctgcccagcagctgggaaggcatcctgaagtgcatatcagatcttgccctgtccctgcctcccattgcctctggaccacagcctctgagatcctgcctgccttcctcatcttgtcttccattcctggggaacagtggccacatagccaggtggctggcagcacggacttgggagaccctaccagcctgggtttgaaccctgtctctaccgcctgcttgctttgtgacctggttcctcattttcctcatctgtaagatggtggtgttgaaaggacccgtctggtagggttgttctgaaggttgagatattcaaatgctgagaacaccacccagcacaaggctggtgaatgctccaggagggttcactgcgccgttgccattttcctgttgatcctggagttccggccactctggcctctgctcacatagctggaactcgtcagaccatctcccacctcaaggtctttgcctctaccgtgctgtctcaggacactcgtcccctgccttaccattcggtcagcccattatccttcgggcctcaggttgaatgtcacttgctgagagcagccctctctgaccatccttttagagtggcttccccgcctcacattccccgttacagtctggcctgattgtatctgccagtgggttctgcttcccccaaccacaacttgcccatcatgagggggcagccttgcctgttgtcccctgcactgcatcaacactgcctggaccagaggccctcggtaactgccagttggctgaatgaatgcaggaatgaggcatgaacaatgcaaagatgctgaaccatgacatgagggactgtttcattcatgtggcatgggggtgggctaccccccccatacctaacttttccaatgtgacggttttccttctgaatttataaggtgcccaccttaaagacaggaattcagctcatatcttttaatagaccctgcaaggtatccagttcctaggacacagcattttgttggttattgaatgagactgaagggatgagaagagtggccaatagcatggagctggggcctaactgcccacgtgtggtcttggtccctagtatttattagccaagtgtccttggccaacttcattttatgccacaaaacctcagtctcctcatctatacaatgggaataataataataccttttctagagttggagggaggattaaatgagtcagttatgtttaaagtcctggaacagtgccaatgcccaccacatagtaatttccatgtaaatgtgagctgccatgatgatggtgatgatcatggttgtgatgatggtggtgatgattgtgatgttgatggtgatgatgatggtcgtgatgatgatggtgatgatgatggtcgtgatgattgtgatgatgatggtgatgatgatggtggtgatgatgatggttgtgatgattgtgatgatggtggtgatgatgatggtggtgatgatgatggtgatgatgatggtgatgatgatgattgtgatgatggtggtgatggtggtggttatgatgatggtggtgatgatggtgatgatgatggtgatgatgatggtgatgatgatggtgatgatgatggtggtgatgattgtgatgatgatggtgatggtggtggtgatgatgatggtgatgatggtgatgatgatggtggtgattgtgatgatggtggtgattgtgatgatggtggtggttgtgatggtgatgattgtgatgatggtggtgatgatggtggtgattgtgatgatgatggtgattgtgatgatggtgatgattgtgatgatggtggtgattgtgatgatggtggtgatgatgatggtggtgatgatgatggtggtgattgtgatgatggtggtgatgatgatcatggtgattgtgatgatggtggtgatagtggtggtgacggtgataatgatcatggtggtgacagtgatgatgacgatggtgattgtgatggtggtggtgatagtggtgatgacgatgatgatcatggcagtgatggtgatgatgacgatggtgattgtgatggtggtggtgatagtggtgatgatggtgatgatgatcatagtggtgttggtgatgataatggtggtggtgaatgtgacggtgtgatggtggtaatgagggtgatgttgttaccttgtagtagatttgaaaaagtggaatagagtggaattaaagaaaacactactgagttaataagaagaaaggtagggcgcaggaagtgtttgctaggaaatggaagagtccagcttattccagtatcagttgaatgcagcagactcatgaactttactgaaaccaaaatttaccgaagctgatgagaggatcatgatttcccagagtgtggactgaagcctccgggaggtgtcagagatgattttggagtagtgcttttcacaccctctgtaaaataggacccatttaaaaattttcaatctgttgcaaactgataatttcattaatgtgtagagaaacattttcacacttcacccctaagagaaggtttgtggactggtacctggaacagatacttatcttgtagctgccaccaagaaacactttccagatgggcaccgtagcaggacactgtgctaggacacgctttgagtagtgctgtttcagatgaaaatcacatcacatggggctttgaatttcacagaatcctgtggtcagctggttgctcccctgtgaattatctttcagttgtgtggttgtatatggaggagaaagttgtagtttgtggctcatgtgtcactgactggtgatgttggatgatttctcttttctaacaagcagagagcagcctcaggcacagaacccttgacgggcatggggtcttgccagaatggaattacactgacttgtttccattgcatttattttgtggccacttaatatttttggatgttgattctgattttcctattagagccaagatgtaaagtttctttaatagataatttaggtgcaaaaagtgagttgccttaaaacatagtgtacattatcatgcagctacgagtgaatatatgacaaaaatcatgaaagtggtacaagacaaatttgcagagaactctagtggaaggcaggatagaggagtgagaatagaccaaatggatgtttggggtcatttgggggccatgtaagcctctcccccttatccctggtggaacagcattaaggacatcctctccttcatcccaaacatctgctttatgggaaaccacaggactatattgttagtagtactgggaaagcctagtcggctttatcttttggattctgagaatgttgtcagtgatcatgtttctctcttcactggagttgctaggagttccagcatccaatttcagctccaacctccaatccttgcacagaaccctacagtacgtgttttgtgtattgaagccacagaagcatgtatttttcctcctcattctctccctgacctttttttgattttgttttttgtttttttttcttaactgcagttacatttttgtaagctgtgttacatcgttgtttggaacacagtgggggtaatgcataaatgctgaataaataaataatgatgaaactttttcctcaaactgtgagattggggccactccattgttagagttattttaatgtgatcaggacaaagaggccaagagtgttgtaggaagtaagctttgttctcgtgggcttgggctgggcaacgctgtggttgttgggaacgctaatttctgttatttggtggtgctcatatctcaggcctctgtttaagaaacaacatagattcctccaaggcacatatttgcatcctgtgtgggccgaggtgcctggcttcattctttctctagatacccacactatctcatgggtatttttaaatgcgtgtcttaagagccaacttctctgctgtgtgcaggcttttcatgatgccgggagagttgccacgtggatttgcaggcgctgagggcagaaacaaggaacaggcagcatcagctcaatgggtgggacccactgtcctttcagcccttggtggggcggccttggaggaagggtcattctccaagcagggcagaactcagttccaggttggccagaaggccaaatggactgtggggcaggtctgaggccaggtagtggggcgacccagaagcaggaagatggtgtgtcaaatgtagagtgagacagaaatggcaggggctgaggagttgttgagtcctgttttttcacacttgtgtggggatcttgaggagtttcgtagaggtgccgcagggtctgcctgttgaggagcaaaccaagctgaccgggttacaggtgccatccactgtcccctcccatctgattggtttggatactaggatgttgtgtggattctcctggagtccagacatagccagtgaaacaatattgaaccccctgcaatagtccagccccatcattccatttcataaaggaaactgaggccttgccagggatcccaaagtggtaatccctcttgtagagttccaggggagggcaccaacctctacctagctactgaagccagaaacctgggcattcacctgccctttccattttcctcctcatccccatccctgccacatccctgtatcctggcatctccagccttcagcacctctccaattcatctgcttctcattacccccagccacaccaggaaggtccaggcccccttgtctgtgcgctgggaggatacagatgcatcctgagccttccagcttcctctgttgggcccatctaattgggtttctgctgggcgatgggagtgatcatttgaaacttcaaatctcattatgacagtctatatcccttcctcaatgttcccatcttgtttcacatctttcagtggttgctcatggcttgtaaaatcaaaacaaaacaaaacaaaacacccaaattcctcaccaagccccctcctgcacctctggcctcatgatggcatgattctttgagtctggggacctgagcagatggtctgagctgtgctagaactctaacccacaccaccgcctaccatgcacaaacacagatgtttgctggctgactccagctcatcctctcatcttagcctcagcatcacttctgcaggaaggccccttccaatctcaccagggcccatcacgtcatcctgtctgatgccctttggcactctgggctaatcctttggggccctcagacgccgtccccactgtcttagttgtctggtttgctctctctcttcccctactggattgtcaacttcctgagagccaaggtcacatatagctttagcctgtgtcccaggccttcagcatggtgcttctttgggcacaggaggtgtgtgcagagtggaaggagaccttcatttggtggggagactgtattatagagaagtagtttcatgttccaaagaacaagcaggaaatatcttccttctcctcctctttctgctagtaaatcctccttcctcctcactggctggatgaagcatctcatggtggaatagtttcagatccagggttcccaggaaagggaaccacctccagttccccatcccctttcctttcctgggaggtctctggtgcttatgctactaataatgaacatttaactaatgagttgctacctgttcatattaccaaagcctccctgccaaaggccaccagagacattcctggggtcaaatcagattagatttatggagcttcctgcatcacagggtaacacagtattgagggccatgacaacatcccaatatacaggactgggagaggcttttttacagggcttgagtatgatctggatgattctagaagaaatgaaagaagcaagggccagctctatctgatactatcaagaaagaggcctcccactataggatatctcagtggtctttgttcaggaggttggaggaactagttgaggctgggtaagtgcaggatccctgcccgtggaggggacatcagtcacgtttgtagcttccatgtggcctcgggtgtcctggcggagaccttggctctcctgtcagaagcttcctctgattgtcaacagggatgattttattttactctttatgctttcatctttcatatttaaaactttgatcagtctagaatttcttttgatataaaatgtgagggacagagccaacctacttttctattttagattgccatcaattgtcccaactccatttattgaatgataatcgcttttctctgattttcttgcctcctttataaatatattagattctatacaattttgtgtctatttttggacttttcattttgtcccattgaattgtgtctatccttgcaacaaagccacattgttttaattattatcactatattatatgttttaataacagaagtccctttccctcataccttattcctcttgcagctttttctagttcttcttgtttattttttatataaattttatcttatttgctatatgtcttttaaatatctgataactttagcaggattttagttgtgtaagaattacagaattttaatcctggaaggatgctgaggaggtttctaactctctcattttctggagaggatatgattttatcaaagtgatgctgtgagtttatggcagtgagaaaccagggaatccccaaccctgaacccacctccagatccactcgccccaccaagcctccagcttttgaccctgcatatttttaggtacccagaaattacttaatatttagcttagtggactgccacgatttaaatttgaccttttaaatccaagcacctccttctgctatgttgcttttagaagaaaggacaaagctgaggaattcaacctttgtttccatttatctcttagccttccgagacaggacgcaatgtagccaacaccactcctttgtctccatggtcaaagtcggaaggaagttctttcagaggggttggcttcattgatcttgtggggaaaatcttacaagtacccagggcatggtgtttgataaggaagtgagtggtgtgaaatccaggctcaagaacaaaagccctacaagcctgtacccaacggggccactggcctagaatggtaataaatagaattgggtgacaaccttgaaggtcacccgtggttcagctctggaggtgtccttgtttgtactcactttgagtaaccatcaacttataaatagcctcaggccaattgcccagtgatgattttgactgtcgcttgccaggggcctgggcttgtggtttggttgtgagtctgtcatggtctctgtgacctcagaggaggaggaaggaagatgatgatggatgcttctagtgatgcaagcaacaaacatttttggacaatgtgcccaataccattctctgtactctgcatgagttaacccttcaggcttcaaacaacgctttgaggtaggtgaggagactgagcactaaaaaggtgaatgcggagccagtgtgagcacaaaaggcctggttccctgctagaccgtgcctcctcttggctggagctctatggaaagagttggaaccagggagccttggttaaaatatcagctccatcccttatgaccttgggcaacttacaaatctccaaatctgtattttcaccttttaactagaataatgtatgtcaattatagggtgttaggattaaatgagaaaatgtacataaaacttttggggcattgtctggcactgggtaagtactcaatgaaaaaaggtaatggttttttaacttgtttaatgtttctaagccttaggttttccacttataaaatgaaagcgtcattatatatggtgcgtggctgtcttctcttttggtttggttcggtttgaggatttgtcggggtcacattaccgtcatgaccacctgtgtgaccttgagcagattccttaacccctttatgttgcagttgcctccactctgaagtgggggtcctgatagtggctggctcagggttgtgtgataatcaaatgagagatgcttagagaataagcatcggcgtctggcacagacgtcctcatcctccaagatcctgtgacttgttgcatctatgtgcttgacttagcccacaatccgtccccatctcccttctcttctctttgttctgggaatctttaaaaacacttgttgagcttggggtcggtttgcagaatcatcacctacttttagggtagtctgtttcatttggggtaaacatttaggtttctaagacattgggacagtgatgtttgacttcacatctattcatgtgctctcactgagctctgaatatgatgtttccattcccccatctatcagagatgacacagaatcatttatatagactcaatagactcttaggggaggcaccagccctgtctgtagcttcactacttctgagactgaggtggtacctggtgtatcagttacctgtttctggcaacaaattattccagaatttagcttgtgattttgttgacaattaggctggacttagctgggtggttcttccaatcttggctgggcccctgcatgcatccgtattcaactgcaggctgggtataacactgtcagattttggtgtcagctgggataactgggatgactcaaccctcttctgtactcttcatcttggtcctgttcacatggtggaggcagagccccaggcaagagggaaatgtacaaagccccgttagtcctaggctcaaatcgggcccaccatctcttctgcaggcaattggcaacgtaagccccagtccagcccagattcaaaggaagggggcacacatcttctcttgatgggaagaacagagttcactgcagaggggcctagtctggggagatgaagaaatgtggccgtttttgcaatttgcctcactgaccacatagagggtgactggccctgtattttatgtcatatgtgactctatagaaatgtgtctcctagctgggctttgcagagatgcagactctatctgtctttctgttgtgggctttctaccttgtcatgaaaaggccagaaaattcctgaaatgagtgtccttttcagtccttcaggtgagaggctcctcagggatccacagaccattgttttggcttctgtctccctctgcttgtcacacagggatcacatacacaggtggaagtgaacttgtttgcttcccttcccaaactgtaagctctgtgaagacaggaatctccttgactcactattatatcattggcacctagtaggtcactgtaagtataaaatgaaagagggcaggaaggcaggaagggagtgaatgagttaggaagttaggcatctagataggaaggaaatgagagaaagcctcgatggaagaaggaaagaaagacactggaggtaaacagttgggaaagaaggaggtgaagagatataaggaatttaaattattcttcaacaagctaggtatggggcaaggcactggcctttctgaacctcattgactgcatctgtgtgatggagtaatagtagcacctacctggcttataatgaaataatacatagaagcttttagaatagggaccatcactgatggctgctctagttgttctagtttcagctgatgaaggcactaggatcctcagcatggaagacacagcagcagggacagggggaaatgctgtgggtccaaggagatagtgcaggtgctcagagggtcatggagagagagaagcagcccaatgattgccgggtgctatgccattcagtgcttcttctaggcatggctttgagcagcaattggccaggcttccagaaacttcagaacaagtggactgtgaactctctgcaaactagatgctgtgatatgcattttcataattcccccaaggatgtggacaggtggaaataaactcccagtcacacaaaaccccaccacccagagagcaatctggttgacatcctggctgagtttattaccataatttttcctacgggtacctgtgtaaatatagaaactgtagacaaaattggaattgtaccactgatatggtttggatttctgtccccatccaaatctcatgtcgaattgtaatccgtagtgttggaagaggggcctggtgggaggtgattggattctaggggtggatttccccttgctgttctcatgatagtgagtgtgttcttatgagatctgggtagcacctcctgcttcattctcttcctccttctccggctatgtcttgtgagatgtacctgcttcccctttgccttccgccgtgattataagtttcctgaggtctctacagtcgtgcttcctgtacagcctgtggaactgtgagtcaactaaaccttttttctttataaattacccagtctcaggtagttctttatagcaatccaagaatggactaatacaaccacttctgctgtatcttgggtttttaaaattcacattattttgtgagtattttctcactgcctgagaattttggggtcaggcatttttctcttcaccgcttagacactcaatttctgtttagaaaatggggagagtaagagtatctctctcctagaagttgtctattttttttttttatttgagatggagtctcactctgttgcccaggctggagtgcagaggcataatatcagctaactgcaatgtccacctctcgggttcaagcaattctcctgcctcagtctcctgagtagctgggactacaggctcacctcaccacatccagctaatttctgtatgtttactagatccagggtttctccatgttggccaggctggtctcaaactcctgacctcaagtgatccacccacctctgcctcccaaagtgctgggattacaaatgtgagccaccgcacccagactattttgttttgacctggggagagttaaatgagttaatatccttagcccagttccataacatccactgtaagcttttctatatgttcctttatttaggaagagtgaacatagtgccaagttttacttagagagcagtgctctgcatgctttggtgctagcacacaataaaattaaacggaggtcaaagcagagagcacttagggattcccaaagcgtccagaacaacagtagatggttataaaggacagcaatagtacaatgacgctgcctccaagacgaagtacagcattaattagtactgggcagtggatggccaggctctttcagggctttactgagagcctctgaagggtggcagtgatgaagagtggggccatgagtgaccatctcaggcccgtcgggaagatacttttcatgtggttgacccatggcagaaggaaggacctgtgtcatccctgagtgtctgagcatgttggggctgtgcttcgggacatggggtttttctccctggtctcgttgggatgctcttcacacctaagcagggtttgcacattcaaacatgggccgtttgtattccagccagcattgctgagaaggccggggagcagcttggtgcatactaaggagcagctcctgccctggctctgtccacaccaggctctctgggcagctgcccatggagaacacaagccagcaacctttgaggagagccaggccagcatttgaccatttgaggctgatggaccctgggtggcagggcctcggctctgcttttgggagaccttgaaggctgatgcatttcctccccagccccactcttactttacctggattgctgctgggactttgagacagtccacgctttcctattgtggaggctgtgccttgcctgggggatggagactgaatctattggtgatgatccagtaaagggtctcagagttcagcagagggtgctgggattcaccccaaatatttgggcagagggagagagacaggctgtgaaacagaatgaaataatgatgtgataggaagccctgcaagcattggcccctttaattctccctaggactctatgaggtaaggactgccccacttaccaggatatgaaacaaaggctcagaaggctcagaaggtggaaataaatctcccgggtttgaccaggagcccagcagcccttccccagagcctgttgacaaacagtgcaggcatgtgcctgtctcagggttatcttccgcctgctttcttctcagcatgcgattgcatcatattgtattgattgctactggaagactgaattcagaggcctcacagatctatatcatgactttacggaaatagaaaaagaaaaggtatttttcatggtggctcagacttacttcttatccccatccttgcaggcagaggcccctaacaaatgtcaaaggatgactgagggggctttggaagccaggagacttggctgtagatctcctctaccacttcttagccatgagaccattggtaactcatcgaaccttcctgaacctcaaatagctgctattgctatttgttacccatgagaccaaggaaatagtcttcatcatgaccaaggaatagtcatgttctagacagtgcacaagctaagaaaggagcagagattagaaggagaaaagaggaaaaaagaacaagcaggacatttttcacctaagagattgacaaaaaaatttaatttaatcaataaattacccagtcttgggtagttctttatggcaatccaagaatgaactaatgcaacaacttatgctgcatcctgtgttttattaactcacattattttgtgagcattttctcattgacaatatcaagtgttggcaaacacatgtggaaacagctcttacaagtctcagatataaattggtatggccatcttgcagacacagtttggcaatatcaagtaaaattggaaaaacaaatgctttgactgtccgtgactatttctaggtaaggaggcttggaccaggatgttcatcacaatatcaacattgtgtgtaattatgaaaaactgggaaaaaatcctaaatgaccattaacaggggactgaatacatcaaatgtggcatattcttacaatgggacacttggcaatagttaaaagtaatgaactaaatttctatgggaggaaaatgaagtggacagtataataccatgtttgtaaacctacccaccccaacaaaataatatcatatatagcatgtcaatgtgaaatgaaaaaaagactggatggagagagaggggcagggagatggagagacaaagacagagacagcaagcaagagaatgtgagagctgtaggtatcagactaaaaagacacataccaaatctctgataattgttccttctgggagtgttgaatgataaaaaaaaaaggatttcacctttatcaggaatgcttcattatatattataatagttatacatataaacacacaccagatgatagcttcaataccctccagttttgtgcatttgatatatgattccttgtgcttttaggttttcttaatgttactcaaagaaattggagaaataatttttaaaacaagagatttatttgaggagcttagagaaggggaaaagtttggatatctaatgatttttattttaaggtcaaggtatgatttgactttgctctgtaaagcaattttcttttctccgggagaatgtttgcagcaaacatttattaattagctaccatgttcatggcccacagaactctccatggtactagttctctaccaggcacacaaataaatcctcagctaagtaagtttatcttggatgactttttctctcagtttgataagaattcagcttgccatcctctggcctagctgagccacaggatgttgaaagaagatcaatgctgcctggtaagtacattcagaaacacaacttcccccagatattccagtgtttctgctgatgcccaaatccctaggtcatgtcagctatgaaaacatcagcaaatgtatggagtattaactggaaaggagtgttgttgcttcttactttttataagcccagaagattccaagaacagggaaaatatctaaaaccaagtcagaaaaggacgtaagtgcagagcccattggtgactgccgttatctgctttgaaaccccaggagttggcgatgttgtttgcaaggagacagctatgcttcctttcttgttttagtcttgggctgagacaaatatgacatttcctagatttggggcccagagctacagaaaacatggccccaaaccaaaaacttcaaattttaagtcattcatccttgaggaatatgctgatacctcatttaccccttgtgactcctaaaccctggacatacctttttatgctattaaaagaaggcttctagttttgtttactccagtctcctagatgttgtcattccccttgaatctcctgagaggctggagattatatttggtctggcaaatggttttctttctaccccctttctccttacatttattgtaaaaatattttaatagacaatacatgtatatggttacaaaattaagcagcatgaaaaggtgcacactgccatcatgaatactcttatcatcatcatcacctttattggatagtgaaaagtctgtggccgggcgcggtggctcacacctgtaatccaagcactttgggaggccgaggtgggtggatcatgaggtcaagagatcgagaccagcctggccaacatggtgaaaccccatctctactaaaaacacaaaaattagctggccatggtggcaggcacctgtaatcccagctactcaggaggctgaggcagaataatcatttgaacctgggaggtggaagttgcagtgagccaagatcgcgccactgcactccagcctggcaacagagcaaaactccgtcaaggaaaagaagatgagagaagagaagggaaaagttaagtttgcatactaaacttgctttctggttgaccagttctccttccctgaggcaaccactgttacaagtttctttttcatgatttcttgtggatttattcgtgttattcacgatatgtgtgtttgtcacatgaatgatggcaatctacacatactgttttgtaccttttcttactttgtaatatttcttggagatcatttcatggagatggatgttggtctttctcagttttttatgtgttgcctgataatctgtggaaaaggttcttctccactgccctgttggttgacactggggttgtttccaaacattcatcgatgaatcagtgctacctcgaataatcttttaaccatgtatgcatctttattttcaggtttgagtttatttgtaacatatgttctgatgactgcaactgcaagaccaaattatatgtgcattttaagtttgtctagatgtaaaacattggcctgcaaagatattatatcaacttataaaaagaaaaattaatggcagcactgtttgtcaatgccctcaccaaactaggtcattgacaattctaaaagatgggtctacaagggtagtgcttaaaaacatcatttttggtttaggttcaagccatgtttacacttgaaatggtatgatatcttacatggtatgagagtgagcaggtgggggcatatctggaaagagatcagtgtgctttggtagttgttgaagtgaagctgagtgatgagtgcatggtagttcacgtttccatgctctgtacttttgtaggtgcttactttttttgttttgtttttttgtttttgttttgagacaggggcttgctccatcatctaggcaggagtgcactggcacaattatggctctttgcagcctcgacctcctgggctcaagggatcctcccgcctcagcctcccaagtagctatgattacaggtgcaccacactatgtctggctaatttttaaaaaaattttttggcgacggggtctcactacattgcccaggctggtctcaaactcctgggctcatgtgatcctcctgcctcagcctcccaaaatgctgtaattacatgtgtgtaccattgcgtccagctctttttcctttttataacaggaatgtccaagccatatatgaaacagatccgacccacataataaaaatatggaccataaatcatcacgagttgttttctccttgtatttagcaaaagctcctcctgtgctcatggcaggctgagtgcctggcccgtgtcttcgtactctgcacagtatccttgtgaggctgagatcagtgtttttatttctgtctcacagatgagaaaacagtggtccagagagattaagtaggtagcagaaccagggaatgcagacttctcacaaagcaatacactgcttctgcctgaccatcactttgcctggctgctgcctctttggctaccatctgtctgccagtctctggggacactagttactctgacagtctagctaccagataggctccagtaagatgggaaagacctggatagaaataaaggcattctatgaacattacaccagcaactctttttaaaaaatagattttattttttagagctgttttaaatttacacaaaaatcttacaaaaagtgagttcccatatacctcctctccccttcccagtttctcctattattaacgtgttgcattgtgtgcacatttgttacaactgatcaacaaatgttgatgaattattaactcaagtccacagtttacatcagggcttacacttgctgtttacattctacgggttttgacaaatgcataatggaatgtattcaccattacagtatcatagaggatagtttcaccgaccccccaatcccctgtcctctgcttctgcagaacccctggcaaccacagatcttttggttgtcactatggttttgtcttttccaagatgtcatatagattgaatcatgcagtatgtggacttctcagactgtattctttgactaagcaagatgcctttaagtttcctccatgtctttcctgtctcgatagctcatttctttttattgttgcttaatagtccattgtcgggatgtaccccaatttgtttatccatttacctgtggaaggacatcttggcttcatcccattttttggcatatggtcatttttcagtattttccaaatggttagatttcatacgtgaatctcattgctcttagaaggtcattcagatgtgctcctgacctggacccaaatggcctggacccactgtcatcacctccctgtctggcctcttctcccactccatcttctttccccactctgcagaccctccagcctccttcctgttcttttgtgcaccatgttggatcctgcaccttcatccttttttcttctttttattcagaagactctcaccccaagtcttctcacatccagatctcagctgaaatgacacatcctctaagatgccctcctgacccccttactgaaagggttgcatgctgccaagcaaatgtccctcacagactgctctgggatttcctttactgcacttttcactctctgaagtggccttgcctgtttagctggccatcatctgtcccccacctctggaatgtcagcttcgcagagggagggaccacatctggcttatccctggctgtatcctagccctagaacagtgcctggggcctcacagaatatttgctggataagtaagtgatggattgattagtctgactactccagtgcttctcaagttgatggctttccatctacacatattgtattcatccgtgaaaagagagaagaaaccaggaaaagcacatctccaatgatgagggttatgtctctggcagcctgtattttggacctgggtgggatcatagtgtgtgttcttgtagcttttgcctgagtttcgtctacatggccctacttatggagtctaagatggagctgacagtgatgtatcattctaaacaagcgtgttgttgcaagaatccatttcaaagagatcctcttttaaatgctacttctctcccttcctcttcatctattctagcctttgaaaggtgtttatgttgattctgccattctccattcctgaggcacagataagcatcataaatatgttagttttgaacaggtcctgaaatttgccgacataattcccattttcttgtcagtacttccaagcatgaatagccttttttttcggtatggtgaattatctacagttagggatggtttaaaggtatttttatgaggacgtttagtcattgggatcacttgttcctgagtcatgcatttattttaagtctaagtcttttgaaaggtcatttagatttttcaaaaatagtagtcgtatcgttgtctcatattctttctccttgcccattttttgcttttaacaaaggaaattattttcaaggaaagcatcttcagataatgcacaaccagcccaggggaaacctagctttatagacacactagtgagatcgttgtgtaatttgatgggggaaggtttgtaaggtttgtgttctgtgtagaaaatggtgagattttaaaccaaagtttcattccagttatgaaaataagacatgtgcatgataaatattttcagatcagtgaaagaaataaaataatttttacccatagttcttctagatatcattaatattttggtgtatttccttggggtgtgtgtgtgtgagtgtgtgtgtgtgtaatttcatcagactggaaactctgagcagtcagagttcttgtctgtcgtcctcattgctctatagagagtactcctgagaagacactcagtgccaatttactgactgaatgaaagttaagtgtgtgtgtgtcacatatttcaaaacaaagtctagatagttctctatatttgattttgtgtccctccagcaatttctcatttttaaatttttctttgaaaacatgatttctaaatagtgggctgttatttcatgggatgaaaagttgtgttggaaagccccttcacactggaatctttgaaaccatcttcattcatttctttacaaaaaatctttagcagtgaaattcttgggttaaagggcctgaacactttaaagactttcatacatttttgctaagtaaccctccagagagaagggaacaagtggccttcccatcggcaaggaataaaatgacccatctttttatgttcccattaagagtggctttaagggttctcttgtaatgatgcatttttgttgtctacattagacttgttgtccctagtttcttagtagcattctgattttgctatggtatgttttcatgttcagaagtttgaaaaattgttaggtcaaatttagtatttttttctttaagacttcattaattgctcctatacttaagaaggtctccatcaccaagagaaagcaacctgctttctctcctggattattttcttctggctttcttgtaggttccttttctttccacttcagctcatgggaaatgcatttgaatgtgaggtgtagcttcctgatcattctgggtagcccagtcactcagcactctcctgagaatagtcttttttttttttttttttttttgccactgattggaaatgcacgtcttatagtattcccattttttacattatactaaattctctttctggactttttattttatttgtctggatctgccatgtcttcatgttaactgttttgataactacagctttattatatattctaatatccagccaaacacctcctttattatatttttttcaattttgagagccattctattatgtgtatgctacaagaagaatattatgagttatatcagatcagattataaaatacaatgagaattacataaaagttatacaatcattttggagaactgatatttttaccaaattgagtaatcccattcaaaagcctagtatgtctgtcctagtatttaagactttctcttttttttttttttttgagacagggtctcactctgtcgcccagactggagtgcagtggtgccatctgggctcactgcaacctccacctcctgggttcaagcaattctcctgcctcagccatccaagtagctgggattacaggtgtgcaccaccatacccagctaatttttgtatttttggtagacacgaggttttgccatgttgcccaggctggtctccaactcctgaacaaaaagtgatccgcccgcctcagcctcccaaagtgctggaattacaggcatgagccaccactcctggccagtatttgagaattttaaagtcaatataattctaagtttaaacgttatggtttcttcccagggagcacaacaatttattacgagttttatttctatgtgtttaatgttttgcattggttattgcagatgagatttttgttttcctgttaaactatctggtgattttgctaacactagaaaaaaatactaatttggattcattcattttgtaaccttaaaagagtgattcatcttactctcttagtatttatcttattacttattatttaatatttatgttaaataccctcttagtatttaaataaaatagttttcaagttggttctcttcagttctctgagtgtagattggttcatcagctgctcaaagggtgaacaatgaaaggggtgcttcctgtgaaatgttcccatggggctcatagtgcacctgagccgagacactcctggttcaagggcagttctgctgccctctgtctgtggagaaggcttgtctgttgaacctctcactgccatttcccttcctgcaggctgtgagcccaagaatgaagggctgctggatcactggtctttctgttttgctgtgagaggaattggtggtggccccctcatgcttggcctttgagcctgaggagggacgaggatctaccctgggtgtccagttactctttgagccaagtggtggatgaagactttgggggtgtggttgactcagaggccagagctgaagtgagcagaaagagcccacaccaccttccaaagcaccaattccaagtcagcaggtgaccttccagaagaattgtgcaataggctttaacttttattgtgcaaacaagtttctcacataattaactcaatggcctccagatgaaaacagtgacattaagaccccactggcttcctctgaattccctgacgaactcaaacttttcccatactggcctgtagtatctggatttctgcaaaagacaatagggttgattttggagtttcagactgtggaactctgtcctagttaatgagaagagtctgataaggccacccagagggcaagtgaggtctaggacgctgcataaacaaattaggaaatgacagagaggcaccaaaactgcagcacgtttcagctgtgtgttcctttctgtgtctctctgattcaatgtggccagtgttttctggagacttttgcaaaggtgggaatggggacacatggcactgtgaccccatctaggtggttgggcctggaggctactcatcaacccaccacccagagaacagaccatgcattcccagctcccaggagccagtgctgctcccggttcctgcctggatcacattagtgttcatggttgttaagcttgttcctataaagagagccctctccccaagagctggtaattggggaaagaagggctttttttctgctttgcttgttccaatcttgtgtttttgcttagaatatgaacacacatggtcacacacatacatgaaaagccagaacaaccagaggaccttctgtttgagcacccagactagacgcacagcagggaaaccatgcccagcctggttccctggggtctgggctcttggttctttcctttgcgattgaggaggaggcaacctgctttctctcctggatttaaaacaccctctacctctcaagtcctcacatcatctgtggaccttatcctcagtgcttctctagaaatgtcttattgttttctaactaaagagaatatgaaatttatttgcataaagaatcttttagtaatgagtacaggaaaaaaaatagtccgacttgagctggtgtaaatgaagagaggcattgattggttcaccgagctgaaaagctaagggcatcaggcaggtggctgcattcagtgatgtggaccacgccagcagggctctgctgtcttgtgcctggctctgtgtccatctgatttggcttcatcccccatcaggttctccccataagggaggaaatgactgtgtagagcccctgactcatattctcatagcttagcaatccttacttagtgatacggtttggaagtttgtccgctctaaatctcctgttgatttgtgatccccagtgttaaaggtggggcctagtggcttggggccctccccatggtgatgagttcctgacagctggtagctaaagagtctggggcctcccttcttctttctctctcttgctcccactctttttttttttttttttttttgaggcggagtctctctctgtctcccaggttggagtgcagtggcagtggcataatctcagctcactgcaacctctgcctcctgggttcaagtgattctcctgcttcagcctcccgagtggctgggactagggggcatgccaccaagcctggctaattttgtatttttagtagagacagggtttcactatgttgcccaggctggtcttgaactcctgagcaaaaaacgatcctcccacctcagcctcccaaagtgctgggattacaggcgtgagcccccttgcccagctcttgctccgactcttgccatcgaacgtgcctgctaccccttcaccttccaccatgagtggaacttcctgaggccctcaccagaagcagacatcagtgccgtatttcttgtacagtctgcagaaccatgagccaaataaacctcttttctttataaattacccattctcaagtgttcctttttaacaatgtgaaatggactaacctgggaaaacacatattttaaattttcctaacagttccagaaaaagtcctggaatggattctcattggcccagcctggtcacatgtccatcccctgaaccagtcatggtggccagtgaaatgtgatgctctgatttgattggccaggcctacctctgtctgtacagctgggtcactggggtgacagatgggagcatcagctccatccaagccaatggactgctgatggggacagggggagttcatcaggataagctgggcacgtgctactgtagtgatctgaacttttgaggggctcacaaccatggtgcctgtgtctctctaattcggcatgttgatcatgggatagcaaagggacgctgcttatggaagttctctgggcaccagctggaccgaggcaccacatccacatatcctccacaatcacagaggcaggaagggggaacatggagaaccgtgccctggctgggaaagcatccgcccagaaggggcagatgccacttgcactcctattcagttggccagaataagtcccatgtgcaggcctgggttctacaggtggggatgtgtaattccctcccgctgagaggcacagagcatttgtgagtcataatagagtctgctttcggttgccctgctggtccccagatatttaggtcctgcttcatgggagacagccccaaagtcccactcagtcactactcacagctcattgtctaggatctttgggtgatgaatcattatctttacatcgtgtttggacatggctcttctttattcagagacttatgacaagtgatctgcccccaccatcaaacacctaagatttaatcttgaaacagggataggataactgcagtaaacgttcagaaaagggacgatgaactgtcaaatgatcgctaccctgaagttctcccatgcaaatacagtgacattcccttctctgggggaaagagagttccttcattgagctggtttggctccatgggactaccttccagtcttcattggccttcttcattggctttagcgccacctttctgaagtcttccctttttggttatccttgctggcggaatcaaaagaagatattggaagacatgctcttcatagagtatgagcaggtgtctcagcctagaaaaatggagacccagggattattttctacaacgttcagtctcttttattcaatctggtgatggcttggacaataaaaatctctcaaaacttttttggtcccagttggcttcatctgccaaaacacacctacagtttttctgagatgtaccttttccatagatctaagaccctgatcttgtcaggctcccataaaagagctataaccatggtccctttgccaatgaattttgtcctagtttgctaacaccacataaatccatttgggatttttaaccacaggtgtgacagcagaccaattctaaaccaccctttgccagttaaaacctttttggctttcttttgttgcttttctcattggttctaagaagccagggttttttttccaatcttacaaaactttgaagttctagattctcttttatttttgccagaccctgttatctgcatagacactttcccagaagtactggttatattattgaataaagagagtagtttgttaccttcatcttaggaagggcaatttggtgacttcaaatgtgagagttagcacctacttgggagtaggaattgtccttagtatgttttaggaagaaattagatttttcatgccttgagcctcccctttgtccaggatgcatgaaggacctgatgggaattctgggtggtgttgggggagatggtgcaggtggaacactagtttcctgaggttgactcagcactttccattctgctgagtcagagtctcggtgccttccttgattaggtaaagccatcccttggcatctctgaagtgcagcttataggctacttgtagtgatatgggacatggtcttttatggggtcatgtgtattttgtcatctggtccttttgcagaacctgttgtgttctgacattcctgagttggcagaggaaaaaatcaggtctcagggaacatgttggtaagtggcaaagtcagggttgttgctcaggtcttcctggcttgaggtcttttcttctttctatttttgcagattggtttctggaaagatttatttaaatcctctctagttcacccctattcttgaatcaaaaggcttatcttaacaagcacaaaaagccccatttattcaggtattataaacaagaatggaaaagatagatgtggcctcatttactcatcccattctcctgctttttatcccacaccaggagtctaccaggctctaagcagacctcaggaaggatggggctgtcagatgtgagatgttagtggtcctcattggactgtgactgggtcctggtttttgaagcttgttttgtttcttgggaggcagcaataaggtcaagctggggctcaaagcatcatcgtaaccagcaaaatggggaccacagcagcgagttcactggctaggccctttaaaaggcaggcacacactttcaaatttcccactatttttaaccagcttgcttgcttgcttttaaattcatgtgtggttcctggaggcacttgacctctttctacagagccttcccctctgctattttaatgaacagctgcatcaatgactccctaaattccaactgcatcttcttcatcctcattaacctttaccttggcattcaagcctcttccaggcctcctcctcctttttcttcctcacctctcttaccatggctttccctcacccacttcttgatgttcctgcatcataccttcctttatgggaatgttctttgccacctgtcaggatcctacccacccctcaaggtctggttcaaatgctacaccttcagaaagattttgggggaaaaataaagtcttttttctttttgagtctaaaagtattgcacactcattatagaatatttataaataaaattaaagtcattcccagtcatatcaaccagttaatccctacaaatatttgcatattttcattcatctttcatgtatacatatatacagaaaatatttataatactgatgccatattgtatatataattacatatcccaattttaaatatagcatgtgtcttgaaaattttttggtatcattaaatgtttttcaaatacataattttcactggatacttgaaattctgttctacctctcttctacaattatgtaaacattcctcttactgtttggttgtttacattgttgtgcgtaaggctttgtctctatctctgattatgtatgtagaaatataagtatttttgaacagcgtaaacttttttaagctcttgacacacattgccaaacgttttctcagaaaggtggtatttgttttcactcccatatgtactgtaagctcatctttccaaatcttttccaatctgatgagttgatttttaagaaatcaactaccagtttggcaaaaatggaaactcattacagattcccctcaacttacagtagggttttgtcctgataaactcatcttaagttgacaatatcatgtcaaaaatgcatttaatatacctaatctactgaacatcatagcctcgcctgtcataaatgtgctcaaaacacttatgttagcctacatttaggcaaaaatcatctaccacagcctattttataataaaatatcaaatatctcatataatttatcaaatactgtttaccccgtcaaaattgcaatggtttcacgccattgtaaagttgaaaagtgttatgtagaaccatcgtaagtcagggatagtctgtatttaatttgtttcttttggggtaacttgtagagtttaattttcttttttaagttgtttactgctatattttttcttctgaaaacgattgaaaacatttgtactcttttcaatggggttaagagaagaggaagattttgtgcttcttgttcattttaaagaggtctttatatattaaggacttttttttcattgattgtgaatatattccagagttcattattttacttttttatatgaattttgaatgaaaagttttaaaaattcttatgtaatttggactagccattcttttgttcttgattggttctatttcttttaagcttaaaaattttatcttaaccctgaatcagtttttttccctagattttctacaactgtacttttcaaattaaactgaaatctatcttagtgggggtatgaaagatttccagtgtgacttttccccaaatatctgattatgattctgctatgcgttgcattgttgagaaatgcttttcccattggcttatggtgcttttgttcatcttgacctaacctatcccatatttcatgtagatgcaccccatgatctgagtaatgacacttccactgtggccatgcagttttgattattatagctttgagatgcatttccaggtctgttagatactcttccttgtcatttttttatactgtggtcccctcccagccataactttgcacactctcgagagttccagtgactgttgcaaatgcctttaactcttcagctcactgtgaacttcttgaggacgggactcaatttgtcctaatcaactacacatcctctgtatcatagcccatcatagcattggccagatagaattcactgaaaacacatttgttatgttgattgtgcaatttctttctggtcattttctgggtgacttgtatttttagaaaacctacaatcaggtgtattatttgattaaatttaggaaagaaatatatgctgtatttaattggcttgtgtttctcagcttcaacccaagttaattcaactttcagtgttgtttgtaattaccagacatttagtacattaatgaagacttctttccagtagcccatttatatttactcttgaaaaatgatttacttttgatttcaaaccaaaaacattatcattctaatttctggattctctcatttctattttcaacccaaaacattccgttgagatatgaaataatattggatcagcctggaaggagaccttgggtgaacaaagcgagtttgcctcatttctcacaacacggtctagggtctgagttctcattttgaatcagggtggaggtgggaaaacagctctcctgggtgcctgttgaatgtgtgcctttttgggcatctgtttacattcatgagggtccacagaggcccagagaaattccaactacttgagtttttttttctatctacattttaacacttaagtcgattcctggacatatctggtacttcttgtgttttctactaggcataggacattactttgcacagagcaggtgttcaatagacacgtttcttttaatgtaaaaaaatttattgaatatgaccctcacataacaaagcagcccagtagtccccttgtgtacccccacccaggtattcccagagagaaccactgtcttaatttacatcgtcttgattagttttacttgtttttgagtcttacataattggaactgaacaatatgtaatgttttgtatctgtcttcttttgttcaacattacatttctaagattggtccatgttaccgggtttgataatatttcatcattttctttgctgtatagtattccaatgtgtgaatatattctcaatttatccaatctactgttaataacatttgtgttatttctagtatttggctgttatgagtgatacctctggtaaccttcttgagctcgtttttgtcttttgctttttttttttctccttttttggtaaagaattgctgggtcatatggcttgcatatgtttggcattagtagatactgtgaaacagtattccaaaatgtttgaaccacggtcaactcccacagcagcatggaagttctagttgctctttaatctcccccacccacccttgatactgtcagctttttctaaacaattttagacatcatgatacttgtatggaaatattgcattgtggtttaattggtatttccttgaaaacgaatgaggttgagctcctttttattttttcatggctatttgtatgtcttctttatgaagtacctgttgagttttttgaaagttttaaaaattgaattctaggaatttaaaaaatatatattctggatatgagtctttggttgaagttcctcaatgtgctttgcctttacattcacttaattatatattttcaggaaaagaaatatttaattttaatgtaggtccatttagcaatcttttttcctttttgtatcttatgtaaggagtatttgcctacccacaaaccataaagcttttctcctgttttcttctagaagtgttatttgttttgctctgaaatttggaatcagaattaattttatgtatggtatgagggagggatcaggaatcaattttcccatatggatatcccattgatcctccaccatttggtgaaaggaccattcttttcctactgcacagctgtgttcttttctcataaatcagtcagtacactgcgtgggtctatttctgggctccatgttctgttccattggcctgtctgaacttgttccaatagcacatcatcataattgttggagatttaaaatcagtcatgatatctgatagtggaaatcctaccactttgttttttttcttcaagatcatcttagtcattcttggttctagacatttctatataaaaatttgaattaatttacacacatacacataaaccttttgtaagttggattggaattacattgaacttgtgggtcaatttaggaacaaataaaatctttaaaacattcagtaatttggtctgtgaacatggtatatcccaccttgtatttaggctatttttcttttttctcaataatgtattctatgtataggtcttatgcacatctttggctagatttattctggagtattttatgctgctttaatgacatttaagttatctcgtttaaatataattttctaattctttggttctggcatatagaaatacaatttatttttgtatatggacttcctatgtaagaaacttgctaaattattctaattaagattattttggattttctaaaaacatttctctggagaaaaaaaggaaagcttcattttttcctttccgatccttaaacattttattccttgttgttctggttaaaacctctaatacaattttaaataaagaccttcttgtctcattcccaatctcggagggaaagatttgaatatttcatccttaagtatgggtttgcaatagattttttgtatatattcctcatgaaattaaagaaatttccttttattcctaatctgctggcagtttctaatcataagtgtgttaggagttttatcaaatgctatctctgtatttgtggaagtgatcctataacttttctaatttattctgttaatgtggtgatttccactgattatttttaaatgtcaagctaatcttgcatttctagattaaacctaacttgttttccatgttttgtctttctgcatttctctgcctctggtttactaatgttttctttaggatttctgtatctatggtcacgaaagataggcctgtcattttcatttctagtgatgcccttttctggctttggtatgaaggttatgctggcctcttaaaattgattccctcatgttttttattctctctgacacttgtgtaagactggtattatttcttccttgagagcttggaggaatttactgtggggcccatacatccttcatcagatactcaaatgtttagaagaggtgacatcctttacgtgaggttccaagttaagaaaaaaaatgttaaaggtagaagcagaggtgcctgtccatattttctcctagtgggaatgattcatttgtatatttatttattcagcaaaaaatatcctaaatgtttgtagcacaccagacactgcagcagttaaggatacagcagaagtgaaacacacatgcctgccttctaggagttcacattctggaccaaggagtgttttctattccagtttgagagtgtgtgtccatgcacctggctgtgagctctgggtccctgtgtgctggccctgcccctcctctggctcatggtgctcactccactccagggctccaccccatgttttcagtctccacccagacattgcttcgggaccttcagcaatgaggttccctgcccctgctttgctcttcccttcaccctttgtgtgtgtgtgtgtgtgtgtgtgtgtgtgtgtgtgtgtgtgtgtgtgtgtgtgtgttgtgacagagtctcgttctgttgcccaggctggagtgcagtggtgcgatctcgatctcagctcactgcaacctctgcctcccaggttcaagcgattcttgtgcctcagcctcccaagaagctggaattataggtgtgtgccaccatacctgtctaattttcatatttttactagagacggggtttcaccatgttgcccaggctggtcttgaactcccaacctcagatgattcacacacctcagccacccagattacaggcatgatccactgcacccggccctcttcactcttcaactgagagtcctgctcattattaatgtcactttttttagagaggactttcttggtccctgggctaaaggagattctccagtcccctaagctcagagcccccatgctcttctctcctagcatttacatgttcataattcacacatttatctgtatgattatttttgttttaatgtcatttgttgtcaccaaattgcgggcttcatgatgaaaacagttgcacctcttctactcaccaatgatactcttgtgcccaatgcaaaaccaggcacacagtaggtgctcaataaatgcgccttgctctccttcctttctaaagggttccagaaggccattaataggcaaaaaacgcaagcgtgggtgaaggctgaatctatcatgctccctgatgggtccccatgcccagcactgggtgctctcttagtgttagtaaaatacatgaatgaatgaatgagtgaattaatggatggatgaagtgcaattgaaatttattatgctcataaacacaaaaattaaatagatttactgcattaagattattttaagaagttgttttattcctacattcattttgtttccaacacaaacagtacataaaaataattatttcttggattcatgaaaaattgaaagggcccttgagtgtttatttagtgtattctttttggcagaattaatgatcttaataatgaaaacagcactgggtgacttttttaaattgaagtttttattgagataattgtaaatgtgcatgcagctatgacaaatggcagggagatatcttgtgtaccctttcctcaattttcccccagtgctaaactagaatatacacacctaattgggatactgacacggatgaaatccactgaacttatcccactgtctaacttaattcacatttgcagcactgtgctgagtgctttatctcatttaactgtgacaacagccctgtaagggggatagcattatcactcaggttctagagcctgggacacccgtgctcagagaggtggagcaactcgctcacagcctggtgcatgctcaggggtggagctggaatccccactggaaacccaccccccagcccgtgttcttcctggtgctggcgtaaaccatgatatatagatctgttccttgttagagatctctaaagaagaaaactacttgcttaacaaaaatgactttgctatataaaggtgtggtttttttgactattcctccagaatggcattttttagaagtctgaagtctaagaaaacctctgcaaaaattcaaggcacttaaatctttgatgaagcactcaaatgtattcatttatcatccagtctttcagtttcattgtagacagatttatgtcctttgtgatggtagctccatgtcctggaatggacctcccatccaggttcacagatacagctaagaggctggaaaaggtcgcaagtggaaggaagcttgggtttgtagtttcctcacatattcttagaagctaggggctggggaaacccagaagttaggtggtcaagggcaaaaagattctcccttttctgtctttcttccccaaaccttgtcacatggaagatttgaaatggctcccccaggcctgagtcctgggcagctgtgtcactgttggtgcccacctcccaggctgcttgctctgccctgcttggagaatgacaacttcttaagttgccacacagtacccagagccaccagttcctctcctggttgctgtgtggctgagactgaccctggatcatgaggcatcctgctgcccagcccatcatttccatctggtcctgttggggaggaagaaaatgcagaggcaaatgcagatgcagtatctgtggctgggctccagcaagacccctccaaggtctctgaccccagggccagtggtttcacccacctggaccatctacaagggtcaaatccagtgtgtgcagtgcctggaattagaggaaagagacatgcaggtacagcatcgtgaaaggccccttttgatgctatagaaaaaaaaaaaacctccaaaataattttaatcatgttcctatctttgtttatatttcattatggaatgagatctggttttgacttatattaaggtgacctgtttgaaattgccaattttgtgggtcgatgacagctgaatattggcagttttaaatggttcaatctaatgcgagttaaattaaaaccttgaggaatatgcaacttttcactttacacggctctgttttaaaaagggtgtcaacatatttcagccttgcggagatggcggcgtatgtctatcctgtgttgcaagcagctgtgaatggttgcgtcgttttgcttggcctacgcatgggcgtgttgtcaccagaaagcgtctctgctcctccaagtggtggcaagcccctcctgagagccattcctcatccagacaagaatccatcagatcttatgaaaatttaatgtgtgaaagtgtacagttgcatgagggtttttttcttttaaataaattagtttgcagcccttgctaacaccagatgaatgaattaagaatgcacctcccccggggctgtcgggctgctaaactgcatgctggggcgaaattccctttctcttattcttagctttttctttttttttgaaacagaatctcactctgtccaccagactggagtgcagtggtgcgatctcagctcactataacttccacctcccgggttcaagcaattctctgcctcagcctcccgagtagctgggattacaggcgcctgccaccacacccggctaatttttgtatttttagtagagacagggttttaccatcttggccaggctggtcttgaactcctgaccttgtgatccacccacctcggcctcccaaagtgttgggattataggcatgagccaccgctcccggtctcttagcttattcttaaggggaatttcctaccttttatttttcttcttgagagagtttcaaatttgccagaacctgaagggttgttgtgctttcagccaaaaggatgtctcagtagcctttagcccaccttcccccagggcaatggtagcatggaacatgcaacccctagcttacttgaaagattggacttgaaaaaaatcagcagttccttctggaatctgcaaggattggggaatttgaaagattcaggggaattagttcggcttcccaaactagttggttttagtgaccccttcttcttcccgttgcatcactggtgtgactgatgttaacattattgttgccccgttttacaaatgatgaccctggaaaggcttggagggccctggggctgcctaaggtcataggccaggaagaaatggagcctgtccgagggcttgcgtctcctcattctgaagcccaggctttctccatgttttcaaaatgccagctggttgcattttgtttttccaaatgatattgtagatgccagaaagtggggcctgtgtttccatttcttggttttcctgcccttccagctctctcataggaggcatatgatgagcacagggaacaggcatctgtgctgggcagacctaaaacgaggaaggggcaccgtgaccagttaccttgcggtgtggcacagtgctatcttgaagaccataacatctctcgagcaggctagcatatctggtccgaaaagtcgccatttctttgggtgggcttgtacaaagtggtccacatctcacagggtggtctgctgggctctgcaggcccgtgttgtgtccataatacatgatcaataaacacaaaagctgcccatcaatgaatccaggtgttcacccggatgggcgtgggaaactcagacaggcagaggccacgggctcttctgtctctcaattcctgtcccctttgcatactgggggggcacttgctgggggtagtccagtaattttatctcatggtgctccaccagagaccatggtgctgatggcacctactaagcgcaacgctgtgcttgactctaccctctgagtgtgcccactcagggctggtctccctcatgcagcccgaggcctcctgccaaagtccacttcaaggggaagccgaaggtgcacacaatcccctacgtctcctttgatccaagtacatcagctcttccaaattgtgtttgccgtgcattttttttccagaatcctcttaagaaggatttaagaatcttgccaaagtggccacttctcctaaaaacatctaacccagtcctcgcagattccagaaggaactgctgattttttaatttatcttcagtcatttgctttcggaagggaacatttattgtgttgaaaattaaagacttgataaaaaatgtttgctttttgtggtgtccttgaaaatcgagtgattttcacccaggatttctgtagtgggtgtcaggcaccgtggatttctgtactgggtgtcagggaccgtggtacaccacggtgcttagaaaaatggatgatggaggtggtgctgtggctggctagcatttattaacattgttattgccaggcaccatgtcaaccctttcctatgcattagctcatttaattcttacagccactatttgtggcaggtactagtattatccccattgcacatgacaggaaacggaagctcagagaggttatgtaacttgcccaagtttgaacagttaataagagcttgcattcaaacccagtccattctggctcatggggcccaagccttgctctgctgccccaggctgtgtaggatgcatctgcggtggccattcttctctccagaggtccttcctaggactgactttgtggagattctgtgctggtaggtggcggggcaagacacgcctgtctctccccctggaaggagtcagtccagcaagaaacctgatgaaaccagtgactcccagctctgggtgagacatgatgatggggcgatggtgggggatgtggcagcacaaagcaactttgtccactgatgtcgggaacgccttttgaaggaagaaaagtgtaagttgttacccagagtagaagatggccaggccaggagttgggaagggggttctagaaggcaaagtgcgtgtaaagttcttgaaactagagatacctaaggaatctagatgaggccagtctggttggagcaaagggtgatgagtcgggaggctggagagtgacaaggaccagattgcgtggggaggatactgctgcctgggggcttcccatcctgagggcggaggaacttgaacacagtagttatttgctatcaactgaaatgtattgagcccctgctgctctgtgggcatacaatggttggacaaacagacaaagtccccgttctcaaggaacttgtattccaacagaaaagaaaagaaatacacaagacgacgtcaaagagtgacaagtggcccaaagaaagtaaaacaagggcccagtcagggtgactcacgcctgtaatcccagcactttgggaggccgatgcaggcagatcacaaggtcaggagatcgagaccatcctggctaacacagtgaaaccccatatctactaaaaaatacagaaaaattagccgggtgtggtggcgggcacctgtggtcccagctactcgggaggctgaggcaggagaatggtgtgaacctgggaggcggagcttgcagtgagccaagaacatgccactgcactccagcctgggcagcagagtgagactctgtctcaaaaaaaaaagtaaaacaaggtggcacctcagattgaactgaggaaggtacaggaagccactacagtgggtgggcagggtgggcacctctgtgcagtgggcattcaggggtgaggagtcagcactgtggcagtgttgggagaaggtattcctggcagagagggtggctgattggaaggccctgaggcagcaacaaacagggcacgatcagggacttccctgtgcagtcagcgtggctggaatggagggagcatgatggagaaggcaccaagtgaggccagaggctcctcagggggtttggattggatccttaatggaggggtgggaggatgccctggagggtttcagcacaggacggcaaggcctgctgtgcattgctggggatctctttgcttccataaggtcagtggaccgggaagtggccagaatggcagctgggatgggcaggggatgagggggacactcttgccatcatgcatgccacacatgatggggagtgggcttgaggggcagccatggcggaagaggagccctcaggggtttgggagaggttagcaaatactcatgcttgttttgggaggagcctctgctcacggtgggggcatgggggtggtggtgagcaccgcagcttgtaagaggcaagcttgtgtggctgctgggtcccacgtgctatcagatggactcctatatggtgtgctgggaaagacgccctgtggctctcaaccagctcagcctatggccctgagagaggatgtgggcaggccctgaccatcttggttttcttccctttttttcttttttatttatttctctttttctttctttctttctctttctttctttctttctttctttctttctttctttctttctttctttctttctttcttcagctttattgaactataattcacatattatacaattcacccttatacagttcacagttctgtggtttttgctacactcacgggtttgtgcaactgcaccacagtctaattttaaaacactttcatcatcccaagaggaaaccccatgtccattaagtgctccctccccacttcccctttccctacccctggcaaccgtgaatctactttctgtctctctggacacttcatacaaataggatcgtacagtgtggggtgtgctgtggcagggttgtttcacctaacaccgtgttttcaagttcacctgcattgcggcattgccagtttagggctgatagtattccatgatacatagaccatactctctttatccattcatccgttgatgggcatttgggtttctttcccactttgtgtctattatgagtagagctgctgtgcatattcacgtgcacatttttgtgtggacacctgttttcagttctacgggatctactcaggagtcagatggttatatggtgacccagtcttcggggcaagctcaggagcagaatcatcgtacggtgactcggtcattggggtctactgaggagtcgaatggtcatatggcgactcggtctttgggcaatggtaaggagtgagaatggtcatatggtgactcggtctctggggtgtggtcaggagtagaatgttcatggtgactcggtcctcaaggtctgctcaggagtagaatggttacatggcgactaggtctttgtggtctgctcaggagtagaatcactgtatggtgactcgatgttgaattatttgaggagttgccagactccttccatgttggctgcctggtctgcatcctccccactgtgtgtgaaggctctgatttctcacctccttgcccacaccttttattgagcctgaacacctttcacatggtcacacctgacctgagcagctgcccggccatagtgccaacacatccctggccacgagaggtggcgcctgggctggccaacgtgcaccctcagggtcgggatgtgatctagagcagggcttctctcattctgttcctgcccatgttcatttcaacccccaaaaggacttgagctctcaggcttaatttcatttacttaatgcatgaaggaggaaatgatttctgaggccaagaccggagtggtccccagggactccatttcaacagtgtatttaaaccaccacgtggaggttgcttgctaggctgggaactgtgatcaaagaacttccaatattttatgttcataaaggcagtttgagagtaatgttttttaaaaaggcatctgaatggggaggaataggatcattgtgaggtccacagtctctttgcctttgaagtttgcaagaagctactgaatgagttccatgctttgtaatactctggtctgggcaccctcaggcgtgcgtggccggcagggacctgtaggaatcctcttcacctggggagatttgaagcctagtgcatataaccagggccgtcacccaatgctgtgtgatcctgggccagtcagttagccttttgcagttagctgatcgttttcacctcagcttgaggcatctctttcaggaagtttctccagttccagtacacgctctcaagcgactctccccctctcctcaaaatgcttacctgcattttcatgatgcagctatgatgtgcaacattcactaattgatgtctgtgaaccctggtggctgtgtgccaggtaggtatgtgctcaggtgtgctgtgtgctcagtgaggctgtgaacccacgtgggtgtgagcccaggtaagctgtgtgctcaggaagctgtgagcctaggtgtgctctgtgcttagtgaggctgtgagcccaggtgggtttgagctcaggtatgttgagaggagggtggatgtgagcccaggtgtgctgtgtgctcagtgaggctgtgaacccaggtgtgctgtgtgctcagtaaggctgtgagcccaggtggatgtgagttcagtgaggctatgcactcaggtggctgcaagcccaggtgtgctgcgtgctcagtaaggctgtgaacccaggtgtgctgtgtgctcagtgaggttgtgagcccaggtgtcctgtgtgctcagtgaggttgtgagcccaggtgtcctgtgtgctcaggcagctgtgagtccaggtggatgtgagttcagtgaggctatgagctcaggtgggtgtgagcccaggtgtgccgtgagctcagtgagtccaggtgggctgtgtgcccaccgaggctgtgagcccagatcggtatgagcttaggtgggtgtgagctcaggtgggctgtgtgccttattgaggctgtgaacccaggtgggctgtgagctcagtgaggacagacaccacacctggttttgctcatgggtatcaccccagtacctggcccagagcagatgattgtcttgatttgggttttggggaggtgaccctggaatgaggatttgagagcaagtaatttataagaaagctgtcccaggagaagctggcaccagtgctgggaaagtggcacagggaggccaaggaggggtagtatcaggcacagctgtgcaggggcagttgcagcctgaccctgagggtactctgagcatgagtgtgtcagagtttgtctctgctgaggccaggggctaggctacattcttgccaccaccagtcattggctctcggctctgtgcaggaggacagagaggctgagaggctgggagttggcctgtaggggtgcccttaggggcaaaagcacatgggagctgggaggctccacagccttggactggaggggtgggcagagcactgacagtatccgcttggggtcaggccatgtggatccagtgttctactccgatcctctccgacaggccttccagaacagggtgtaccatgtgctccagcacgagggagacgtgcttctgatgtcagctatagcagtgcctccagggtcgatggcacgagcccagttgacaatccccacagccagatgctttgaaatatgtgatccttgataaatttttaatttagggtaattttaagtttgcatattgcatgagactttactgctctttgaaatctgcataaatcacagtcatgctgcatgtttgggttgtcacttggcatactggccagctttttgttggccccccaatcctacttctgctaagggctggcctggtgtgtgtgaccagaatgccaggcccagaagccaccagcactaagtcaatgggaagtgctttgctcagtgcagagctgctgctgctggaatcactgcaccacttattccccatgacactgggcctcctcgccaccaggtcaagccagactcaagacgcaggcaaacggaaaaatgcagaactgtttgctccttctccctccctggaaacccctgctcttataggttggctttgttggtccagccccagcttcttgacttggtagggagttccacaggatgaggacatgctttttgtgtttttctttgcactaaactatgtgtaacatcaaatttaccatttcaacccttttaaagggtacgattcatgtgtgccaatcatgctagatataatttgcattttcctgaatattaattagggggaacatcttttttatatgctgttgacggtttggatacctccttttggaaggtgttcccggactttgcatattttccacagggttatttgactttgttcatttgtgggagttcttttgatattctagaaactggactatgtccagttaaatatgttacaaacatcttttcctgcactgtgttttgtcttttcattttacagtgtttttgattaaattcttaatttaaataaccaaagagtacagttcagtgctctgtgcagtgagtgcagtcacattgttgcaaaaccatcactgctgtctaattccagaacctttcatcacctacaaggaaattgtgtgatactcctcattctcccctcctccaagcccctgataactacgcatctactttctgtctgtatgaattggtctgtgctgaacatttcatgtaaatggaatcatacgctgtacggacgctatatggacttttgtggccggctgtccccatgcagcatcatgttatcagggtccctccacactgtagcaggtgtccaggcctcattcccttttatggctggggaatgttccatggtctggatagactatacttgatgtgtccatttgtccgctgatggacatttgggctgtttttgctttaggtcatactttctgcctgatgtaaaagtgccagtcgtgtataaggactgtagtcagcgccaccatgccacagcttagagaagggatgggggaactactgggttgtcagaggcgccgttcttgaccctcagagactttctgtctcctggaggagaagtggctgtgttgggcaggtttgaatcttgagaattcacggtccctgggtttgaggcctcgctgtgccacttgatgccatgtgaccttgggcaagtcacctctccctctgagcctcacttttctcacctgttaaatgaggtacttataaagccgaatagcctaattcaaacattttaagtctgaaatgctctgaaattcgaaacttttttagtgttgacatgatgctcaaagaaaatattcatcagaacattttggatttcaaagttttggatgctcaactggtaatgcaaatattccaaaatcagaagaaatctgaaatccgaaacacttctggtcccaagtgtttcggatcaagaatactgcacctgtaacacctgcctccttagtggtgtgatgattgcgtggaatgagacatgaaaagggctcagcccaaaatcgtctggcaccaaatacccaatggataggggattttgtttattttgttgttactgttgttgaggtaaaattcatatagcacaaaattaactattttaaagtgtacaattcagtggcatttagtacattcatgatattggcatctgccacatgtgtctagttcccgaacattgtcacatcacatccaaaggagatcccatgcccattctcccctcccacatcccgcggcagccaccactctgccttgttgagtggtcttctgtgactggctcctttcgtttagcaccatgatcttgggggtcatctgtgctgcagtgggtgtcagtgctttcttcctggtaagagcgtaacatggtgcagtcattgtggaaaacaattgggtggttcttggaaatgtgaaatataggattactgtatgagctagcagctccacttccgggtatctaactaaaacaactgaaaacaggtattagggggaaaaaaacctgcacacgaatgtccaatagcagcactgttgttcacaatagccagtatgtggagacaacctaaatgcccatcgacagatcgatggattaacaatttccatacaatggactattaccttttgttattattattattattatagctttcttaactcctattgattttttcaaaagtgacctcagctgtcatctcttttccacaaagagtcttacctgagtctggagaccattcctttttctgaccacagaaccccgtcttaatctctgtcctgcctcttccactcattaattcattccctgattccttccaaagtatttgttgggtgcctgctatagacaaggtcactccagtggggagggaccgacaacaccaagtcagctgaaataacagcaccgtggagggagtgtgtgccatgcggagaattttgggttgggtgggagggtgcttggatgtctcactgttgctctgatggaccaggaggagatgtttgcaatgaaacccaagtgataagaaggaggcagctttgcaaaggtggaggagagcctcccttgaggggctgcttactaggatccggaggtggggatgagcctggggaggctgcagagaactgtgaggttggagctgctcacagggagaggtcacagggctttgagggccaaagggaggcctaactcctgtggaagccactggagggtttgaggcagggtaaggcggggtcaggggtgtatgccatgtgacccgaagggagggcattgcgggaacctgggagcgatgagggagacctgggccgggggagtcagggcagggcggatgtagcaaagtcacattgtcctgagtgaccattcacttggctgtccccgctcccaggcctcaggactgtgagggcaggcactgggtctcaggcccagagaagatgctcagaaaaggaaaaggagaccggggcacgagtgagccagtgcagtgtgcagagtgagggggcagtgggcaaagaaattgcatggcccagatcactcactggagaccagagacaccttagtgtcccaggatgatgaagagcgaggggccagagctaggggagttagtgatgcatctgctagccgggctggccctccctgtgggcacagagaaagtggttcctcaacagccatgggtgacctttaaggatgcccacagatggtgccatctcaggagaagggtcccagagggactggctctgtcacctgctgtcagctgctcccggaaagcccgcactgcatgacttgctggtttgttggaatggttccatcttgctgtgtcacttccatgacaatcaccagaggaaccaggcccaggcaaggggcctgtgatgaagcgagcagccctgatgacatcagaaatgcagacagttccagacattcaagcatgatgtccttggctcttgggtgaaaatcctcctcggtgtgtcagggaaagtcattgaattcacgttggacccggacttggtaaatcttcagaagcacgctctattctgcaggatttaagcttcagatgggcctagactggtatgcacaggtagggactgtgcacttgagcacagatggaccttcagcccatctccttttggttctcatatacttgttgagccctggctaggccctcctgagctctgtttcagggcctgcagaggctgctgtacaggtcacacttggtctctgctctcacggtcaagtagccaggatggacataaaactaatgaacacatacatcaagagctaattaaaaattgtgctgaaggccatggtggaaaaataacaggaaacctaacaggtgggtaggaagggtgagaccatgagggatgaataggagttcatcagagaaaagtgttgcctccagagggaatggcacagaaggcagccctattgtgggaaagcacttaatgagcgaggagggccatggtggtagagaagcttaagaaatggaggccagggctctggggttacagtgggggttttatatttcatcctaagagccactgtgatgtcatgtggggagcaatataaggccctgtttgcttgcttgcttgcggggtaggcaggagtggaagcgggaaaccagggcagaggctgcagaactgtacaggtgaaagtgatgctggactgcccccaggggttagaagtgaaatgaagataagagatcaggatccaaaaccatttattctctccctttttcttcttggggcacccagtagtattttttcccagaagacatttcttaaaggatcacttaagccaggaactgtcaaatgcacaaaccaaatgcactttctactagtttttgcaaataaagttttattgcaacatagccatgcccattaatttatgtcccatctgtggctgcttcacactacagcagcagagctgagtggcggcagcagagactgtgtggcccgcaaagcctcagagttttattatttggccccttacagaagacatttgccaattcctgacctaagcaaagtgagtgagggacgcattttcaaaacacaaatctgttggcttaaagtcttcctagcacttaaatgcatttaatccctctgaaaaatgctagagtagacacagtttttaaattgacttttgtttttctttaaccttttgctgatattatatataagaaactcaccttatgctttaggtttagaaagtcagggttggaactcagactttgaagatgttgtgtgatattatttctctaaatttctactacaatactaaagtctcctgatgtgttatttcactttttgtcctttctctgaaatgctcattttcctccttttctgtaaaatataatctcagggaagaagtttgtaaaagcagcttttagcctttgcaaagatataggtgggcctcttgtacaataatttttataagagtttgttctttgcaaatgcagatgcatcctactaagccacatacaaaaaaatcatcacaatgatgacaacaacaaagccaattttccagattccacctttctccttcctcatcctcttcatgtttgaatttgtgctgccaaattctatagagcattttcagatccacttgatttacagatttgagctgaatttcacttggaaaactgaccatatgtctggcaggcaccagcgaccattggcagtactatagggttgatactaaacagatgggctttctagttagatgtgctgttttttccacaatacatatgagaaagaaaagaagccactttaataatgtcttgatttttccactggtgtcagagtcatcaatgatgcccatttatgtagtcttaatttcagcatcattgcgtgcagggtgccttagacagctagaagaagcttaatgacttgggaaattttgaggcccaacttctgcctagatcttagagaatcttgttatctttggaatacagatagtggataaaagacttttatagtccaaaaataaattattaacactatttgtcaggaatacattcaaagttcttagtcctgggtttattgctcaaactatttgacagcttttgtggggttattgcagtctaggcagcaaggtgtaaatagcggttgtctgataggtctgtttaggaaaatctagctaaacaactgaatacgatttcttcctgcagaacttctcagagcctatactatgctaatatgcactggggctctcatgaagagggttttagtacagacagcattttctaactactttaatcctctcagcatctccctatgctagagttccatggaaaacactttgggaaacaccggtgtcatgcctagatggtaaactgaagagcagagaggctgcggcagacctgccatttaccagctgtgtgaccttgaacgagtgctttcgtgctctgagcctctactttttaaatgtaaaatggagctgaaaatataggccctgcctgttagggttgtttgcctggaatgaacatgcagaaggttttggtggcctccctttgggcattaaaatataagttctcctaaaattaagtatttattcaattcacaattttccaggggccaattattcactctgaagcttagccaggcttttgtcttttcttctctgtgcttcttagcacctccactaaccagtaaaggagagaaaggagatgccctttgagttaagggctgctgagggggcagccagaagaagccatggccaacatgaggtctagaggtggctcgggaattgcagttaccttccactgtcgggagtcagtgggacagctccaggccattgttaaaaaccattgccctgcatttgattctgcttccatttttgtatcatgggatcaatccactcattcatttattcactcgctcactcatttattcaacccacctgccaggcactgtgctaggtgccggaggaggaagcggaccctaagtctaggaattgcattgtgcagttgttgaggtctctgtttcccctatactggaaaagtcagcagttagtccatcaaacaagggctataatcagattacagattttgatgaatgaacttgcagggctgtagaaaaaagcctataagcttttaggaatagagccataggcatttagcagtattttcttcccttttttgaataaattcactcctttttttttttttttttgcatccctccctgccctccacccaacaccagcaagcagtttattcctccattataagcagtgtgactataagacacttgtcaaatggtctcactttgtccttggatggtatgacccttgttttgtttttattgatcagcacacccaaaatatcatgctcttcagtcattacttaggaattttctaggggtggaggaggtcaaaccaagaacttttacatttgggagattgaaatctatttctaaaacttgattttggaggttcagctccattctggtggtcactctctgaaaatgcccagcactttttctgtagatggctgtcaagccacatctcttgcagcctggccacaggcaattggattttcagtgctcagtgcttccgtgtgaggttattgtatgttgctttaaaggttaacttcttcctcctcccagccctatttctccttcctcctcccagatcttagacagcagtgttatcatctgctctgtgtcatctagcacaggactgggagaggggcggagttgtcaaagaggctgtggggttaagatcagggcttttacagcagatgacctgagttctaagctccactctgtcgctaactagcatgtgccctggggtaattatttcacatctgtgtgcctccattgtcctcatctgtaatgtaggtgatgaaaatagttcttcgcttgctagggtcttgatggaatacaatgagcaaattcatgccaggtgctcagcactgagcctgttgcacagcaaatgctcagtagatgcttccgttgctgatgacagtgatgacaaaaacaaaccttcgtattccttggctcttccatatgtgtgagtgcccccatcctctgccttcctgccttcagccttgttccccctacagtctgccatcctcaccgagattccacgtggtcttctcacaaggctgaacttgctccaggtccctcaatgactccacattgtccccaggactcttatcacagccacacagctcttcttggtcaggtccccacacgccttcctaagctcacctatgtcaactctgttccatagaccataagctccagcctaagggtcctcaagttccagtgcacagacccacaccagcaaattaagaacactaagagcaatgcagttgggttttcatttacgaatgtagaatcaattaatttttttaagagacagggtcttgctctgttgcccaggctggagcacagtggtgcaattcactgtaacctggaattcctgagctcaagcaatcctcctgcctcagcctcctgagttgctgggactacaggtgtgcataaccacaccgagctaatttttttttccttcgtttttgtagagacagggtctcactacgttgcccaggctgggcttgaactcatgccctcaagcagccctcctgcattggcttcccaagccactgagcccaggcctaaaaattctgtttgtttgtttttttctgagactatattttttctattatgtgtactaagttgtgatgaacatagatgattgctttgtgtagtgtgtgtgtgtgttggccattactgccataatgaacattagcatatctgtgtggatcccaattttatatgtggaaattttactgggtttctgagccttagagactggggacctcagacctagcttccccaaatgactccccattccccaaacaccatgtactgccatgcatttatgaatttgcacgttttactaaaatcctactcaacctctaatacccaactcaattatcactacctactacctcccctagcttctagtagccttcttagagttatcccaccctcaagcaggaaaagttgcttcctctgctattataatcctctttcttgattcttcctggtggttccaggtaccttagttttctcagtggtcactgagtcccccgggagagagggtacctagcaccactttgtccctcaggcctaacactgtgctttgttcaaagacaatggtctccacgtattggtgttacaggtaaggactcaaagaagaaatagaggtcatatctcagcttcttatttgcttctattgtggctcatgtcacattatgaggttgccttacactttctgtgttccttcttttctcctccataaatacatgagcttcatgcagcgggaaactgcaggcatgttgatggaatttactgctctgtcaaaactcagagcagtcctgacacacagcaggccctcagccgatatgatgaatgggtttgtgagtgaatgaataaaacaaacaaggaaaaaattattttgcaatattatctgatagagatggcacctttcttctctaagaaatcagccatgtagcacatggcactgagtacctgacctcactcccccagagatatggggctttccttccaatatgtttttggggaatttcgtgaagtggaaggataagataagatatcttagtggatgaaagatgaggatgaaaaaatacctgatgtcactaaagggtggacatcaaagtcagatggacgaggaacagaccctggctccagcgtttggcagccctgcactccggattcacagggtcgagcaggtgtttatttgggcagcccctgggtgccaggaaccagcaaagatgcgagacccagcaacaagcacgagagtgacggttctcattgtcatggagcttatgtttgttctcatgggaaatgcagatgacagtcaataaatagtgaatcccagggcacaatctgagagtaatcagagctaggatggaaggaaatgtgaataaagggattggccctgcaccaggcatggaaattagcctgtaagctccatgaggtcagtgttccgtcagtcctagaacagttcttgcctcatagctctgtgtggctgttgatgggggaaagggatggagttagttacccagggacaagtataccagctactgtgagcctgagagaggcctgggagagggctggctggagttgccaaagaggctggagcttgtcccttgagttgcaagcatgtgacatcagcaggggagggccagctgccccatccatcatctgaggactgaggctgtgtgtagcacttcctcacacagatgccaggtgtgacagacatttcccattaattaacctctaatgcctcagaggtggcagaggtgcagtggaacctggcactactgttattcagaggctggggggtggctgctaatgtgtttgcaccttccagagtctctccagtgtgagaaggcagttcctcaggaactgcagggagagacggggagagaattcctggagtggggggaggtgctcccatctgtcccttccctctgtggacaggtgtgcatgggccacatgcacccgcccacagatggcatcccacccatgcaggtgcacacccacccacgcccatgcacactggctccgcaggtgctcacccgcccacccgtgtaggtgcacacccacccatgcccatgcatgctggctctgcagttgctcacccacccaccctcagagatacacacctacccactctgtgcacacctgcccaccagcatccgcaggccacaccgtgccgtggatgaccacacctgccccgctgtacacctgcagtgatgggctcatgtcctctgcccttggaggggtttgtaagtagttttctctgagcagcactattttgaagtttctcttcttgggcggagagtcatagctctcacaagccctcccctggcacagtcctgggcttgagccaccccagggaaggcagaggggagagggaatttcctcccaagggggatgcagagcagcacagcctggggcccctgggcatggggtcttcactcctctgatgacagttgagccccttgaggagctgcttagactaaggcatctgtcctggtcaatgcattggatttttggtttaggagcaaagggtcttttgagctgaagaccctctagtggctccctgctgaattctgaatcaggttcaagtccctgactacgaccctgcctgcctccccagcacatccacgcctctcaaccactgtttcctcctgtcttggacagcctgcccctttcccatcatagcccctgtcctgttccccactggggcggccctctggagcacccagtgctgaccctgtcacagtcggtcagtcgacacctgccctcgaggctccctgaggaggccctgggtcctgtccttcctcgcgtctgtggggatcctggttcagggctctctatgtccccctggcacgtgcctgagctgttgctggcactggagatacagctgcaaacatccatcaagggcctgcagtcaggagcttcagctcggggcatgggcaggaggagtggagacaactacaaacaggtaaacaaatgagtgtgtgcgtgcatgtgcgtgtgtgtgtgtctgtgtgcgtgcatgtgtgcgtgtatgtgtgtgcgtgcatgtgcatgtgtgtgtctctgtgtgcatgtgtgtgtgcgtgtgtgtgcatgcacaccagctgatacctgtgatgagaaaaataaagaggaaggcaagaaatagtgaggagtgccatcccacatggggtgagccaggactgtctaaattcatacctttattcattgttcatctcctgcaggtgagtacagccccacaaaggcaggcatcgtctcttttgttcacctctgcacaccctgtgcctattaggatacatggcacatggttggtgtcagtacgtatttgttgaaaggtggagtgagtgagtgagtgagtgagtgaattcttaaagggagagaggagtgcagtctcctcagtggccaaagtgctccctcgccagccctcagctctgctgtgaggaccactgtgtgtcagagacggggtgggaaccccagaacctgctccagccactagggcagaagtggggggaggcagctgattaaaatagtgcaggtagtgacggtggtcctggcagtgatggtggtagggagggggaggcgccactgcccctcctgcccaccttccaccagtggaagcagtcacatagccacagcaagaaggagacaccataccccccagcaaggccctggcaaaggggatgcagggagtcaatgcttcaacctcctgttagtaagtggcagggccaggaggggagcctggggtgcctggtcccagcccccatgttcttcacagctacgtcacactggcttccatggcacatggcaagcactaatgcacaataaggatgataataagggggagggagcagcagagcacagagagctgcacaagtttagtgattaacttggattttgtcctaaatgagaagggaagcgagcaggaagtgatagggttagagctctatttctaagacatcggatcacaggaagaccagttgctggggcagggatgctggtactggaccagggttgttatgatgcaggtggcaaagaaagttgggttcagggtctgatctgtagtttattctgtgtgctactccgttttgccttggctgctaggaagctcagggcacacaaataccctcctctggagcccgtgtggtgtctgtcgtggggacccacctaactccttgatgctgtggccctcagcagaccctgattcctccagatccttcctgacactcccttcatccttcagctgtgtatgtgtgtttctggtgattgctgccgatcctttgtgaaggaggtgagatataaataaagcaatgattatgctccatcctcgtctcctctgctcatccctggagatcttcgtcttcatcttcagctgagcttggaggcttggggagacctagcccatccttcccctcgtgcaaagcatgctcaggacagcaggctttcccagggccatgtggagtcacagtcttgctcccatctggtgtctgtaggtggaggaaggaaaggagaggatgagaacatggaatgcattgtctctgagaagagaaggatccctgtacatccctctgcctcccgtggccttggggagagggtggccgggaggatctgtggttaattggtgttctgcagctgccctggttccacacatttcctgggctcccactgggtaccaggcactaggtgctggggtcgcctcaaaaacacagtggaggatgccattgctgtagctcccttaatggtttgcagagcccagaatgtcaaacaagacattcctgggcttgtctttccccatggggctgctttgtggagcatctgtggacacagcacctagcacagttaacacttgtattagtccgttttcatactgctacaaagtgcccccgataaaacaaaaaagaactgcccaagactgcatgatttataaaagaaagaagtttaattggctcaaagtttagcatggttggggaagcctcagaaaacttacaatcatggcagaaggtgaaggggaagcaaggcaccttcttcacaaggcagcaggaaggagaagtgcagggcgaagggggaggagcctcccttataaaaccaacagatctcaagagaactcactcaatatcatgcggacagcatgggggaaaccacctccctgatccaatcacctccacctggtctttctcttgacacatggagattatggggattataattcaagatgagatttgggtggggacacaaagcctaaccatatcagcactctattagtaatgcctggagagaatgacctcatgccccaacccacctagggtgggcctggtttatcctcttgtcttggtgtcccatccttctgtgttctgctttgggtcccctcgatgcagctttggaaggtgagaggggcctctggagtcagggtgctcaaggtcctgccctgccacagcatttcccagctctgagaccaacaaaaaaatggctcagggctctgatcttcagtttgttcatctgtaaaatggatataaaatggaatgatctctagctcatagatttattgtgaaggtaaaataggacaatgccttaggatagtcctggccctgcacaggcagtgaccagcgtttactccatcatcattattctattgctcatatcatagaaattattataatataaattttgaccaaaagttacctgcactggcatggtatgttaatcagagtgatgataaagtctagacatatagataatattattttacatggatgataacatgaactattaataaactgtgtattgtggatgtttatctttgttttcagattgtttttcattttaatttttttttagagacagggtctctctctctgtagcccaggctggagtacaggtgcaaatcatagctcactgcagtcttgacctcctaggctcaagtgatcctcctgtctccgactcttaagtagcatgcaccaccatgcctggggaatttccaaaaatttttttgtagaggtggagtctctgtgttacccaggctggtctcaaactcttgggatcaagggatcctctagccttggcatcccaaagcattacgattacaggcatgagccactgtactggccttcccagaatttatgaccacactgagtcctcccctcaaccttacctatcagggatgattatcatggcatcttttttttttatcaacagatgtggaaaccgaggctccaaggggccgggtggcttactcaaaggccctgggttagagacaggtgcagccctttggaagccagaccccgtggaagctctagaggctgccaggcaggccgcctgtcactgggggcacagaggtcactgccatgtggggccttgggccctcgggtgctgcctcatatggctcttctcaggctgagctctgcagagcccagattcagagcaggccgtcctgggcctccttggggcagccagtggcatgcatgggtgccttaggtgggaaatgcgggagtgtgaccccttccctgggtctgaggggcctggcccatcataatccccggccccttggacactggtaatgccccttcccctcgaacactggtggtctccttccctgtcctctctgacaaaggtgacctccttcctcaggtgagcccttgtgttagccacaccgtccagcccttctccctgcatgtccatgcttcctggggctctgaggtctgcatcagcttagggctcccagccccttccacaggtaacaaggcaaattcacctgctggctgtggaactgaccacgcgctgaccatgggaggctgagccagctgtcggggagtgtgtatgttcgcagggcgaggggtcctggcagaggtctgggctcctgtggtagcagccgtgctggggagcaccccacgggtctgcgatcttcctcccccagcgacactgggaggttaaatcggagcctggttgggactcaggtccttgttgctgccagaagaaacgtcccttccctgtcccaggaggcatctggggcaatgtgctcatctattctcagtcctgcctgggtgacggcctgaactctgctctacactgtgaccctaggatggaggtgacgctggcttactttgtgagcttctctaactttaccattttgttagttgcattttgtttcattctaactaatctttcctactaagggacacacggcttgtgctacaaaaacagcctgtgaagcacatctccctctctcccccgcctgccaacagccagggctccccatttctttctttctttttttttttttttcttctttttttgagacagagtctcaccctgtcacccaggctggagtacaatggtgtgatcttggctcactgcaacctttgcctcccgggttgaaacaattatcctgtctcagcctcctgagtagctgggattacaggtacccgccaccacactcagctaatttttgtatttttagtagagacgggatttcaccatgtcggtcaggctggtctcgaactcctgaccttgtgatctgcctgcctgggcctcccaaagtgctgggattataggcgtaagccactgtgcccagccccggggttccccatttctttggagggcccacagacattttctctccacacaccagtgtgtgcctgtataccacccctgttcgcacactggtggcgtgtgcgtgtgaatttgtgcgctggggttttctttggcctgattatctcagatcagtttcctgtccgtgcttggagatccactttctttctttctgcatctgcacacaggtggttgacaggacagacgatgacttacccagtccccctgtggacgggtatgtaggtcggtatgagtctcttttacaacaaacagcactgccatgagcttcctaggacgttcatcttcacgtgtcccagagtctacaaacatggccgtttcatggacaaggaaggggtccaggagcactgcttcctctgcctgctcacagacgtgctcacagacgtgctcactctgcagccgtttgctcagaattctcaccggcctggctctgcgttgggttccaaggctgccccaggcctgggctctaccctagaagaggtggcagcctggtgggagggcaggcaggcagaggtctttgcggctcattggtgcctgcataggtagcttcatgggcgtaagacaagggagtgaccctgtctgggacaagaggaaggtaaagactctggacaaagtcctattcaatggaggagctgaagtttatgaggcagagaagcggctgggagggagagcagcgtgggtggagggcagagcacgagcaagggtcctgggcaggcagcgtttcatgctggaattaggaacatcttcacacgtggcgcgtcatatggcggaaggcgaaggcttctggtggccgtgagtgggtcgcaggagggagggtctcacagagggaaattcagcgcacgctgctgagctgctgcggccactgtgggtgcactgctggacaaccatcctggggtccaggctttggggggatcactggtgaccccttagggtgagaggtcatcaccttgggcccccaggagtcacataggtttggtggccacttgaggacccccttggttttcgtcttccagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcaggtaaaggcctggtgacaggcgcgggcaggctgtggctgggaccagcgtccttggcatggtgctgcggcccctgctgatctgtgacttcctggcccctacacaggaggggcagatgtgcttcatggcctgtgatggccaggagccatgcaagttaccccgctggcccctccagggcccacctggcctccctgaagccctggggtggagttggcaccaggcaccccatgtgggacgctctgcccagaccctaaggtgcccacaagtccactgggaccttgttaaaaacgaagcctctgatttacttagggctgggttgggccgagacactggctttggagcaaggtctcacttgctggcttcacctgggtggtgagcccccagcccacgcgactcccgcaccacctcacctcccacacctgcaatctcacttggaggatgctggggcctgggtcgtacccccacagatgcaggtttagttggccaagagcctcctgggtgactcagggttgaggccgtcggtttggctttgacacctctgggcctctcttcttcctgaaagacagaggctgctcccctgctcctaagctgtctcagtgtgccttccctacaccctcccaccaaagcatccagaaggttcctccactcacctcctgctgccccctcacaccctgccagccctggctctgtgggaagcgggattgcgatggctggtcccgttgcccccgcctcctcggaatccagcttgggaactgcagccatgaggctgaaccacagacagggtggacacaggcagtgatgacgggacaagcagccgtaaggcacataacggcagaacacggccccccagcatttggcatggaggagccaactcaaccctcagaacctcctgctaggccagcactcccgcaggatcctgccccatcggaagggatggggaacaggcccagaaagggaaatcactcacccagggtcacacagccagcaggtggcggggctgaggcttggaccctggcagccgggtgtggtggctcgtcagcctgggctctgcagatggcagtgttctgagaagagagcccggaggaggccgcatctccaccccagggccccgcctccagccacatgcctgtgagccacacctaaaaacaattagtgagggagctgctgctgtggaatcagtcccaggcctcaggaaccagccctggcgagtgcccgtctcaggctgttgcctcggggggtccctggggtcccatttcctttccagctctgaagaggcgcaggctccagggctttgaggatggtggagacgaaggccaggtgttacagcgcccaggcccacagcaggggaggcggccaacaccgacagcaggccctccactcatgcttttctgtgtgctttacaaaattattattattatttttaccaaccaagaagttgatagatgaattcttgttgaagtggaaacagaacaagcatcatcattcggcagatcttgagcacctcctgtgtgcccagtaccaacaggaggggcccaggccctgcccacccagagctttccgcagagtagggagtcgagtgacaaagtgtggaagccaccaagtgaaccagcacgtgagtcgattgcagactccggcgaggctgcaaggcagcctccctcactggatgctaggctcagctaggtgggcgggttccatttgttcccctgcatctggcagggccccttgcacacacacggcactaatgggctcttagtgatccaggcttaatggcaggatcacggagcaggccctggggggtggaaatgagcagggcgggcactgctttgggcccagtggtccgagaagacccaggtgaggaggctgcattgagctgagatgtaattggttcattgagaaaggcagggaagagcatggcagcagtgggaacagccctcgaaaaggcagcgagctggggaaggcacgtctgtgcagcagtgaaaggccgggggactagagcagagtgacctccgtgacctcaggggggtctctgacattctccaggcctgctgaccccagcagtggaactggaaggctgaggtttgtcttctgaggactctgggctctttggcctactccaagctgtgccgtgtgagttcaccagcaagatgctctggggaccctgcaagggcattggaggtctcgaggtttttacctgcagcatccccaccttcaggaccgccattcgggcatctggaaattcgaggaacagtgctgcattttgtttacttattccaaaccactattttcctttaaagcagggggtgttatttgtttcagcatatcaaattcctgatttcacgggcatcacgggttaggatgagttgaagtgaatgcaaagatgattgaaagagaaatatgtagcaaacagtggttttggtaggcgaggctgggggaaccggctgaagatggctctcaggggctgcagggtggaccagcatctcagtccatgcctgccctggcaggtggctcagatccactcagccatttacacactgtaccaccttcacaagctgcaccaccactgacgtccccatccccgagagggggagggtagagcctcgcagctgcatctttgggtcatcgggaagtccttgagtcagtgcaggcaaagacctgtgatgtctgaggctagccaccatgagcaccgcctggtgccggcctggggacggggtccacacagagctcgaggcctccacccctgttcttcttatctgctttgtgagcctggctgcagcctctttgctgacacctcccaaggtcagcattcactttgtcaattttatccacaattctggcacctggaaattggcttggaaattgggaccacagaaaggaaattctgttttctctgcccaaaaatgtccccaccctgctgtgtttgggtttcccttttcatcctttggctttagggtaaatatcctcagggaagccacccgggaggtcaaggatgggatgggtttccccagacaactgccccccagtcagtcccccgccccaggcctgacttattcctcctcgcccacttctagacacttgccatctgtcctcccacctgtgctggcatcaggcagaggctgtgcctgtcttgctcatggcagaatctcctgtgcctgacatggtgcctggcacacagtaggtgctcagtaaatgtgtaaggggtttccatagattgaacacctgatcaccatggcctgttcccccagtggagccccacctgtgaaggctgcagggcttctgccctccgtgactccccagcacccagctcagcacttggcacatagcaggtgctcaggaaatgcttttgagtaagtgaaataattccattgccagtgcctgtttgtcatctgcctccccaactagacattaagctaagccaggtgggctgactctgtctgttccccggcagctggcagggccccctgcacacacagaacactgatggactctctgtgatccagggttaatggcaggatcacggagcaggccctggggtggaaatgagcagggcgggcactgctttgggcccagtggtcggagaagacccaggtgaggaggctgcattgagctgagatgtaattggttcattgggaaaggcggggaaatcatcacagcagtggaaacagcccttgcaaagctgcatctttcaaagaaagggttgaggtggttatgtagtcttgtatttggaaattggggctcacctgtaggcaaacagttttcctgacggaaggaagaagatgattgtggagcagcccgaggcctgcctgtgaaagaagggagaatgggacaaggtggtggccgtcgctcaagagtgttttgctccgggaaggggaggcagaaagggctattctgaaggcggaattgacaaagatttggcaaattaggcttggtggaaggggactgggggctggcctcctcccttcctgtccatctggtagactggaagcttttaacctgggtttattggaagaagctctagtgggagagccgcacaggagaatctcatctgtgagtggatgttaagagcggccaggaggcacttcgcaaaggcgaacaggaaccacggaaaggagcccggggtgttggcggcagagggagggcactttccttggttggtaatttagggaacatttggtgaagggcaggaatggctggtgagagctagcttagagaggggcgttatatgtgcaggggctttccagataaatcacagaaatgatcgctgtagaatatctactgcgtgcactgctctttagctgtggtttatgcacattgcttagcagcactcttggtaagaaagttgggcctcgccagtggactaggccccctaaccccgaggcgcctgctagctcagtgtttttggtctgtaaacttgagcctggcattggctgtggcttggacagggcccagtgacacctttgcctgagactcacctgtgtgtttgtgtgttgggcagcgctggagaagaagatggccggcaggcaaggccgagaggagctcatcaagaaggggctgctggagatgatggagcagggtaagtgggacccgtccctggcttggaagggcacggtgctgggaatgcagaatggaaagtctcacatgagcccaggaagcccatcagaaacagtgtagaatccaaggagggccgtgttcagatgaagcctgcaaggttggagagacaccccatgtcaggagccattccattggtccagcccccaggggcacgggagaccccattactgagctgaagagctccccctcatggcaccactcctctctggggaatgtctaacagagctgggtgtgcatgaatctggtggtttatcccaattcctttaaagtggtagcagtggttttttcagcattaatttttttttcatattcacatttcagtcctccatttgggcaaattatttttaattccactattacctactccccctaccaccatgtaggaagcattcaggacatgctggggcggggtgggatattgtgcacgccctgtctcattggtcttcccagcatccctggggagagaggcagcggctatcccacttgcagacgaggcgtgggagggtctgggtggtgactgccccaagtcattgcagcctgagagcagagacacagaacaaatcctgatctcttggtctctggtctagagagcttaatctcagtggggtctacataatcatctttgtttccatctttcagaaaggccagttattatcactcatgcaattaactgaacagagttctttaattcccaagtctttctctttgtgatggattcctggaggtgtgaggcccaggacttagatgctgacactagcccttggtgccttccggttccctgagaggctaaatcttggttaggaggtttcacaacacctcactgcctctggaagactctctggagctggaccaagctctggcctgctgatttgaggaatctggccatgcatagccagtttcctgaggcttgcatggatatattgaattcctctctccccacttcagccttaaaatattactagtgtctttgtaatttggcccaaatatcaggaattaggaaggaagctcatgaaataaacgaatccagattttatgcagccgggcctgtcagcacacaaacccgattgtgggcccaggcttttgtcattgtttcctctctttagactcgaagagtgaagtattttgatgatgctatttttaggggaaatctacatgggaaattgcttcatagtgataataaaaccttacatgtgcgaggaaagcttggtgtcaagtcccgtggcactcagatggttaacgccgtcgtgacgctcggatttggcggaatgcggttgctgagctagaaatctggaggattttcactgggatgggacaaaaaagtgtcaaactccggcattttgaatatgttgccaacaagcatacctttggatcttagggaaggagaaaggaagatgaaaacaatgctaaggccttttctcatctattctaaaaaaaacactacttttgttgagtaaagagtaagtatatagatttggttcctctcaaaaatgaagctatagtttgactaattaaaggggaaaacttctaggagcgttggcttttttccactctgaatttttgcaagatgactttgtctgatgaagtcatagcagaggctggagacgaatgcttggccgcggccaggctgacagtgtggctctcaccctgctgccgtgggagcctggtctctggcttccgtgcctctgacggcgacatcacacacccgcaggcttacagaatcactttagatcagggtcggcaaaccttttctggagagggtcagatagtgcatatttcagggggacgtgcagtctctgttgcaactacttgtctctgcttttgtagcgcaaaggcagccggagacaaaacatgcatgagagggcatggctgtgtcccaagaaaactttatttatggccactggcctttgaattttatataattttcatgtgccacaaactattatttttcttttgatttttttttcttttgtcaaccatttaaagatgtcaaatccaggtgggggagctggattggtccccacattgtggtttgctcatctctaccttccatactctctctcttgctaaatgattgtggaccagggactagagtggcctgaaacacagtctctttccttgagagggaaaatgcactcctaaattgatgccatgacattttattgagggcccactctgtgtcagggtctgtgctagctgctgaggacacaggtgagcaaaatactgttctgaacgcacatccagtggggccattaggtaatcccacaaaaagccggcaactcacgaccacagtgagtgcagtgaaggatgcagcaccctaagatcatgagacaggacctgacctggttctcggggggccgggagatgtttgagtcaggtccaaaggtgggcaggaggacctaggctggttctcagagtctgttgcatattaggatcacctggagagatttaataaccctccaccgctcaggcagcagttaaattagatgcgctgggcgtgggacccaggcagcagtgcttcctcatcctccacagctgattccgactttgatgcaggaaggttgaaaagccaagagacagaaggaagcggggagtgacttccagcccacaggagcagcaagcacaagtccccgcggtggaagggaccttgagatggtgggttgggttggaggaaaggaggaaggaggaagcaggaaagggagaggggcttgggtcaagacgcctcccgtcttccctgcccacacaccggctggggtggcagaggcatgaccacgctgctgcgggagcctggggcggccacagtgcgagtgggtgggatctgcgaggagcccgagtgtctctgcagggaaatatcagggaccgggcagcaggggttgctctgggaggggacttggacttgcttttcgcagtcgactcttctgtgctgcttgaatcctttactgtgtgccacctgtaatcaacctgtaatcaacgtgctgtaataacgggatccacgcagatgcttggccacaggctcccggctaaatccttccctgcaccgcagtttccgtcctgcactagcttcaaaaatgtcttttctcactgggtcgacctgaggtcagaccctgtctgtccctaatcctcctggtgctgggtcaccgggtcctcttgcaggatgactggaattgttggcggtggctgtgcacctgccctctccggctcaggggaggatcaggcttgagggctgttgctctggggtaggcacgcagtgccgccgcctctgctgtggatgtgaggactctccagggtgaggagcagaggcgctttcctggctttggggttaaggaaccggcttcagggttaaggaaccggcttcagccaccgccttccactgctggcagggacgaatctgcagccgggggcgccctcctgtggccggccaggctcatgagcctccctgcaaggtggacgggacttcatgcaggacaggccctgtgaggctgtgggagtggattgtcagggactccagagcctcatttgagccccctcgaaactcacatttgaacttccttggccaggacaaaccccaggattgccctctgccctgcacacgcgcatgtatgcacacacacatgtacatacacattggacaccctggagcttgccctgaagcaggtgggcagcctggtggagtgagccggactctgggcagggccagcagaagagagcccgccagctcccgggggtgaggcagcatccagggcatgagtttgctccctctggggtgttactttatgatcgatggtctgttttatgaaccactgtgaccccctcccctctcgttcctgtgactctagtcgccagcttggacctaggaaggaccctgctggtggcgttattacatgactagatgtgtgcagtggagcccgttgtgccctggggagggcagaggggacccctctgatctcttcagtgctccttccaccctcgtctcggatatccgtgactaagtgaggccagaccaaatctctggtacaaggggtccccttccccagcccccttgccctggtccccagcccacgtttctctgtgctagacactgtttatgttctgaatgactttcctccatctccctgtatgcgttgacttggcattttcttaaataatttaaggaatttcctaccccgtcattgggtataaaagaagagagtttattactctgtgctgtgttcagtgacttgagattgactaggcattctttcctcagggaattggacagtgacaaatcaagtctatctggtttccatgtggtaggaacgccgggggacacatgtctgcacgtgtgcacacacatgcacgtgcacctgtgtgcacccacctgtgcttgcactgtgcacatgtgccacgacacacgtgtgtgcctgcgtgtgcatctgtgagtgtgtgtgcatgtctgcaacacgttccctctcactgtggctgctcaggtgcactgccccgcgctcccctctgcagccctcagaaggagagtggccgggcggaggctggccttccagcgagaggagcagggcctgggctcccaccgctcccccaacccctccccaaccagcgtttcttagcaacggccctgccaccagggctattttgggaactgaaacttttcactgaacatgattatgagctggagctctgaccgcagcccagagaagtcctgcaagaagtccttgcagaaaacctgcaagaaagcaggggaaggttcaaagactgtggaggggcatggtgcttttctgagtctggagacctctgggccttccaggttctatgttctgacctttttatagtggcagttgtgatgattttgatgatgacgatggaggcatccttattattaacagcagtgacagtcatggcagcaaaagacctgtgcattctaaggtttggtgtccataactgcaagtggtgggtggcagccttgcctgtcacatagggtaggtgtgaagctcaagctggcagagccctgtgctcccctacgccagctctcacattccctgtgtgttgccaggggctgggtaagctgtgctgtcacggttgcacgtcaaatgcgagtaagtcggtcacgagaaggggctggtttcagttttcagctttgtgacctctaattttgtctactcggtgagctctcttggcttgtatctgggttggtgggctgttatagccaagggtcaaatgtggctcaggacctgtttttatgtggtctttgagctaagaatgctttttaaatagaaaagactttcataaaaattaaaaaaaaaaaatcaagggttgcagcacgggggatacagcacgtggcccacagagcccgtcacaatggccatctgcgccttatgggaagagcctgccagcctcgcctggacctctgggcaactgacgcggctgcatggatgagatcgtccagccctaaatctccagacttctggcatggctgaccttttcattctccccggaggagacgtgtgcggcagagggaatatgatcagcagcgatgacaagctcaaatctcttccagggtcccaggcaggaaatgggtctggcatgagtcctgggtgtggtgaggactctggagggagaaacggttctgtcctaagcctgctgttagcagatgggcccaaaggtgcagaccaaggggccagatcactcttgtcaccctcctcttctcgttgtcagaaaccatcaccaacaacaatgacagaaagcacatgtaaagtgcctaccttatgccagacacattccataccctagctccgttaattctcactatgttgccatgaagcaagcagaaatattatccccattttatagataaggaaattgagatccagaggaatttgctatttgggcacaaaacaccgtttgcaggtggtgggacgcatgatggggtgactgtatactgtttgtccaaacaggacacttttaggagtgaaagggacactgttgaaggacacagggatggcaggtaggaatcgggactgaccaggtcctatggaccctgaccctgaagtaaatgttgcctcctccttccactgccaggatgggacgtgtgtggaaggaggtcagcgtaggctagcatccccaaacggccacctcgtggctgtgtcgacatgtgcaggtcacactgccctctgcaccgggcctccaggaactgctgtagagattgagaggagtcctgcagggctatgtggaggctttgtgcatggggctgtaacgtgcatctcagtgacgtgactgtgacttgctggccgagggccctgccatcctgcagttgggtaactgagccatttattttgctctccaagtgctgagcccctcagcattaaggtgcaaacccagggatggcaagtgaagggccagaccctcagaggctgcagcagccgagcttcaagagacggaaagcaccaggtccttccttatgccctgctagtgcctcctcttctgggaaggctgcctgtcagacctagggacccccggctctgtggcccctccatccatgggtgtgccccgttcctgggctcacggtgccatgtgtggtcatctgcgtggcttcctcagagtgtgagacccctgggggcaaggactgtatcttactaacctccaccttgccagggtttattacagtgccagacacgtagccggtgatcagtaaacacctgtttaatgcctggctgagggtcaaacggtgggtgcagaggtgagttggttctctgcagccatgacaacccctgcatctcagagacctacagcaatcaccgtttgttgtcccctgtctgggttggcctgtgatctgccccgtgggtctgctgactccagccagctgctgggcatgtcttcaggacaaaggtccagggaaacaggagggacgagcagggatgtgcaagcacttctcatgccagtgctgcatcatacccactgtgtcccatcgaccaaagcaagctccagggcagaggccggggtcagagtggggctactgcaaaggtgcacggcagtgggtgtggacgtggctcaggggcactgcagtctcccacaggtgtcggaggaagagtgcacacagggagtggagtgtaagagcagaaaccaggctagggtgtgctgaggtgcccagggctcccctggaaagtccagacttggagagggactcctagggtgtgtggtgagggggagaggggtgggggaccacccagagcctagaatggatacttctcagaaagactcttgggacgacggaagggatgaaggaagggaggtgcaggcccagctgacagctacatttccttgtagatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcaggtactggctggagaccacgcgaagttgagctgctcctagaatggccatacgtccccactgttgtccttggctatagcttaggcaacagccctcgtagaacattgttctccagagagctgggcccgtgctctaagcgctgccatgctgtgctgcctggctgggttgaagtgtttgctggggcacttttctctactgtctctttccaagtctggcacggctgataagtgaaggtacttaacgatgttcatctccctggcacacctaccccccctcccagggcgtctttgtgtttccctgggaacttctaggcaggaaagtgctctctggaggggcaagtgcccagtggggggattttagtgaccctaaaagggtaggaggtagggttgagggacttttctgtggccgaaatcctgccacagggggcctcttggcctaagagatgctgaagtccctgcatgtgtgcatgcctgggagctggtcggtgctgatgcagtctcagcatgctgcagcctatgtggggctcttccgctgcttcttgaggggaggtgggcttggtgccttgctccaagcctcagtttccctctgttaaatgggaaaagtaatggacctacatcagggttgtttggagggtgggaggaacttagcagtgtctgacgtgtagagtgactattatcaaaggcagtaggggctttgcgtagtggtggtggtttttattttaattgaatagaccagggcgcttcccaaggataggggagaagggaggaaggatagaggggaggaaagcaggaactggccacagacacctgcagatgcttcaccagctcctcctcctcctgcccacctggcagagtgattcttacggagcttcactgttgacttggaatcctgatgtctcgtaaaatttcaagctataagcgagtctcacacggtttgggggtgggaaggtgaacgcgtctctccgtgagtgtgggaggttggaaatccaggccccaggacagcctgctgggcttctgcttcagagcgggtggacacctggtcctccgtgcccgggacttccttctgccacacaagggtggcaccacacactcgcaggccgcccgtccacaacgcccctgcagcgctagcggcacctgcccagaggcatgctcagccctcttcgggggtggccgtgtctctccagtttcacttggcttggaatttggggtctgagagttgtgacttctggagggtcccagctctcacgcagaggccccctccacacacacaggtctctgtgtgccccaggcatctgactttggggctggcgtggttctttttttttttaatactttaagttctagggtacatgtgcacaacgtgcaggtttgttacatatgtatacatgtgccacgttggtgtgctgcacccattaactcgtcatttacattaggtatatctcctaatgctttccctccccctccccccaccaagcaatggcaacaaaagccaaaattgacaaatgggatctaaactaaagagcttctttgcagcaaaagaaactcccattggagtgaacagacaacctacagaatgggggaacatttttgcaatctactcatctgacaaagggctaatatccagaatctacgaagaattcaaacaaattgataagaaaaaaaccccaccacaaagtgggtgaaggatatgaacagacacttctcaaaagaagatatttatgcaacccgctggcatggttcttaaggctgagcagagcctggccttcctgccgtggtgtggtccccacagcccagcccttgtgtgtggcctgtgagcctccccaagggaggcagggctgctgctcccagcccttgatgggggtcacgcttctccttggcagtgatttctgtagctcagctcagggcctgtgcctgctcccctcagtgccctcttctgacctcagacacgctcccgctctctctccagatgctgggtgtgcggatgggttcctgagagcagagtgggtctgttgagattacacatttgtatcagggaccctctcctgagtgaggcctgagggaggagtgggaatcagctgggcagagagcgaggtgcagagcatcccagaaaggggaatgacatgcaaagacaggggacaggaacacacacgttttctgtaaagggccagagaggaaagagcatgagctctgcaggctggaggtgtctgacacagccactcgcctctgccccctggtagcacaaaagcagcgtcggtggtgaaagggtggggctcttgtcggtggaactttagtgattaaaaacaatccagggcccggtgaggtgggtcacacctatcattccagcactttgggaagccaagacaggagaatcacttgaacctaggagttcaaagtcatcctggacagcatagcatgacgccatctctacaaaaaagttttgttttttgtttttggttttaattagctgagtgtgtgggcacacacctgtagtcctagctactcacgaagctgaggcgggaggatagcctgagcccgggaggtcaaggctgcagtgagctgtgatcacaccactgcactccagtctgggcgacagagccagaccctgcttcaaaaaaaattcaaaataaacagcccacagaatggagagagagaagagacctggcaggttatccctgagggcagctggaaccccccagggatggagagtcgatgggatttgccttgtaggaagcgctctgctggtgacccagcaagacctgggggagactggagccgtgcatggttccctggggacttgtctcattcccagcttccccagtgtgggtcttgtgctcctgggatttgtgagatgacttcttgtgaatggcatgtggacagacaatgagaaaacattattaatgttcaattaataatgaaaaagtttaaacattaataatgaaaatacttttcagtaattagggcaagtagtattggcttctcattttgggcaatgatagagatttgctttttcttataaacagagataaaaatataaattcacttaaagtaaaatatagcaaacaaaagtatagaaagtacagaggaatgtccaaaatgtctaaagcaggagccacaagtctgatttaagaaagaccattccattccctagggatgcagctggcttattagcagttagtgacatttgtcatcatgctggggataacaagaggtgacacaagtggctgcctgcatgcagggttggggagcgtgctctactaatgactgcacattcatttagcttacttagccctggaagcagcccccggagatctcacgcccatgatgaaatgctggcacaaaagtcgaataactggtccaaatgactggaaacagagggcaatgtctttgacatcaggccgacctgggtttgagacacacggctgaactccttactgagctgtgggaccatgggcaagtgacttaacctttctgattatgtttgatcaactgtaaaatgaggatagtagtcacactgacctcccagggtcgctaaaattaaattaagtgatccccaggaaagacttatctccctcctaacccacaccgagcacttggaaagtgtctgctgctgctactgtagcatcactgttactctcaccatcatcgttgtcatcgtcattgtcatctgttgtcttcattgtcaaaaacaacccttggaaagggacgcactaacacgcattatttagctgcctacagatgctcccagagaggccatctctctggtagcatgtgtgttttgggatgtggggccacctgcagtttgctatggctgggacaaccccgaggcctcatccagccctgcaggcctgggatcctgcgccagggaccctgcgccagggacatcggtcacctccacaacaccaggtcaatgttcagaagcttggccatgagcaacatccctataaacggggtataacttaacacagggacattaaatgcactggttaaaaatttgcaagccaatgtttaaaaatcaggagtgttcacagaaatccagatgtgcagtttcttttcagtcatcaaagttcaggcctccggatccctgttcccacacagccagggtcgctggagctgaacagagtctgtccctgtagatgggtgttggagtttgcaaccctttccatgaaggttaagagcctagtctttggagccaatccctgtgttactgacttaatcttctgctttgggccccagtattttgtgatagaaggagttaaagcttgaggccactgtgaggcaacgtggtcctaggtctccggtttctactgcagagctcagggggaccagctgttagatgctgtgtgtctgatgctgtctgttctcttcccacattctgcacctcagcacccaagggaactgcccacatctgggcccagtcgctctgtgttgtgggtaattccatgacagacagatgtcatctaatggcagacaaagccagatcctcaagtggcaaatgtgtcacgtgagtgctggaacctgggacctgcttctctccttgaccttggacaagttcagggaaacctcatgggggcccagaacatggtgccccgtgggtgatggtctacacctgcaggagcccctggggtgtctgcagtggtgctcattgctgtcctgaaaggtcagctgctttctcttaaaaagcaaacctcccatgagctttgctgggggtcggggagaggggtcatcaaaaagcacaaggggctgtcctgggtcactcctggcatccaggtggcaacatccaggactggagttgcagcttccccgtgccccaaccatgatgagtgtgggtgtcaggggatacatctgaatattgcaaatctctcaggaggaggacactgtcaatgattttgaccattattttccttgagcctttggtttggtgatttgggttgactttgggcttttgtgtttggggcgactttgcttttcctggttttgtttggatggtgcccgatatggtttggctgtgtccgcacccaaatctcatcttgaattgtagctcccataattcccacgtgtggtgggagggacctggtgggagatcattgaatcatgggggtggtttccccagtactgttctcatggtagtgaataagcctcatgagatctgatggttttataagggaaaaccccttttgcttcgttctcattctcttttgtctgccaccatgtaagatgtgcgtttcgccttccgccatgattgtgaggcctccccagctatatggaactatgagtccattaaacttctttttctttataaattactcagtctcaggtatgtctttatcagcagcatgaaaacggactaataagtgccacaccagcaacagagcattccctacaaagcccagaaggatccggtgttttgacacaaatgggaacagggtcctcttcagtgtttctactatgggacaggggctgagttctggccttcccacaagtgcactaattaaaaaggagagtgacactcagggagcgtgttctgtgtgcactctattatcttataacagcctcatatttttggatgagaaaacagagcccagagaggttaagtcactttcccaggccatagagcataaaaacagatcaaacccagtggcaggactgggtttgatcttcaccataacagtctacagcctaaactctagagccaaacaggagacaaacatttcttctgcttctggaatgttctggaatgtgagtctagaacaaggactgtcaaattgcaggcttcaggtcagatactgcccatgtctgtgtctgcatggctgtggagcactgctctagtgggccggtcctgggagccagggagggaggggtgcctccctccctgtgccctgctcctgtcttcctagctggtggctgcccttaaccactgcctggggcctatgctggtcccagctacccctggggcctgggctctgggcaactgctgggcaccgagtggaggaacctcatctgggagttggtgagccacctggcccacagccagctgcccaagctgagaccaaggttgtgctgggtgtacgggggtggagtacaagtgaccatggctcaccacatccatccttgggctggccacccttgaactccagaatgtcttcagtgggtggtaactggctgcaaagtgtgtcccctgccctggtagccctcttgaggcaagtggcagggcagagtttttcctcttgtttaagttcctacataatattcttgattttgcctcttagcctggaaagacaaaaatgtttactatctgcatctgaacagaaaaggtttatcagcccctgctctggaaaataagtggggattacacagaagggtgtcagtggaacatgctcagcaaagaggtaccagtaagtcatgaacttgtggcgctgtggttgagcttcaggtatttccattcctagccctgacccctgcattggggtttgtacagtgtagaagcttctggttgagactgcatttggtaagagggagcctctgctggtccagccccaagggagcggtcccccaaatgcagggaaccagtgtcttcttccactttttaaaaaattgattcagcacttgagatgttaacagatgttgcaatttcagttttgacaagattccaaaatacaacggtggctgcacactcacgtgagatgcagagggcggtgtcagagaggagagggaagatggggaggagggagggagagaggagatgctgaaaaccgtctcctgtccttagagccatcaggcaggctaaggatgtgagggttcagtgtgtggtgaggatggatgttttgggggagactttggaggagggttttggtcagcgtagctggtgtggtgagtctcatggccatcagggtgaagggtggggaacccatagtcccaccttgggcaggtggaatgaggggacctcagagacttaccctttaccctgtgccttaaggcagtggcactatgaccattgactcagtcctgggaaatccagagctcccctgtccagtgcagtagccactagccatgtgactgtttgaaataattaaaatttaagcttgtttttcactccagccgcttgtccagtgttcagtggtcatgagggtctagtggccaccatatggacaaggaagaaatgtgtccatcatctcagaaagtgctactgggtagtaccgagggtcagggtggctgcacatctactttgctgtgaaacaagggcagatgtagtttggattggctagccttccagagttctccatactaacagagactgtaatagcaacagaggccacatggcccaagctggaaatattttctacctggccctctgcagaaaaggcctgccaaaccctggtttggagaatgggtttccactggggtgggaagcattgccaggagctgggaggctggtgaggaggcccaggcagaagttctgacagctcacactgggaaacacgtgggtatttctgagaaatattttcgaagtagagttcgtgagacttgcctgtgaattagatacaaggggtgggtacagggtggagaggacaagagaaggatggcgtggggcatctggtctggctggacagctggtgggtcatggaacactgaacctggtgaaagtaggtgatatggtttcgctgtgtccccacccaaaatctcatcttgaattataatccccacaatccccataatctccacgtgtcaagggagaggccaggtggaggcaattgaatcacaggggggcagtttcctccatgctattctcacaatagtgagttctcacaagatctgatggttttataagagactcttcccccttcacttggtacatgtccttcctgccgccttgtgaagaaggtgcttacttctcctttgccttctgccatgattgtaagtttcctgaggcctccccagccatgctgaactgtgagccaattaaacctcttttctttataagttactcagtcttgggcagttatttttagcagtgtaagaagagactaatacagtagggatctgtctggattagtgccatgtccacagcttctagaatagtgcctggaacccatggttgttcaataacatttgcaagatgggttgatggttgaatgagcaagagggaagggaaggctcaggagaattttttgtggggaccaagattcaagtttggatgtgattggcctccagatggagatgccagtgtggccaactggtaacatatgagtctggagctcagagaaatggtccagggttaacagagaaatggaatcagttctgaagccaaaggagtggatgagaatgacctgtgagaaggttagacagggaagaggacctaggccttcatcctggggcagcccaggtggacattcagatgcaggaggtgggacctgccagagaggctgagcagaggtggccagagctccaggggagaaccaggagagtatgtgtcgggaagccagaggggaaagtgttaaagatggtggatggctgagtggggtggccctggctcagtgagggggccaggccttgctgggtggagatgcagtgttaaaggtcatctttcataagtttatttttcaaaggagcagataattgtaactaagctgggagtatacatgaggtcaagactgtttggtttggttttgggtagaatattttagatcttgttgggatcctgaaaagaaggataagtcagtgatgcaggccaagcgggacaacctgtcaatagctcagagggatgtggaactggcccaagtcagtgcttatctagtgaagtcttatgtggagatcagacatagaagatagatccagatgattggctggggctgacccagaagtgaggacactgaccccaggctgcccttcctccctggtatgaggacactgaccccaggctgcccttcctccctggtatgaggacactgaccccaggctgcccttcctccctggtaatgcttcctttggtggcacctctgagcagacccttggagcctggttcagacgctggccacattgtcctggaggagatgagtcagaggagtgctgagtagctctagacaaaccttccccaccatggtttcatgttggcctttccatacttgtagtgggcaggttcgggtattttatacagattattgtacagatgaggagactgagactcactaagcaaggtggaggccaaagtcactcgtctgtaaataggtcaaacgtatggaggaagggggcggatgctggatactggtgtaattgaggccgggtgagccagttccgtgacatctctgtctcccaaaagcaggactttggaaatgtgctgggtgaccagtaccctgagagcgtaacccattcacaaagaagcgttcaggaacaagaagtcctgtaaacccaaacaatcaaagcagggtgtggatgcaaggaccatattaaaggacttcagaataatagatgtgtgaatatctgaaaaggggtgggacccccccaggaagaaacttcctagaagaaaactaggcctgggctggctactgagagctcaccccatgcctggtggtcttggccaggaacttggctgccgaggaaatgggctgtgaagtgtggtgtcccaagaatgagggtgtccacttgcctgtgctgatttacacaagacagaaaactccacaaagttataactggaacctacatagagaaaatgggcatttctgtgcttacctgtggcttaacaaggacacctcacaactatttttacctagaaagcataaaatatttactttgatgttgttatcagggcaaaacttactaagtgaaacaactaatcagagttgtagactcttagacattataggttacaagtcagatgacataatgacagtctcaaagcataggagtcttaaaccctttttaacaagtaacacttttgaggacagtttaatgtaacaagaaaaataaaatgaaaacagcattttcatgtgggtatccatgcagaacaagagtatagagccagttgtaatggttgttctcagttcaggccaacttcataacacagagctgagtctgccgtctgcagctggagtatgtgttgttgagggagaacaacacatactccatctctgctttcagagattttgttctccaggcattaggagggctggcctttctgagataaggactccattgtcatgaacttaacataagaaagggctgggaatgagagtttaaaacttccaacatagccaataaaggaacggaaactaatgatagctaatgggatacaaggagcgtgcaatatttgcatctggtgtttagctggaggctctctgcaggcaggaattaggcctgttgtaacaccccctccctgaccactgtgttttcagcaccatggacagcacccaacagctcttgggtacctccagaaacagcagctgatagatgaatgaaccccataggagctaacacagtgacccaaggacaagccccagctccactaggcttttcccttagacatacagtggggagagtgttcgtgtgttcttcattgggtagttgtaaaaactgaataagatgatgtatgccaggtgccttccacaggccttagcactcaagagtgtgctgagagggcaggaagtgagggagtgctggtcccagggagaccatctctcttggatcagagggaaggaagaatagagatgctggggacagcagtttgcatttgagtcagaaatccaagaggagccccggtctgatgacctcagtttcccctgtaaagctggaggtgaagctgtgtggtgggagcaggcaaaggtgggaagctggaggtggggaagggacagaaagggcttgagcagtcatgcagagcacctgcaggaggaagctcctggccacgggtcctgcagagtgacagttcttcctgaagtggactccgtaggctcttcctcctgcaatagtaggcaagggcaggagcagacaagtggcagcttaatccccagatgaaacttttccagagagttaaatggaaaggaatccaggcaaaggacttagggactgttggtccgattgttgttgaaataatggatgatggaacccaagccaggcaaaaagagaaataagaaagggaaggattgataggttgagggaaagctggggatgggcaggctgaggggtggttgtgaaggaggtggatggagcctgaatcagcagctagaaagggagggatgagggttctgggtggcctgacccttcctccaagtcgatccttcctatcctcactcccactctaggctggcatgccagatgttagggctgctgcaaacagacaaataagaatgagagctgctggactggagggttacactgtgtcatggccacttcttgcttaaactgagaaacaatcctgtgagggactattgttaacacaatgccatgcatgagtaaatggagttttggagagatttagtaacttaaggtccaagagtaaattcagagaccacttgagcctgggtgtgtctgactccaaaacctggcatggtgaacactgctcctaggtgaggtgggagctgtggcatggacctctcatgtggaaaaaagaatggaatccctcatactattgaaatgacttccctctctccatattcctctctctgcttccgatggttctattgagagttgaacttgcaggaagtcaagtgcctgtgtgaggtcactgctctgtatgctcttcacgatcccatcccaccaaaccctcttgctttgctctcttacttccactgctgtcagaggaaacatgtttttaactctctgctttgcctttgaaccagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggtgggtccacatgcatcctgcccattctatttcctttctctgccccatccatccatctatcctacattcatccacccatccatcatctatctatttattcacccattcactcatccatccatccataccttcaaccagtcttgattgggcaccaactgtgggctggttctcatcattagcttctgtgactggggctcagggcaggcccagaggagtagatcttaccaaggaaactgtggttggcaggagtagactgcctaggctccctcaagcaaacaggggagtctctttgcaggagtcaaaggggggatcttccaggacctgaatgcaagaggtgcagccagttcccaggatggggcttggctttagcttggcttggcttttctttttcttttttcttttcctttccattctgttcctttccattccattccattcctttcctttccattcctttctgttccattccattctgttctgttccattccattctttctggatgctcatgtgtctgtctttctctttgtgcttctctctgagtctcagtctctttcagtcagtctctctcccttcctccctccctctctctgctggtctctgttttgctgtttcactttccagtgagttctgtccagcaaggcagagccaggagtaaacagcagacattggtggtcagataggggtgcacagctggacagaggcccccacagtcatacacttatgtagcttttgtcacactggcagaataatcctagcaagtagagataattactttgcaagcttaggtattttttatctggaattgactgctacaaacaggacacattgatggtctcagggaaaaagtaggctgttgatcaagagataatgacttttcagagtaaagccttgcgtgctgtctttgaaggctgtgggcgtgaaacatgatgcatagcagggtttgacagttttgttacaatcacctaaccagtgattaaccaccatcaataattgccatttgctgggtaggcacgaggtgccccatttatggttgagaaaacaggctcaggaaactccagtaacttgtcccaggtcctggaaatgattgagacttttgaacccagtttttgggcccaaagcttgttgctaccacacgtgtggccaggggctggtgccctcccctctgcgatctcacctaatcctcattgtgcttcttcccagttttcatgaaagagggaactgccaccttttggaagaggtgtcagctgctgagacaaggagagcccgggcatgagctcgggagggctgggtcccagcccttggctcttttctggggaccttactgccccttatggggtgaatgttcaatctggaggggactcttgggtggaaaatgctttcagtggggcattttccttgtacacctaacacgaattaagtattccagtctaactgatgattctcagccagataccacagaaacggaggaggtgagatgcaccccacagggggcctctttagctgggactgcagatgtcctggatgggttagatgtggggctgtggtgccctgtggttccccaagtagtattggtttgtgggagaatgtgctgctgggtgggtggagggatgagtgagggggcgcccccgccaccccaccaccctgagacttggccccagctgttctccctgacagaacattctcccttcctgctttgcctggtcagtacctttgcatgcttgggaccacagctcaagctgtttctcctccaggggagccagccctgacccttgacctcatagcaccatgcgccccatcttccagcatttaccacattgccccaccttgtttagtgggttgaatggtgtcaccccaaaattcccatccacctggaacctcagaacatgaccttgtttggaataagggtctctcaactgccattaagttaaagatcaagctgagctcatgctggattcggttaggccctgaatccaatgacagtgtccatgtgacaggcaggacaggacacacagggatgggactgatgcatccacagaacgccaagaattttccgggggagaggcctgggacggcatctccctcacagcctcagaaggaaccaacgctgccagcatcttgatttcagacttctggtctccaaaactgtgagagttgttctgttgctttgggctgcccaaggagccatacacgccttgtctgttggatggtttgcctctctctaaccacctgccccccagacagtagtccctgagagacggccacacgtctgtgttcactgtcaaatccaagtgcaggcatagtacagggcatacagcaggcactcagcaagtgcagatgatggttggatggatgaatgaatgagtgaatgaatgcatgcgtgctctgaaccctgtctgtctgctttctgcatctttctacatctctgtagatgaatccaaatattcagtctttatgcaacatggccacataaattacagtacaaagtttgaggcaaaactgtgctactttgcattttgttattgtctttgtgatagctccctttttcctccattgaaacctaaaaccatttaaagtccattcaattagccaccatccacctcattttattctggcgaatgtataatttgttcctggccctcaataacttggtaacccagagagtttcctgcctctcccaagcttgggaaggtcgagcctcagatggcacaggtcttcattctgactccacacgccctaaattctggcgttctgtccccagtctgcggacacttctggcttccgccctgccctcagttgcaaggacatcaggggatactctgacacttatgcgtttccatagggactgaattgagactgggaggtggaggagggtagttccgagctatgggtcctggcctggcttcttcctgcacagactacattttggtgactttgatttaattttctcagttcctctttttccttttcctttgggaaaaggttcatgtgcttcagcatgtgaacactagatggtagcaaagaagaaagtctccttacctgggcttcccttgctgcaggagggaccctggcccaactgagtctccacccaaggcaggactgcaggtgtcttagttcatctgagtgacttataaaccacagaaatttattcgtcactcttctagaggctggaagtccaagatcagggtgccggcagatttggtgtctctgatgagggcttgcttcctggttcataggccaaattcctggactttcttgaaaagtcttcatctctgatcaccctctgagtcactacaggcccattaaggtgggcaggttctcctctgtgtgctgtggtccccaccctgcccccatggagaaattgcaggaggtcctttgcattcctgggtttcacctgcctggtccctggagatgcgtttacccctctcccttttacctctcctttacccctgctgtcacctggtccagttggtaacgctcaactctgcgggatgggagtcccacagcctctgccaagtgtaagtggagctgggtgcgatgtgctgttctcagcccccaccttttcctggcagcctgcccctgaggtggcttctgaacctcagcttcctcatctgtgaaatgggggtgacaagtggtcccctgcacaagctgggtggggcgagccaggcaaagctctatgggggccgtgggggcagtgctggttgtcacatctgtgattgacagtggggcagagacctgggtgggatcccagctccaccaagctgagcgagagcaggcaaaccacgctgcctcagtttccctatttgtacaagagggctagtgattccttcctcatggggctggggtgagaagtagaggcaatgatggttagagacagaggggctgggggatgctgcgtgtcacctgcgtgtgctcaggagtggggcactgtcctgagcaggagcagcctggggaggctgaggccagtggggagaggacagcgcagtgtgcagaagctggggatgggtctccctgcagcccctgccctgcctggccacttcttgcatggctggctccttgtcatttctcaggtctcagctcaaagtttccctctgcagagcagcctttcctgacctccctctcccaaaccagctaccacctccccccgaccagcccagtactctcagcccacctgcgtggtgccctctcgcccccctccctccaccactctctctcccagcccttttctctccctctccttctgtctccttctctattctacaatcatctgctctctttctgtctgcctggcctctgtctgtctccaccagctgacggcagggcctggcccgtttccctgtggcctggccttgtgtggccaagcaggtgcttgtagagaaagcgaaataactaaagtcctccacgaggtttacagtttccttttgggttttgaggaatactttttattgatgctgtccacatcccaggattgtattggaagtttgtttctggtttttagggaatggggtagtttagatctggttgttttgctggtgggattaaagggatctggtgtttgcaccagtcctgccaggacgcttttggaatgagagtttgtgctgaacacctaagagcttctgggcctgtgccagctgctaggctcctgaaaaggagctgatggtctcattttacaggcaagtaggctaagcctttgagagcttcagtgacttgcccagagtcttgcatactgggaaatggcagatcaagaccagaggccaaatctgcagaagacaaagcccatgctctctgctcttccgggcacctgacaccctgctggcccggagcacatgcaggagactgtcattgatggaaggagggggtgtcccactcatttagacttgaatgagcaaagcctgtttagaatcatcttcaaagtcatttcatgtacacaagtgtttattgcccgtgttttaagtgccaggcctggggaaactgtaggaaggaaggtggacacaggcctgcccaggagcaagaaacagactgggcagcgtgattcactccaagtaagaggaaaagtgtcagggcaggctcaggtcccaggggacaggagacgagggatctgatcatggcctctctaaggaaatggtattctagcagaggagcggggaagcatttcaggcagaaagaacagcccatgcaaagactcaggttggacggagtgtggtgccttcaaagacgggagagatcttcacatgctggagtgaagagagtgaggtggagatgcagctagggagccgagtggggccacccccaggggccttgagactgggccatgagttcgaatcatgtcctaaggaagatgggagagtgatccaattcaccttctggggtgatcctcctggcagagatacagggagagggttggagcccagaaatttattccttactgttctgggggctggaagtgcaagcccaaggtgctggaatagatgctgtggggagggcagagcggaccatggtgctcatccaggctgaagggtggctgcacagattcttccgggtttcccaagaacaagaagcagcttcaggaagctgaattcatagcagagaagcaggaaggaggcttttctaagcccagcgccctgcagggaggatgctggtgctggtgtctgcaaggcttggcccctaacagggtttgccctacagatggagcagaactggacagagatgcaccctggcctctagctttgggagcagggatcccggtccagcatcttggcattagttggggcccctcctggaggtgcaggggagcgtcctttccgctcatggtccccagtctcagcaaaacccttggtcccagctcctgaagacctatgttcttgctgcttcctcccacaccccaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacaggtgaggccctgccccatgagggagacctgtgctgccagaatccctgcctggccagcctcaggctgtgcagctcatgccacgcccagggccttggctgggtgtcccgttctacagtcactttctgaacaaggaagtcacattttcattttgcacctcgctctgcagattgcatagctgatcttggttcccacattctgggacggggtgcacagtgaatgtgcactatgggaacctggccacaaagtcctgtgcgtgagcccctcaggacccagggtggggtgggagctttgcaggagagactgacttagagaaaagtggccgttccactttgtcccaggacactgagggcttcatagttgtcactgggcaagagtgtaaggcagcctgtgcctgcagcttactcttattttggatcacatgtgtctcatggactgtgaaagattagaggtaaaataggtaataggagacagtatgggttggaggaatattagacaaacaaaatgtccttctcagtttttgtgaagtcctcgccctgaacattgattgcatgtattttggcaggttttattacttgcatgttctgtgcttttcaaaacagcatgttgtaaacagccatttgccttgaactcaaatcctcatgctccttctggtgtgtccaggataaaaaccaagaggtcacatgcattttggggctgcctctgtgatattcattataagctccaaagtcaatcgtgctgggtttctgggtgaagggggtgacctataacctgaaccatctttctggtttagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggtgaggaaaggatggcccattaagtgtggggatctcggccagaggtctagtgtcaccagggggtcgaggacagagctcgtgcctgggggaggaacaggtcgaggggctgcacctggggagaaacaagaggggggctgtgtcctctggaaatgagcttctcctgaaacaagctggggtgggggtgcacagccaggcttagagcaaggaactagaaaataccccggtgaaattgttttgagagttgcatattagttttcatgtgtatgtgaaaaaaaaaaacaacataaaagtggtgaagcaagtgacttagagaatgccacccctgaggatgctgtggcgaacagtatatagttggtgtacagatgctcagtgtacagaagttatagcaaaaacaaaaacaaaaaaaaactgtaacaagtaaagcaggacgagatggaagcagggggagagggaggaagagagattgctctattgatctcaaatggccgtctcagaagtgctgtggatgggacaggcagcatacgcttgtttgggagcagatgctcacagggtccttggaagccagctccgtatttgtcctcatggtgcgttctcccatgaggtaattgctccatcctacccttgaggactccggggctcgggacgatagaggcctgcagaccaccctgtgatgaagggagaaggaggctcaggccaggaggaggaagtgctgagggggtttccctcccagctggtactggctgtgcggggccctctgattagtcccaggaaggtccagggcggccgtggtgtttggcctgcaagggaaggatcaggaagcgtccgttgctgttcttcctggaagcatctcatggtgactgttgcgggcatgggcaaagctcaggccacgtctccctgggtgtctgtggggagcaggaaagggcatcagatgtcggtgctgaccctggctggtactgaaggcatgcggtgggtactgtgatgggtggatagaccggcagcccagggctccatagcctcccgcttcctgctgctttggagcctttccaccgggtccgaggaagcaattctgagtatgtggctgcacaacatgaaaggggtgggggtgctgtcacctgtgcgtttggaggaggctgactgccaccgcggaaccagtgtctttgtggcagaaactaggagctggtcactggcctgagggcaccaacctctctgaagaggctggagcctgtggtgttcccaaactcgttaggccctggaatccttgcccttaaacacctgtgagcctccagcaggagggtgctatgagggtgcacttctgagtagagctggtgttgggatggtcaagggctagagcacggtccctcagcctcagcgctggtggcaagaggccaggcgattctctgctggggagggggctgtcctggacacattaggatatcctgcagcatccctggcctctccacactggattcccccagtgaagacaatctaaaatgtctccagacttggccagatgcccctgaggggcagaatcacccccagctgagaatcactggcatagtctgtgcccttggtttgggggtgcccttccataagtcccttatccactccaggacacaatgctttcattggtgaagagggagatgggaactgcttcctcttgacattgacaatgtcagcagccagggccccttaccgggtgtttcttgtgtccgggatgctggtctaaggttgtgacaagaaaggttttatcctcacaggagccccatgaggctatgacatcatagtccttattttacagatgtgtaaactgaggcatagggaggccatgtaactggccatggtcatgcagctcgttggtgccaggctgggacttgaacccaggctgccagcgccagctttccgctctgtgctagaccctctctgaggatgagtggattaatccatgtcagcccttggcacagggcctggctcagggtgcacctcggagagcacttcttcctgtcctcaccagccacacggggaggatagcccctggggaggacagcccctggggaggagagcctctggcccagaagggtctcccggcttgactttcctttagggcattgttaggccatccagatgcagtgtcctcacgcctggcgttaaaggtataatgcagtcattttatttaaacacagaagaggatgggaatctgcatttcacctctcgggagcctcaggcctggcccggatatgacctcaaaaccctctgtggcagcgtggttgagccagcagcgtggttgagacacagagtttctgcactggagacggcatcaaagcacatctagcagcacccttggctcccacctctgtccctcccgcccagtgccttccttctctgattgagtgctctgcacagggacgcctcctgctcagccaggtggcctggtcacagccagctgtgttagcctcttgtggctgttgtaacaccttatcatctgctgggtgacttatgaccacagaatttactcttctgcagttctagaagctagaaatccaaaatcaaagtgtgggtagggtcgtgctccctgcgagtgctccaaggaggagccattctcttccagtttctggtggttcctgcattcttggcctgagaatcccagccctgcctccgtgggcacatagctgcctcctctccctccttcctctccccttcatatgaggatagtagtattgcaggcagggcccatctggataatcctggatgatctcctcatctagagattaacttaattacttctgcaaagatccgatttccaaataaggtcactttcacaggttctggggatttggacttggcacatcttttagagaaccccctttcaaccccctgattccactcctcttggttaactcgttcctcttctcattgagctaaagctaggctctgggatttgacccacaaagtcccctccatccctgagatctctgtggctgggccggtccatggcctccaacagaatgtgctgtgaagcttggacttggccctgggcaggtccctcccctgtccctgccccatttccttgttgtcagacgaaggccctcattgttggcttctatgacaacactgaaccttccttcctagctgggacacagttgcagattcacactaattcttgtcattctctattctctgtctctttgctacctatcaattacttattgttgactgtctaattttgtctgtatgagggatcatgctggtatctgtctgtgtcccgtggtgtgtccatcatcccagggtacctggttctaagagtcagtaagcacctgttggttgtgtggctttaaacacatctgtgaccctgatgaatctgatttgtccctccagccgatggcccctgagctccagggtgtctctgtggactctacgcatgcgtccacgtggggactggtgtgcattgcatagcttacatctccagatctcggttcccatctgcgccctgtgctgggactcttctccatttcaatcaatacatctaagcctcctgtgaagcttttggctttgtgctgatgtccggatgaccctgaagtcctctctgttccccttggagcagttcgcgggtccagccaactccctcttctctggcaatggtttgctgtgctctcctgcctggacttggcctccaggcggtctctctgtgccaccattgccccatttctagttcattctccacacaggtggccacaggaccagggtctcatagaagttggataatgtcacctcttgctcaaatccctccagtggctccctgaggcactgaatgccacatcctccctagtgcctgtggccccaccccatgtggcctgcctccctctcccggctcgcctctcccttggacccagcccatgggcctctttgatggtcctcacaccccaaccacagcccctgagactcttgctgtccctggaggtgtgcaaggctccaccgcgtttaaaacatcgctcagtgcaggaagccacctggccgctgtgtggcaacacttggccccttcttctcacccaaccttatttcccctacggcagcgtccctgacgccaataccattggctttgcccatgcagcctctctaccagcacatgggctccgcgagaccaagtcttcgcctctgtagttcttactgtgcgcacagctcacgagtgctaagtgcaaaataaatatcagttacatgaatgagccagaatgggccaatgggggattagagaagccagtgcctgtaaagtactaacaggtgccaggtccagggagccctcatccctggactgtttctcccatggcgtggctcagacctgagcctcttgttatttgttctcgaaacccagtgtctgtaagtgaacacggattttgagctggggtctgagagtgggggaaggtagcactcattgtagaaactcattctggaaactgctgtcgtgaacgtggcccaggcccaccgctgtctgcaccgtgcaatgtgttacatggggtgtcatctgcaagccctgggtgaggccccctttcctccatgggccttttgtgggccaaggtcaggattcctgtctgaccctgagaaactccttgttgagggctgggctcattgcacaaactggcaggtatgtctgaggtgcaacctccagccatttgcaaattgaggcttctgtgtgctggtcccagggtatagagtctagggtccctgaagccctgaaatcaagtgcagaaagcagtgctttgcttttgtcacattctcaactgtgtccccaatgctccagaagtgatagatctctgagataaaatgctgtgggaaaattcaatattggtcatacagaaagtatataaatgttgctttttggggggaaaattactcacagtaggaaaggcctgtaagagtattttgctttgcctggtgcagacaatggtgaataatggttgttatttgcttctctctgcagtgtgttgagttcaaaccccattcccactgtctcgcctgatacattgttttcacatctccatggggtgaaagcagaaagcaccaggcagcaaattaatcaattattaatcgcaacaactactattttattcatttattcatttattctccctctctccctctctttcccctgttgagggaggtttggcagacgttgtcttatcccatgtgaaaaagaaaatttttgttatcaaacgtttttgtgaacttcagttctctattagaatggagaatgcatctgcatgagaatttaatttttggaaatggtggaggccctatgcccacatgcacatgcgtgcccacacacacaggcttgcacatggggtgccttcgtgggtatgcctggtcagcggtgggtgagcagggccttgcgctcattctccagtcatcaaaagcgaattttatgagaaacagtctttgtgttgtcactgccccaagatttaagttttaaaacctgtcaagaaaaagatgtttgtgttttgtcttttctctgtgctgaacccaagagtcatgaccacacctgtctggtttttcacagtgtcccagctctgggcgcagtagaaacacgtgatgagggggagcgagggactgaggggctgctatgggaatccgggctgcaagggaagaacctactgatggaaggaagctgacttctccagagccccccagctgcctgtgctgctgctcctcctgcagacagcttctcccaggtgctcatgacagcaaggctgcaggctaggactcaccactgtgtctcacctgggcccatgtaaggacagcacaggccctccacttcatccatgctgtagtcttagtccctttgagctgtcataacaaaatccctagactgggtgtcttataaacaacagaaattcattcctcacagttccagagacagggaagtccaagatcaaggttctgacacgtggggtttggcaaggccccactttctcataggtggtgccttctatgtgtcctcacatggcagaaggggccacagagctctctaaggcccctttcctaagggtaccaatcccattggtgagggttccacctaatgatctaatcaccttccaagaccctaccccccgaataccatcacattggggttaggcttcaacataggaattttgggggacacaaacatctggcccctggcattgggaatgtcacagggagggctgtctgtgcagctgggtgggcctccgtctctggggcttactctgcgtagagagacttgctgcaggatttgaccaccccacgtgcctcgacatgtttctttctagctctgtgaccttggaaaagtttcttaacctctctgtgcttcagttctatcccttgtaaatgggggtgacaagaaagttcttatgaaggtcaacaggggtgctcaccgaagtatagctttgtctcattgtgctcagtgagcgttctggttgccgtggtaatcagcactgtcaccctcatcatcactgtggttaaggagcatataggaacaaggaagcactgggcatccaccgctcatcaaaatactgcctcacaggcatgaagcaaagtttagctcccagtttgtcaatgttccgtagctgatttgtgctattcctcattcctcggccaattcatcagtgagagtgttgatgtccctgccgctgcataggtacatctgttctccatccagacatgcagttacatgtgtttgtgtaactggctgtggttttgcttgcctgcttagcaagggacaagggcaaggggaattaatcaccggggtctatgtgccaggacaggctggcggggacctttgggttggtcaggagaaacaagcctcaagaaggcctctcgatggcacctgccatgagccacccgtcccagaccaggttgggtaacccacggcgcccagcctcagattactctgcccattgggatgaccctgggcaggtggtggcacatctgggccctggctgcctttcggtagctcacaggtgatgtcagtgacccccttgtcaggttgtcctgggggcggatgagacaacgctcatggagggcctggcctgtgtgggcacatggcgctcacgtggtagccctgctgccaaggttttctgagggtgtgtcccagcggcaaaagaaaaaaatctgatatttgtacattatttatttataaactatacattaggggtaccatgctaatatactgtgtactttataaaatatacatgcaagatagtaataaaaggtgacccgagagagtgactatgtacatattaatatgttctagcacagcctgccccactgtgtcctaggagtaaggccctaggaagtatatttcagcaagcacaggggggttctagtgctggtgcaggagtgaaagagtaaatcctagcccccacaatcccatgagtcaattccagtcagctaggcggtacaagagtaaagggacatacgggatttcccggctttatagattttttttaaagcttcttaagacacacccttgctatgtattcagcaagtactatatgtcccaatctaggcctcaaggattctaaggagaaactagacacagtctccaaccctctaggagctcatgactgaccttaaaagctgatgttcaccataaactcaacaacgcaaaagagggctgggtcgggagttgaaaggtgtattagtccgttttcacactgctgataaaaacatacctgagactgggtaatttataaggaaaaagaggtggttgtttttttcattttgttttgctttgttttttgttttgttttttctaagacagagtcttgctctgttgcccaggctggagtatcgtggcacgatcttggctcactgcaacctccacctccggagttcaaacaattctcctgccccagcctcccaagtagctgggattacaggtgcataccaccatgcctggctaatttttgtatttttagtagaggcagagtttcaccatgttggccaggctggtctggaactcctgacctcaggtgatccacccacctcggcctctcaaagtgctgggattacaggtgtgagccaccacacccagccagaaaaagaggtttaatggacttacagttgcacctgcctggggaggcctcacaatcatggtggcaggcaagagagaatgagaaccacgcaaaaggagttttccctcataaaaccaccagatctcatgagacttattcactaccacgagaaaagtatgggggaaaccacccccatgattcaattatctcccattgggtccctcccacaacacttgggaattatgggagctacaattcaagatgagatttgggtggggacacagccaaaccatatcaaaatcctaagacaaatgtgtgacgccaagaatgtggtgacacgggcatttgatgacatggagaacgttacacggagagaggcaacactcaggcagttcctggtactgtctaaatgtaaagaaagccttctttgcaggctccgggatcctttccccagtagacatacttgtaaaaagtgaatgctaacgtgttatttgaatgccattttaagtgtggggagggtgtactgaaaggcttcgtgcagtgtatgcttctgtaaagtgaagagccacctgcagcgagtgaggactcccccacagtcgtctccatggtgacttcacagaacagcaggcagcccctgccttttcttgaaagttggggctagagatttgaaaggctgtggaaacccagccactccctgcactgacaccagatggcgctggagatgctcgctgggatgcaggatgcttgtgagaacctggtctcaggacgacctggtgggcgtcttgcagcggaggcaggtctggcccagggtggttctggctgagcaccaagcagcagagctctcagagtgggaacgcacagccccagtgacaatcagctgaaacagggctgccccccgccccgccccaccccggcccttttttttgtttgagctattatttcccatcaagtaccttgataagcacttttcatgcattttattgcctaagtcccttgacaaggtgataagacagctgctattaccgctttttttgtttgtttgtttgttaacagtagaggaaaatgaggcaaagagaggggatgaaacttgcccattttgaatccagggctttccagctccacagcacatgactgtagcctactgttcgtccaatgcgtaagcacatcataggtgccaggcactgccctgggtgctgtggacacagtgatacaagccagggtcccagcccgcaggtgcctgcagcaagggggaggcaggagcccccaggaggtgatttcaagattggggcatgagcaccagatggacacaggcaaagagtactctgtgatttgtgcatctgaaagcagctgttctgggccagccgtgtgctcttaaaagcattggtaggaactgtatccgtctccctggggcctgggcctctgcactttgcaggctccgcaagggtgaaggtcaatcttgtgtgtcctcttggctgagctgttccacccagctattgaaatgctagtctgcatgttgctgtgaaggtattttgtagatgtggttgtcacctgcagtcggtgactttaaggggctttgagtggccctctccagtcagttaaaggtttgagaataaattggagtttcccagagaagaggaaatcttgcctcaagactgcggaatccactccagccgctggcctgccctccaaatccaggactgtacagcccccgcaatcgcatgagtcaattccttaaaataaatgtcttaaaacacacacatatgcacatatatgtgtgtgtgtggatgtatatatatatatatgtgtatatatagaatgtgtatgtacaaacatgtatgtgtatgcatatgtatatgtgtgtgtggtgtgtgtctatcccattgcttctgtgtctctggagagccctgacccaaacaccaggtgactctcaagagctgccagggtggagaaccaaagctttaaaatgaggagtcctggtcatcaaggtaaaggctttccacatagggacagcttgagcctgggcgtggagatgagacgcgtgaggtgcacagggtagcgtggttgttgcatagcccagtgtgagacctagggactggccagggagagagacctttattcaccctgtaaagaaagctggaattcaaaagacaccaaagtgtgaagcctctgagggttgtcccaagtcactcacctcctggctatgtggccttgggctacactgtgggacgttgtcatctgcaaaataggaaaactaaatcctagcacctgccttatagggctgcggggagatgacatgggaaacgcattcaaaggctgcctctgggcctggcataccgcaagggctcattcaatcttggctgctcttgctgccactggtgggaagcagtgtgggatctcctgcagctgaactgatctttctggagtgcagacctgatgccgtctgtcatgattcaagccttggaaagggccccaggactttccgagggtgggagggtgggctccagagaaaagacagggaggggccatgaggaggctcaggcaggaggggatggggtctgcagggagtgtcagagtcagctccagctgccgtaacaggataccacagagtggatgcctgaaacgacagacgtttgttttcttaccattctggaggctgaaagtccaagaacaaggtgatttccagtgaggcctctctctgtgtctttatagggccgttcccctgtgtgctggttggtgagagtgggtgatgagtactctggcctctgtttcctctacagggacaccagttccatcagatcagggccccgctcttgcaacctcctttaaccttagttacctccttacaggccctacccacaaatacagtcacattgtgggtcaaagcttcaacttgtgaattctggggcagagcggtggtacacaggtgaatcataatgtgggagactgaggcagagaggagaaactggcaggagctggggagtggggatggtgctgctggactccattcttgcagctgtgggcccctggctgcaagagaaagcgcagaggggaggaagcgggagatgattcgccagcgacctgagttgactagagaggggccctgcccagctccacgctgacagggaccatatagtcagtcaagagcgtttattgagcacctcctgcatgcactgtgaggaaagccaagtcacatccacagaggaaggccgtggtcagcagcaccagcatctgtccagtgggtgtgtccctggcatgttgcaccagcacagcgtgtgaggtccgatccttaaagctgcttcattttgttttccagcagccctctgcatcccctgcttctgcatcccctacttcattttgttttccaacggccctctgcatcccctgcttctggttttccaacggccctctgcctcccctgcatccccaggtagcactagacttttctgtttatttgcaggtagtgaactgccactgagtctgagtcgtaaacactgtttggattcagaggtcagaatatccttcccctgtgatgctcaaacttctgagtcagttcggtgttttgccagctccctcctcaactgagcccctctgtggcaggaggcctggggctgggatcctcccctttgccctgctcattccccagcttctgcgtgtgtgcccccagggagtgcaggctagcctggtgtctgggggccttggctgggctctgagctctgtgtggccattcagtttgcccacttgggtcccagtctgtggggctggcacctgctggaggttcaatttcccttcaaaaaaggtcatggtgatccctctgagaattactttgagaacctgacaactcaatgatgtgagattgcctactccaaggcccttctgtgggggacagcgagggctgctgtggcctcctgctcctctctctttaagatgagcaggtccatccacagcagcccagggagcagccctgggggcagagccatcaaggacctggtggagccatcctgaaacttcaacaggtcagggtggccattgtgcgcggcatggcacttagcacagctgagcagttaaaggggtatatggagggccctctgtgcagttgacaggtgtctgtggagcactctctgtgccattgacgggtgtccatggagcgctgtctgtgcagctgacaggtctccacagagcactctctgtgcagttgacgggtgtccatggagctctttctgtgcagttgacagatgtccgtggagctctctctgtgcagttgacaggtgtttacagaagtctttttctgtgcagttgacgggtgtccatggagcgctctctgtgtagttaacaggtatttacagaagtctctttctgtgctgcttgtagaagtcctcaacaatggtgatcttcactaatcactatttttttttcaggaagtatgcaggacttttgcaatccaacgtgcgtgtgttattttaaatttcatggctatggtggcagtggtgtcagagtaagggaaatcatgcagagtggaagcaagaggaaaccctgtcacttgtgccctattctgttgcaaaaccatgtcccagtgctggcctagacacacggggtaggaaaatagacaccacgtttttgtaggaagattggagaatagtggtctccttgcacttgacctgctgtgaagagttgatgttaacttcttggtgagtatgtaaattacatccatgggcacaggcgttctcgcagaggatgccccatccaggcctgtgatgcaactgcagtgccctggcaagtgcactggcttccggggctgggctggggagggcactgagctgagatccagaggaggagcagaggtgggagggtctcacaggctcagaagctccagggtggaaggaagcccagcctttgagggacgaaagggaagaagacaggcagagatcattctggagaagccagtaggggagtggccatgtgcagccttgtctactatgccagtgatctcactctttatataaagaaaatgcacaagagatatagggacatctttgtggctgttgttctgccaacaaccgtggcacacacaaaaaccctcacagcaggagcccaggaggagaagagagtccccattccactccttagacagcccctctggccaggagctggagaggagagtttccagtgccattccttagtcaggcgccctgggctagagctcaggctttcagacagagcctgacttttccacacccacttcctactggtttacagctactgtataaagcaaagcaccctcactttcctctttgtgacaggtagtgatgctttttacagaaactagactttatagaagcctggaggtgtggaatggtagagatccacaggactctgtagtgaacatgcaacaccagctcccatctgaaatacacacccacagatgcatttttccgttttattttatttcttccataagttattggggtacaggtggtatttgcttatgtgagtaagttatttgtgagatccttgtgcactcatcacccaagcagtaaacactgcaccatatttgtttgtcttttatcctttgcccccctcccactcttctccccaagaccccaatgtccattgtatcattcttatgcctttgcattctcatagcttagctcccacacataagtgagaacatacgatgtttggttttccattcctgagttacttcacttagaataatagcctccaatctcatccacgtcatcgtacagatgcgtttttctctagagaaagttcatcagcccagaaggcctgcctgggcgcttccctttcagactgagggatagtgacacttcccttaccctcaggcacccattgcagggtctggatgccccccacgcctggcagcccctcctcccccattgttggctccctcctctcattaacctccaaccctgctctctccctggctcccaggacaccatccctgcctttcttcctgccatcctggcccctcttccctgacccgcccctaaaggtgagcaggcccaagcttcctggctccttcctttgctggctctgtgctctctcttgaggctcaacctcacatctgtccccatatgtggatcgtcacaaatctccatccctggctccagctctttctgatgctaaaacctcacatgtccatttgtccactgtccctgcagaggccctgatgcaccctgagttcagcagagccaaagctaaccttgtcctctttcccgggaaacccgctcaacttcccagatcctcatactcagctaatgtcatctccatgtttccacatcaaagcccaggcagtcccctcctccaacatcacagccccactcattcagaaaagatgtgccatgatgtatgtgtcaggcatggcagggagagtttgccctcaagacccccagagtctggtgtcggcatctataacagtgtcactgttgtttcagaaaacgtcaggcacttctgcctctggccatgatgaagcgatggtagctgccctcccactaaaatcaaacgagagactggacaaaatgaatgagaggactgtttcgaggcattgaacagaaacagtacatgcctgttatccttgagagagtggagacccctgggttagcccataattgatctccctggtttctgggggaggcatcttcctgcagggtgcagggaggtggcctctgagcagagtggtgatctcaccgagatgaggaggcagagactggagtctgggctactgaaacagctggagtttgtaggacaggaaggagctatgtaacgggttctgtgcagatccagttggccatagcctgggctatgcctatatgcagaattctacagacttagcagagattgcctgtgagcatgacagctgaaggtcagggggtgctaggagatgttgggagttcagctcaaacagaatgaagagatcttgatgaatgcaacagacttgaaatcccacaaagaccaagacttaggagtaaggggcataccttaaggctttgttcaaaaccaaaatggacctgcagttattataaatatgttagaggtcttagagtgtcaacaaaatgatcacaatgaatgaccagatggagaatcttagcagagaaacagaaacaaaaagaaaaccaaatggaagttctagaattaaaaggtacaatatctgaaaatgtcactgcttgtgcaaaacagactccaggactgttctcacacaggggcttataaagccaggacataggccaggctgggaggagttggggaatccctgccaccctcctctttcctgggattcattactccctctacccaaatgccaaagcctcatgcacatcaattcatgcagcctgaacccagcaggatccacgactgccaatcctggcttgcagtttgtgctgggaaatggctgcattagcaacgtggagacatacttccttgtaactaagactttgtgcatctctgtaattatgtccttaggataaattccaacatgcaggctaattgagaaaaagatatctcatcatgagtttattttaactccaaagcctctttgccttatgttcttatttatatacatttcctttttttctcttttttaaaatttaactttaaagttcaggggtacatgtgcaggtttgttatatagataaacttgtgtcatgagggtttgttgtacagattatttcgtcacccaggtattaatcttagtacccattagttagttttcctgatcctctcccttctcccaccacattggcatcctttttcttctctagagagtatctgagactggttctaaaagcagtagccagcccggtgatacagggagaaatagccaaaagagctcctgccaaaacctacagtaatcagaaactttgactcaggaattctcccctttctagggatcaagctgatggaaatattcatatgcatgcagagaaatgcaggaatgaggacattttctgcggctttggttagaagtagaaaaacaaacactaacctaagtgtccattcatggtgagctggaccaataaatgatgggattatgtgatgttcacactgtggggttattaacagctattgaaagagctggattaaaacaccctgctttggaaccaggaccagctgtggtgtggaggaaacagcatattgcaaagtagtgtgtatggtatgatcctacttttgtaagacatcagaattaagtgggagtctgtaaattgttaattgtgtagaagtaggtctggaagtagatactgcaaaatgttagcagtcgctttttttagaggtgagatgtgggcagagaaaggaatactatctttccttaatactattaggcttaagttgtttgcaacgagcatacattatttttgtagctgaggaagagaacatagttctttgagctttgctgggaggcagtcagctctctggtctcagctatgacctgggacaactcatatctccatgaactttggtgttcttttcattaattcaccagggaggtgagggtagaaggagagcctggtgagcacctttcagctccaccatggtatgaatgtttgtctcctccaaaactcatgttgaaatttaattgccattataacagtattaagaggtgggacttctaaaaggtgattgggccatgagagctccgccatcatggatgggattaatgctggtataaaagagtctgtctggccctctctcagcctctctttgcccttctgttatgttatgacataacaagaaggccccttgttatgctggtaccttgctgttggacttcccagcctccaaaactgtgagccaataaatttctgttcaatgtaaattacccagtcttgggtattctgttatagcagcatgaaacaaactaagatgggctctaattctgatggtcagagcaagctccctggtaggttgaagggtggctctgactgggactccccattgggaagcaaatcaccctacagccttgtcctctgggaagtcctgacctcaaggagcactgcccagaggagtggctagagggtcactctggagaagcatgtgagcacttttcttttttctttttttttttttaactgaagttttagggtacatgtgcacagtgctggtttgttacatatgtgtacatgtgccatgttggtgtgctgcacccattaactcgtcatttacattaggcatatcttctaatgctatccctcccccaccccccaccccacaacaggccccggtgtgtgatggtcctgttcctgtgtccatgtgttctcattgtttcatactgattgtatttctatttatttttgcaaacaggtggtatactcagtatacattgctcaaaggagccccagtgctactggtttcttatctgtcccattggggctgttttatgcttatacaagcgaagatacattaatatatgttaagcttttccatcttggagattaggtatcagggagaagactgatgtgagatctgcctcctcttctttgtccctttcctgtctccccactcacctaggaatagaagggaggattctgacgactagtcttagagccaggcacctctcttcactctagagagggcagctcttcctgggatcaaagtgccatgtgtggtcttcttggagtggggctatcaggaacagctgggaacaaatgaggggccttggaagcatcaaccaggtctcatctgttgatggacatatgggttgtttttagttattacaaataaatctgtgatcagcatttgtgtacaagtctttgtgtggacatatgctttcacttatcttggataaatagctagaagtggaatggctgagtcatgtggtaggtttttaactttttaataaccggaaaaatgtgaagtgatcctgccatttagagtggtcctctgatatattctcaccatcaaggtattagagtttcagttcctccacatcctctccaatacttgatgtggtcagtctttttaatttcatgtaaagaactctgtgcagatccagttggccaagggctgggctatgcctatatgcagaattccacagacttagcagagagttagaatttaatttttaattctagtgggtgtgttgtggtgtcttattatggttttaatttgcattttttctaataattaatgatgttgagcattttttcatatacttatcaccatatctttgttgggaaaatatctattaaaatcttcccatttttcaaaattaggtcaattgatttttatgtttgagagtttcattggtctgtgtgtctgtttttatgctgctttagttattataccaaaatattgtttggtaccatgctgttttggttactatagctttgtagtatatctatttattttattttatttttttagagacagggtctcactctgttgtccaggctggagtgcagtggtataaccacagctcactgaagccttgacctcttgggctcaagtgatcctcaaacattggctttctgagtagccgagactatagacatgtaccaccacacccagttaatttttgtattttttttttgtagagacgaggtctcactatgttttccagggtgctcttgaactcttgagctcaagcatttctcccaccttggcctctcaaagtgttgggattacaggtgtgagcccctgcacccagcctatagtagtatatcttgaagtcaggtagtgttgtgcctccagcttcgttcttgctcaagattgctgtaaatattcagtgtcttttgtggctccataccaattttagattcattgttttcctatttttatgaataatgtcattggtattttgataaagattgcattgaatctgtgtatcactttggataatatgggcattttagcaatgtttattcttcccagccatggacaaaggatattttttcatttatttgtgtcatcttcaatttctttcaatgattcataattttcagaatacagatctttcatctccttggttatatttattcccattttacttttttgtagctattgtgaatgggattattttcttgatttctttttcagatagtttgctattgctgtacagaaacagtagggatttttgtatgttgatttttgtatcctgcaactttatggaatttgtttattttaacagttttttggtgaggtctttagggttttctatatagaagttcatgtcatctgcagacaggaacaatttagcttttcctttctaatttggatgccttttttttttctgtagcctaattgctctggctaggacttctagtattttgttgaatgaaagtagtaaaagtgggcatccttagctgggcatggtggctcatgcctgtaatcccagcactttgggagggtgagacaggtggattacttgaggataaagagttcaagaccagcctggccaacacaaagaaacctcatttctactaaaaatacaaaaaattagccaggtgtgctggtgcatacctgtaatcccagctactcgggaggctgaggcaggaggatcacttgaacctgggaggccgaggttgcagtgagccaagattgtgccactgcactccagcctgggcaacagaacaagactccatctcaaaaaaaaaaaaaaaaaaaagagtggtcatccttgtcttgtttcagatcctggaggaaagactttcaattttcctccttcaaaatgatgttaactatggatttgtcatatatggcctttattatattgagttacaattcttctaaactgacttcattaagaggttttattatgaagtgatgttgaattttgtcaaatgctttttctgcatctatgatttaacatattaatttttacatattgaaccatgcttgcatccctgggataaattccacctgatcatgttgaaggatctttttaaatgtgttgttgaatctagtttgctattattttgttgaggatttttatatctatgttcatcagggatgctggcctatagttttctttttttgtgtccttatctggtcttagtaacaggtaatgctggccttgtagaatagtttggaaatactccttccttttcaatattttagaatagtttaggaagaactgatattagttccttaaatgtttggtggaattcagaagtgaagcagtcaagtcctggactttcctttgatgggagattttttagtactgactcaatctccttactcattattggtctgttctgattttctatttcttcataagtaaatcttggtaggctgtacgtgtccaggaaatgatccatttcttctaggttatccaattgttcgtactgtgcattgtgcaggtaattgttcataatagtgtcttatgattccttctgtggtatctaatgttccatttttcatctctgattttccttcatttcttagtctaaagatttgtcagctttgtcttttcaaaaaaacctcatttgttaatcttttgtattttctagtctttattttatttctgctctaacctttatttttttttccttctactaattttgggttgagtttggtcttttcctggtttcttgaggtatagtgttaggttgtttatttcacatcttattttttgatgtaggcaattgttgttgcatgcttccttgttacaactgcttttgctgtatctcatagggtttggtatgtttttacttttgtttgtctaaagatactttctaatttcccttttaattttgttgttgactccttggttattcaggagcatgatgttttatttcctcatatttgaaaagtttctgaagttcctcctgttactaatttctggctttatacctttgtagtcaaagaagatacttgatatgatttttatcttcttaaatttgttaagatttgttttctggcctaatatattatctaggagaatgttccatgtgcaattgagaagaatgtgtattctgcagctgctggatagaatgttctgtaaatgtacattatgtctgttttgtctaaagtacactttaaatccaatatttctctgttcattttttgactggatgatctgtccattgctgaagtaaggtgttgatatcacctgctattattgtgttgcaatttatgtcttcatttagatctaataatatgtgctttatatatttaggtacaaatttgtatgcatatatatttacaatggtaacatcctcttgttgaattgatttcatcattgtataatgaccttttacagtttttgacttaaactctaatttatcagatataagcatagctactcctgcttttctttgggtttcaatttgcatggagtatttttgtccttcccttcactttcagtctgtgtgtgtccttagaggtgaagtgaatctcttataggcagcatacaattaggtcttgtttttaaaaatctatttagccactctctattttagctggagactttattcatttatattcaaagttagtattgatgggtaaatactcctgccattttgttagttgttttctggttattttatagatcttttgatcctcttttcctctgttgttgtttacctttgtggtttgatggttttctgtagtgcaaagctttgattctttccttgttctcatttgtgtatctgctgtaatttttttgttaccatggggcttatataaaaaattataaagttataatacactattttaagtagaaaacaatgtaactctggtcacatacaaatactctagacttttaccttaccccactcccacagtttttaattatgctgccttaatttacatctttttaattttgtatgtttcttaacaacttattgtagctatagttatttttgaccattttgattttttaatcttcatactagagatttgaaagatttacctacaccattatcataatgtagattctgaagttgattatgaatttgcgtctaccagtgagttttatactttcacatgttttcatgatagtaattattgtcctttcacttctggttgaagtactctcttgagcatttcttgtaaaggcaatctagtggtaatgaatttcctcagcttattcttgcctgggaaagattgtatttcctccatttctcaaggatagctttgctggatataatattcttggttagtagagatttttttccccctctcttatcatcccattctctccaggcctgacaggtttctgctgagaagtttgctcatagactaatggggattcccctatatgtgactttgttatttttatttccttctgcttttagaatcttttcttgttttcaccttttggtggtttgattatgatgtatctgagagaggacttctttgagttaaagttatttggggatgtttgagtttcatggatctggatgtccatctctctgccaacacatgggaatttttcacctgtagttttgttaaataagttttctgtgtttttatctgtcttctttgaaaatttcataatgcaaacatttgtttacttaatggtgtctcataagtcccataggttttcttcattttttaatcctttgctctctctcttttcccctctggatgggttattttgagttcagaagttcattttgcttgatctagtctgttgttgaagctctcaatttaaaaaaattatttattgaattcttcagctacaagatttctgtttgttcctttttaaatgatgactctttgttgactttcttattcagatcataaattgttttcctgatttcattgaattttctactgtattctcttgtatcttgctaaggtttcttaaggtcattattttgaatttcttctcatgcgattcataaagttttatttctttagggtcagttactggagaattattgtggttttttttttggcagcatcatgtttccttgctttcttgtttcttgtgtccatgcattggtatctgcacatattgtggtacaatcacctcttctaattttacagattggcatattttgggaaaaacttttacctatagatgggacctagggtgtcagtagggtagagtacattgccctttgttccaggtgggtgcagtaatatagtctctgtgcaggtttttcagctgtaatcaatgtcagcaatgcctgtgagtacctctgttgcctagtctgcagaagtctgtggcaatagtggtagcaagctatagtgttagtttcctcattggctgccaaatactttttctatgtacattgaggtaattgtgtgctttccttttttcagtttgtgaattttggtaaattacactgttgctttttgagcgataaactaatcttgccttcctgaaataaaaactccacttggtcatggtgtatcacaatttttataaattgttgggtttgatttgcttttttttttagagttttacatcagtgtttttcaggaatattggtctttcattttcttttcttggaatattttctagttttactttgtcagagtaaattctggcttcacagaattatttgtagtctctcctgtcttagtttattcatgctgctataacaaaataccacagacaaggtggtaataaataacacaaatttatttttcccagttctggaggctaggagttcaagaagctggcaagttcaatgtctggtgagaacccattcttcataggtggcaccatctaggtgtccttacatgacaagagatggaaggacaaaaagatgtgaactattgtgaagcccttttttaagggccttaaatccattcattatggaggagccctcaagccattcatgatggaggagacctcctgaccctaatcacttgcaaaagtccctgtctgttaacactattacattggagattaagtttcaacatgaattttggaagggacacaaacattcaaaccataaaaacttcctttcacttttttgaaataatttacataaaattagtattattctctaaatgttttgtagaactcatcagtgcatgtgtctgagactgcagtgtgtatgtgcatgaagatttttaattagaaattctatttttaataaatataggtccattctggttacatatttcttcttaagtgaggtttggtagtttgtgttttttcaaggaagttgttcattttatatcaattgtcaaatttattagcatgaagtgattcactatattttttatatcttcttaacatctgtagaattagatgatgtcagtgtcacctctccagtttctgatataggtaatttgtgtgttcccttaccatctctttttccttcttcttcctgatgaattattttctttattattttttaaatttcattggtttctgctttgatccttattatctttttcttctactcttgtggtttattttgttcttctttgtctaggttcctaagatggaacctgatatcatcgatttgagacctttcttcttttttaatattggcatttaatgttataaatttccctgttaccattattttgatatattgtattttcatttgtttcaaaacactttcaaatttcccttttgatttcttattggagccatgaattattcaggaatttaatttagtttccaaatatgtgggtttttttagaggtatttttttttgttattgattgccaatttatttccactctggtcagagaacatacttggtatgactgagtcctttggcatttattgaagcttatttctggtccaaatatgtccaatcttggtaaatgttttgtgtgtacttgaaaagaatgcgtgctcttctgttgtttggtatagtgctttataagtgttagatcaaattggtcgataatgtcattcatgtcttcagtagccttacaagttttctatttattctatgaattatttagagaggggttttgaaatctccaagaaatgatgtgtggatttctttatttctttcctcaattctgtcactttttgctttaggtattttaaagctcacataggtttgtcaatatttagtatcattgtgctctcctgatgaaggtatctctttaccattataagatgacccttttcaaagaacctgatgaggtttcttgctctgaattctaccttgcttgacattaatgtgcccatttcagctctgtttgattagtgtcagaatggtacatcttttttaagattttatttttaatctatttgtaactttatatatagttttgttgttctttataggttctttatatataagacttgttggcagcacatagttttgtctcatgttttaatccattctgaaaatttttgccattaattagggtattctgaccatttgcacttaatgattattttattaggtttaactctaccgtctggcaatttattttctatttgttccatctagttttttccatcttttctatctttctgctttcttttggattgagtgattcttttattccactttatctcctctgttggcttattagctatatacctctttgactatttccatagttataatggttgctttagtggttatagcatacctctcttatcttatcactgcctacctcaagcaatagtatgctaattcacttttagtctcatgacctcaccagagtatacttctgttctcctttcccaacatttgttctattgttgttgtccattccactcatgttataaacctcatactactttatttttagtatcaaagtcagttttcttttaaagataaataataagaaaacaattatatatttacacttgtggttaccatttctattactcttctttccttggtatagattcaggtttctattggctatcatcttccttttgcctaaaggatttcctttgtcatttcttataatgcaggtctgctggtgatgaaatcttccagcttttttatgtccaagaaggtacttattttgtctttattttgaaagatagtttttccaagtatggaattccgagttgtctggggttttttttctttcattactttgtaattgttgctccactgtcttgtcatccacattgtttctcttgagacatctgctgtcattctctttgttactctatacagtgaatacagataatgtctttttatttctgtacacttttaatattttctcatggttatagattttgattaccatggcccagacacagttttctttatgtttcatgcataaagttcactgagccttttcctgcttctttgcaggcatggtaattttttattggatgacacatgtgaattttaccttcttgggtgttggatgttttttgtattcctataaatactcttgagttttgttctgggaagcagttaagttacttgaaaatagtctaattcatgccaggttttgctttaacatttgttagatagaaccagagcagtgctcaattattgagttagctcaacagctaactcccattccagaggcagaaccccgtgtactctattcaatgtctgtacaccatgaagttttctgtctggctgatgggaaccggccctccgtctagtgccatgtgtgcaccgggcactgctatctcatcatttcagaggattctttcctcagagtcacatattaatccactgagggttcaagggaccctctgcagatctttggatcttcttactatgcaactctctcctctccaggtctctttcacgctaactctggctgccctgatccccttggcctctcaggttcatattctcaactctgggagttttccaggctcttcctggattccccctccctggattgtggcctggcaactctctagaggcagtagctggccagtcatgggcctactccatttgattctcatttttcaagaatcactgtcttctgttgctgatttctagcacgttgaaaactacggttttatacattttgactttgtgtttgaggtttgagtgaggaagacaattcagtccatgtttgtccaccttggtcagaagcagaagttaatgtcatagctttttactttgaagactcagacaagttttcacaacacattccttctagagaataaagttaggctctgctattgggtgtccccagatgggaaccccacttatttttaggcttcagctcagacgctacttccttcagaagtccctttctggcacactaccttcctcatgtggcttatttgttcctcttgcaccagatcactccgcagcttttgagtttgtatatggcaacaatgaacaaggtataatcctcgctgtagataaactcatcatatttgtttttctccatggagtgaaaatgttttaagctcatataatgactatggtcagggaaaaagccacacaaataattaggatatgttgtgacagtgcacaaatagaaacacacataatgtgcttgagaacatgataaatgccggttttacctttccttccctcacctgaccaagcttagcgagacgtgtggcatcttcctcatctttgctcttcagtgccaggtatggaataggtccattatggacaggtgccttattgaactgagcagagccacgaatgtcaggctgggagtgtggtcgctggagtcaggccttggtttacatcctggttctgcttcttaaccactctgtgcttcgacaggagagcaggaggtcctacttagttttggacgtgctaagtttgggatgcctgctagagatctgggggaagcatggtgaagaaagctgaatgtgcaagcctggagttcaggagggaggtggtgtctggagatggaaatctcgagccagtagcagttggttcttagtgtcatgggacacaggaggtcatataggaagcaaatgtggacagagagtgaaggggtttgaggattgggtcctgggcacatccacctctggaggtaggggagatgatgaagagccagcaaagtaaactgagacataatcattgaggcaggaggatagcaggctagggcagagacctgcaaggagagagaagagagcctttcacaaagaagggagtgaccgatggtgtccatgcttctgtgtgcttgagtacagagtctgggattctcctgagcatcctttgctccactgggatggaagatgggacctgatgagaccggggctaggggaatgtcctgagccccacacgtttgtgtctgtgtgcagggagcgtggaaggcagttcctgcttggtgaggtggagctgagagcggtgccacttagcagctatctgtgccactctggtatccggagagaaggagccggcatttgcccatccttcctcctaagccctgtcagttgtgattggaacgatgcccccgcccaccacatttgctggagttggactagagctggtaatatcagggttttactttttagtttaatttcttgcacaatgcatggatgtttattgagttttgccaataaagagttccatagggtattactgagcaggactggtctgaagataaatgaaagttgtgtacttggaaagacaatgctgtattattttcaaacccccttgagaaaaaggccttttgcactgggtgagctctggatcaggtccaatacagacagccttgcaaaagtggtgtttcagggaacacaagatgggtcaaatgatgacagtttggggggaatgagtctttgaagagctctagccctgttcttttccctcggtggctgccaggcagctggtcttcactacaaatgcagactgtcacatgtcaagactactgcagagttgaagaatggggcacaggactggaaaaggtgaaacattcttctcaaaattccaccaatttttctggaataaacattccttgttttgctgtaaacatgtggttaatttcaagaattgtgaaaaaattgactgcaatctttttttgccagttttctctttgcttttacaaaggagagattttttttttgtcattttctgtgatgttacctaacaatgttctttctaagcaatgacttctttttttataaggaaactatataaaaaataaaatacagtaaccaaaattaagtaaaatgatcaattcttggcttttatttgccaatttattttaatatatatttacaaaattggacacatacacatatatattttggcatataatatgcatactttctgtcatttgctttccttagcaatatatagtgactatcttttgtcattccgtaacatatacgccaccatttttaataggtacacaatattcagatggaacagatgcatcgtaatttaacaggcatcctctgactggatgtttacgttgtgttcaatttcttacttttatgaaaaagtccgggatgaacatcctttcatgtactttttatgtgtttgtcccaatcattttaggagacagactcctagaagtgggatttccagatcaaaggttaggatgagaaagtaagcgtgtttgggggcatttggggagggtgatgtctgtcacacaatctagactgaaagctctccgtccgtccctgcacctgtttctcagcttctacctcctgctcagtgctaggcagcctgctctgggaaggcatgctcatttagattaattcaatcagtgggtagaagggtcactcaaatccatgaaaagtcctcattttaagctatgtcttttggaaatttcctcttttggcttttaagtagcaaaacctggtaaccttctgataccttggtgaagatcagtcagatctgtaagtttttgttgtggtcctactgtgtatccttgctgtgttcatagaggccggattaataagtaaatgagaatgacttgctcctagcacagatttcacacagagtgagttttcatttatgtctagaaatctgcaaagaagggaactttttctcggttaagagcaaatacgattgaaagtatgtgatgataagcctgagacatttgcaatgggcttaaggacttggttcatcaaaagctgaaaagattaaaccacgttcagtatagttttatgtttaagcataccatagttctctgaaaatggcagttccttttcctgtattagtcccttagcattatgaaggaatctgtcccgagacctttgagacttcctgcattcatgaatgtcaccgtcgcattcagtctctctcataacatgcagtaaaggccaactgaaaaatgcctgcaactcctccaggctcctgaggagactataaatacaagactgcagtcatttataaagctattaaaacaaagtggggcctgagcccttgctgaaatgattttcagagttgttttctctctaaaacacatggcaaacaatcgcatgttagaaattcaagacttggctgagttccactttttgtatcttactttatcccaaacttctgtgaaacgaccatgttgttcaactgactttcttgctttctattcccgcctccacactaggagttgacttccttttaggtaccatgtttcttaagaaataaaacctgccttcatctatggaagtgatcatattggataacaacttgagcccccaggaattaaatcccggcccaaaaaaactgcaaaaccacagactgcaaaactgcaacctacatcgcatgtagatactctggagttacttgcaggcagcagcatctgcagtggcagggcaggtggggactgtgctgttcggaaagctgaattaactagcacccacatttcctagtgcactaaggaatgacactctgcctgcgaaagagctaaaccccatctctgctcctaagtaaatataaacattccattccctaataccttcctctcatgctgttaacttcactcagctgattccagacacacatagaacacaagggctggcctagcagacctggagtcagcccaccgttaagttcacgcaacagtattcaccaatgatctgccatctccacaccctgctaggacatgggcgggtgggggaaaggctgtcacttaaagtctctgcaggagacagatggtaaacaaactgaaaagatatcagttggttggggggaattaagataagtggagtggtggtgattgaaggctcagagggtttctgaggacctgggtccaaccctggatggtcctggcaaggctgtgcggtaggcagaggaaggagatgacatggagaccctagcgtgggatatctagaaactgaaggaagagccatgtggctggggggacagtgggcagggagaaagtgcagggaccatgtggagctgggtgggggcagtggccaccatggggaaagtcactgtgtcatttttggtccaaactcagacgtttttgaaagaaaaatgtaggtgctattagtaatcatctgggacagcaggtgtcagccgggactgtacctggaaacccatgagtagggggcttagcggacagagatggtgacatcaccttacccctgtgttgcccactgttccactggaaagtgccgcaagctggcgagcgtgtgtcctctcagttctagccaccatcaccctggtctggagtccttcctctggcaggtgggcggctccattgacaagccagccctccgctaagacctgtctcctttgttcccttctctcctcttgccctggatggggcttttaggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaagtaagtggcagcttgcgggcacagccgggcctgtgctctggccttgcaggcggagcccctctgagatcccacatcctgggtgtgccaggccgggacgcacaacccaccgtctgcagcaggtctcttgaccccgccaccgttgacgtttggggccgtgtggaggccctttcctgtgggggctgtcccgtgcatgctcagatgtttagcggcattctcggcctctacacactacacctcccgtgacaatcaaaactgtccctggacatcatcaaatgcctcctggagggtgaattgctccactggcctgtagcagccaggcaaggactgggccaaactgatgaggacatggcttgtcagtgttagagacaggggcagtctctgttcacctctatctgatcattttcctgcaagaaggtggatccagtgttgccagatcttctaaatttgtcaagtaaagctacccccccacccacatacacacagttatgcagtcacgtgtcacttaatgacaggatacattctgagaaatgcgtcattaggagattttgttgttgtgggaacatcacagagcgcactacacaaacccagagggcgcggtctgcagcacgcctggctccacgctgtagctgatggctccgaggctacaaacccgtacagcacatgactctaccatatactgtaggcaattctagcacgttatggtatagaaacatttctcaacatagaaaaggtacagtaaaaatatgacatacaaaatacaaaatgtcacctctgtatagagcacttaccatgaatggagcttgcaggcctggaagttgctctgggtgagtcccgagtgagcagtgagtgaacgggaaggctagcacgcgaccgtgcacctccgcagacttcagaatcactgcacacttaggctacgctaaatttacataaactttttttttctttaatagtaactttttactggataaactttaactttcggactcttataataacacttagcacaaaacacaaattatacagctgtataaaagtaatttctctttacccttattctacaagctttttatatttttcaattttttaactttttaaatgttttattaaaaattaaaacacaaatgccgcattagcctaggcctgcacagggtcagaaccatcaatcactgtcatcttcctcctccacagcttgtcccactggaagatcttcaggggcagtaacatgcgtagagctgtcatctcctatgagaacagtgccttctggattccttctgagggacctgctggaggctgctttacagttaacttttttttaataagtaggagtacactctaaaataatcattaaaattatagtgactacatacagcagtaacatagtcctttcatatcatgatcacgtgtgatgtactgcacggttacacgcactagactttgagaggccttggcagcacagtaggttttttcacaccagcatcgccacacacgttaggaacgccttacaccacgatgtcatatgacagcaacaatgtcacgaggcataaggaattttacagctccattttcatcttctgggacaactatcttatatgtgtcgtatatgtcgtgtatcattgaaatgtcatgaggtgcatgtctgtgcatatatacacatacaggtatatccacatacgcatcattttctggacaatatgtgcaccaagtccacccatctgccgtctggctgtgacccagagccacgggtgggcaccttctgtgttgcacccccataagtttccctgggtggtccctgctgtctgctgggctggagttggactgtctcatggggcaggacagagtggagctgctgcgtcttgctggttgaggtctgaagggatccagtcatgcccctgagacagaatgggggccttcttttggaaggcaaggctaccatgagccgggtggagctgacttgtgtggctttccaggatcgggcacctccctagttgctttccacattccagagccactggagttcagaacccctcggagcttgctgcgtaccccagtttgcgcccacggacactgcccaaaggtgccaagagccactgagcaggcatcggtgggctttcagaggaaagtcatgccattctggcagggtgggcctctgtttcccctttcaccaggccagatggcaggctaacgtgtctcgtgtgcggtaggagaggaaattctgataaagctcaggtgcaccgtcccaggagccacagtccacatctcctgcccaccctgtgaggtgtgagtcagtctgtgtagggctgggcttggtagacagtgccctggacagcccctagtccgctccttccctctttaaacctcaaaagccaacccttccctggagggagagacagtgccccaggggtgaggggaaccagctcccggagcgccagtgcctctgttggtttgctctgcacccttgctgtccccaggcccctgagtcactggagaccctgggaaaatgcaggttctgatgctgcaggtgcagggaggcctgagaatctgcatttctagcaagcttctagggctgccgacactgctcgctgctgggctgcaggccacactttgagaagcgagggtctacagcagggtccccagccagggaaccattgatgtttgggcccagatcgttctccgtggaggggccgtcccgtgtgtgtagtgtgttagcagcattcctcccgccttccactagatactagtagtacaccctccgcttctgaccaccaaacgtgtcccagacaccgcccaacgtcccctgaggtcagagacaacagaacgctccccgggtgagaatccatgatctgaatgttggactcccgctctgggcagattttcctctgagcagtggggcttttcatttcgaggaagggttgtttctggtctccgctggggagcttgagccccagtgttcccaactcccaccaaaatccttacttgagtgttttcacggtggagggccgtgaacgtaagcaggtgaggccggcccggggtggggctgtggatagagcacgaggtcctacccttccaggtgttacagagttgtgcttggggcgcaggtgcaggttgcatttctaccagcggttgggacagccctgccgctcggcctctgcatcgtggtgtcgtcatcccaggctttcatttctgcaagtctcagtgatgggacgtgtgttcctaaggcttggtttcctgtttctctgatttctggtgaggttgagcattattttcagcgtttatcagctttttggtttcttctttatgtactttgcctgaagttttctttatcttaatgatttttaggagtttacttttgaagatgtagcttctaatccttccccattttgagttacatgattcttctctctggggcttgtattttcagttttaaaatacttttctttgaggcacaaaagttttgatttttaaggctgtcagattgctgatcataaacttgaggagctcacagcctttttctgtgaggaccaagttgtcagtactttgaggtttgtgagccaggctgtccccgccacccctactcagttcaggcgctgtagtgatgaagtagctgtagacaatctgaggatgaaggggcatggctgtgtgtcaataaaactttatttacaaaaatagccagcggtccattgggtccagctggcactttgctgacccctgatgtgctttatggttcgcactatttgtaccgtgtttaaaaatcctccccagcctagaggtcatcagaattttattcacttctgttatttgcggttgcctttacctgtaccagttaataatggttttctatttgatagtcaaaccaagttctttcaaattaaaatactaagtgaattgatctaaacaacaaaaaaaaaggtaagtaatggaagatagtacatgtggttcaaaaaacaacaaaaattatggtggggcttggaatgagagatgcctggggtccccaccgccgactgtgaaggttgagaggaagttgggagaaggttgggctgccggggataccccaaacgcccccctatgtaagaagtaccaaaaacatgggccctgtggcttgtttttactccattacttactgaatctggaactaattttaaaccttggactggaatgtagtagctccctgctatttgtcaccatgtttaaaaacctggaattagacacagagaaaacagcagcggagtagcagcatcccaggaggtcagacatggcttcctggaggcgccatttgttttccctacagcagtggcttaattggtctccctttgtctctgctctgcctcctttcagagattcctccaccgtctcttgctaagtaattcagcctctggttgccatggcaacgtgccatctactgtatcccaaagaacatttgcgatttcctttttttaatttccagaaccttcatattttatcttctgagtgttcctgggccttttcctggtgaagcagtcactgctccccacggctaccccagaacacatccgtgtgcttggtctgggacccccaggaaagtcagggtcccatttgaaagagtgaagctctatgctgattttcacccctctctgtgtaggagctcagcttacctttaaaacctgtgtggatgcatcagcagagtatgagaggcccgcagctcctgcacggtaggtgtgcactggaaattatgcacagaggcacgggctgttttgcctccatcctgtctacagccaccatctaaggagagcagtgggaagcacctgctgccggctttcagcataggtgccggcgatgtgcttgacgtctgccttactttctttcatttatctagtcttcacagtaacccagtaaagcaggtggtactatcatctccattttacagatgagaaaattaagccttggtgagaaggtaactggcccagggccacgtagcttgcagaagctgccgtgcagtgagataggccatttgttagagccctagccctgggcctgggagaagcattctagacacgaaagcactgtggctccttgtttatcttaggcatggctttgaattttcttatattggtttggctttgatcagggtatcagctggcaactgggcaatgcaccaggtgtctcgggcaaaggacttcacacttgctctaaagcagtgcagaatgttggccgggtccggtggctcatgcctgtaatcccagcactttgggaggctgaggcaggcagatcacttgaggtcaggagttcgagaccagcctggccaatatggtgaaacctcgtctctactgaaaatacaaaaattagccaggcgtggtggcaggtgcctgtagtccaagctactcaggaggctgaggcaggagaatcgcttgaacctgggaggcagagtttgcagtgagccaagatcatgctattgtactccagcctgggcaacagggcaaagacaggggggttgggggtggtggcagtgcagactgtcaacacagcatggagcagtggggggttggacatcctcagggggaacatatagaaagagacactgcccagcaagggctctggaacagtgcagcaagcaggctagagccccagccgtctttgtctcagctgcgtgagataggccagcaccagtgtctcagaatctctctccttgtttgtgaaatggggatggtggcaatacctgcctcagggccctctggaagattccacattggtccctgaagaaagtcataaaagcacattctcagcagggggtgctggggccagagctgctgctgtcacagtcaaggctggatgcactcctgggcgagctgtcacctgcacggggcagaggccagcagcaggccttgtggcaggatgaaatgaatgctgctgcatgaacagcggtcacgatgctagtgggccagggagtgcaggagcattgctgttgatggggcttgagtgtcattcccattcgtgactgttgtgtaattttgcccgaagagagaggaatagggtaggcacctcctaagtcatgcacaaactgtcattccccttggggcgttctttgctcccaggaacgtgtgtgagaagctgattaatgctcagtagcatctttcaggagggggcacttagcatgttcatacagcagttagcggatctctgagtggcttctctgcacgttttgtcctgtggcctccagaacacgctgcaccctcaggtgtcctcccgggctgtggcctcccactcctgctctgtctgcaggagcaggacacagcgtgcagcgagtttagacgctccctcctctagatgtgctttaggcaaggcaggcctatttttggtcctggagacagaacgcacagaaatgtggagacagacagtgtccccgcagaggctgtggtttgggctgcaaggcggaaaccgtgcctggccagccaggggaccagcctgtctcaatggggccttcgttctgctgtgagcttttacctgaaactgcatggacggaaattttcacttccacagaaatggtgtttggtaaatttcagacacgtggaagcgggggaggaatcagcttccaatgccagccttcataatgacaccactaatagcatctgagagggtctgccgtgacgctgggcaggtgcagtgctgattgcctgtgatgccgagcagggaccatcatccctgctctgcagatgaggagactgggcagagaggctaagcagtgtccctgggtctcacagttcatgaatggccaggctgtgggctccagggccctcgctcccagccactgagccttgctgcctgaggccaagcatccggctcacaccttgtggacagggccgggaagctgatgatacactatagctaaaggccagtttccggtgaatgtttgtgttaatgaggtggttatggtccacgttcactgggctgagtcctttgcccgctgatgtctgcaaccctgaagttctgtgctcggtatggtgtgggtgctgcacacaggctccttcatggatcttactaccttccccaagaccctcactgaggagcgaacacacctgacatgggtcactcccggagcagggctgagctgccgcaagcgctgacggtttctcttgtcacagttatcattgccgccctgaaaaggctgcaaagtttgccttctgcctcagggttaatccatggctgctgggatggaaggtagcatttgaaattacctacagggggaggctgcacctgcagaacgggcccagttgatcctgtcacatccaatgtcattgcccatctcttggggtgcttaccccccaattacagagatttcgaattcatgtagcgtgcacgtgctaggcgctggggtgcagagatgaaaagatgcactcacaggtgataaattattgtgtctggtgaaagatgtacagagatagatgtgtggaccagcttcaggagggagggtgagggtgtcccaggcagaccagccagtgagagctcgaaggtgggaagcagcaccgccttcccaggactaccctgggggctgagaaggttcagggctgggtgagggtggcagggcagagggagaagactggaggggccatgggtccaggtggtggaggctcctgtgctgcccgctatgggttcccaatccacacagacctcctcttgtcattctgggctcagctcagatgtcaccttcctgaccatctcccagtggcacagcctcgccattaccctgtgtcacatcgtcccctgctgtgtttttagccacttccacagctgctgaaagtgccgtttactcatctgttctgttcgcctcttcagggtgtgcccactggcgtggcggggccctgctctgctcttctgtgagggccttgcccaccaaggaggcgctggctaagctggtgggaaatggcagatgaggaggcctggctctcccgagaagcagccagggctccctgggggtcaggagcgagggcatgtctgggaaacgcccctctgctgcagtgcagggctggtttgggagagcaaggctagagctgggtggggagacaagggtttctcacatgctacaggcccaggagccagcaccatcctggggacgcggggctgcagagaggacggcagagctggtgaggatgaacggcaggcctgtggctgagggaggagggcctgccagcctaggggtgggtggatctgcaatggtggagagggaatccaggaagaaggcaggcagacacaggggaaaggttatatgtccaaagggtccctatgccgtcaggtgcctggggtttttggcagtgcttccatccacttgtgcaggtgagactgcccaaggagcacagggactggaacgggagactgcccggtccatgctggacttgctgatctcagctgaggtcgagggtattcagagcccgtcgtggtgttttatacggtcctgtacttcctgttatccttggtccattttcttctacactatcttccctccagtttcacacacttggacagaagggagtggttgtttttcactgaccgccaggaaccacaacaggcttctgtgtgttccagtgaaataagccctatctgtctctcgggaatggagcagtgttaagctttttttaaaagcacaatctgaagacactggggtctggaaacccattttttcttgttctgaagcctgtggggcctccgcggttgggccttgctgaataatttggggttttaggttgggtacatcaagggtaaagggcttctgtttggatcaaacaggaggtggggggagggtgagattccctcatattgctgagaagggagttgggggctgagttccccgacttcagaggtgagacatctcacaagccagaccttgggactgtccctgtggacccaggctggactgggaagttcagggaaccctcgactcgaagagggttcttgttaatgaacagtcttcaaggagcaaagcccagactgttctcccagtgtggtgtacacatgaggagggacctcatcggggggaatttggcttcctgatattcaaaagcacatttgtctgctcagtctctgaaattgccagtgggacaatttccaaagggatcaccagaaagaaggtaaatgcagagacgaacaaggaactcatcatacccaggatcgttcttgatcaaaatgccaacagctgggcatcttcagccaaaagaaatgcagttgtggcaggaaagactcagctgtacttggggttctggtttttttttttttgtttttttttttgagatggactctcactctgtctccaggctggagtgcagtggcgtgatctcggctcactgtaacctctgccttctgggttcaagcgattctcctgcctcagcctcccaattagctgggattacaggtgtgcaccaccatgcccagctaacttttgtatttttagtagaaacagtgtttcaccatgttggccaggatggtcttgatctcttgacctcatgatccgcctgccttggcctcccaaagtgctgggattgcaggcgtaagccaccacgcctggcttgggtttcctgttttatagtgaaccccaaggttgcaaaacaggcgatgaggcttgtgatcatttatctttatggatcatgggtctgcgaactggatgagagttttaagcatgtcaggtgtgcaaacatctcctatggttgtgggaatttctccttgcatagccaccattgtctagagcagcagtccccatccatttttgtaccaggaaccagtttcatggaagacagtttttccatggaccagggaggaggatggttttgggatgattcaagcacattacctttattgtacagtttatctctattattattacattgtaatatataatgaagttattatacaactcactgtaatatagaatcagtgggagccctgagcttgttttcctgcaactagatggtcccatctggaggtgatgggaaacagggatggatcatcaggcattagattctcataagaagtgtgcaacccagatccctcatatgcgtagttcacaatctgctgagaatcgaatgctgctgctgatctgacaggaggtggagctaaggcagtaatgcttgctcgccactactcacctcctgctgtgtggccaggttcctaataggctaggttgccccagatgggtactggggttgggacccctgttctagagcagtctgcacgctggggactctgggtccatgacagtatttccttcctgtgtgataggcctcacagcctccactttgcatgtgaggaaatggaggctcagaattgttagtagccagtgagtagctgagtgaggacatgaacctgagtctttccagctcaaagtccttttccttagcctatttcacaactccctggaactcatccatggccatcctctggttcaaattatcctccacctaggcagtagactttcctttaaggaaggaagaaacttcttcaatgttttatcctcagtgcctggtacacagtaggctcccagctaattactgttgaatggatggttggttagatggatagatggatgattgtatgattggataggtgggtggttgggtagttagatggatggccatctggatggtgggatgattgaacaggttaatggctgctggggtaattgcattataagatgcatgagtataggtagatggagagacagctggatgaataggtagatgggtggataagtggtgggatgttgtgtagttagatggatgaggaggtgaatggagacattgttgaactaaatggcatcctattcactgtgcttgatgtaccctaatatctgtccatccatccatgcaactgtctcagcacgcacagtgggttagatggaatttcctaagagtttatttcaataaaataagagtttagttcagtacaataagtgtttattgaatgaatatctctctttgcatagtgggctctttggatacatttaagcaatgattccatttactacattgattataaccaacctattcagaagtgtatttgtgaatagtgtgagccctcaggacctcagtggccattgccaattttggagactggttctgtgctgtctccaggccagggtctgcatacgcttctggcgacaccactgccgtctggctgctgaccagcctgggctatttctgagctgcaggtccttaggccctcaggtgaggatactccagaagcctccacttcaccctcactggaaggaagtctctggtggaaacaagctactcctaaagctttctgagcacttgtcaggaggaataggagagaaagctttatcggaatgagtaagaccaatagtattaacccatgactcgccacaggaggcgggtgggggatggtgtcttcacagctcattcaacagagtagaagtcacagacccaaatgctccataagtgacctgggccaggcagggctgtggcatcctggggagtgtgcactcttgctcaagagggcagctgtcactcagatcctgtgggccatcacccctggccacatgtcaggccattgtggccagaatttccaagagaaaccgaagatttgatttttttggtgaaatagccttcatgtaaatgttgagagcctcttcctatttttaaaagcaatgtgtgcacccagaaaacatatttgtggaccagatttggcccgggaccacccactggccacctctgatgtgaagtcacttatgcacttgtattgggagaagtacatgtttctttacactgaggttaaggggattttcaactcttgagttagcagggaaaataaatgggtcatcctgtaaagtgactgtcagcagcggaagcctccagggctaccactgtcagtatcctagggagcctcagcgaacctgtctccttcctcgcatatgtgagggggcccttgtgtgcggccctctcagctccacccttgctctaaggaagccgcacagtgcaccgctgagaagtcaggatggacagaatgcctcggttcccagccagctctgcagttttccagcatgtgggcatggggaagtcacctcctgacatgcgccttactttcctcctctgtaaaagggatgtgactacaacagagcctgtcttttggggccacgggaaggatgcaatgagccgtcacacgtagaatgcctggaatcatgcctggcagagaggaagctctccaggaagaaaaggaagaaatctgagttccatgaggatagggaatttgtctctttcagttttaacagctttgttgagacataattcacacaccacatgcttcacgcactttaagtgtccaattcagggcttccaacatactcatagagttgtatttccatcagcacaatcgattttaagatattttcctcactccaaaaagaagcctctccctctcagctgtatctccagtccctagaatggtactgagtcctgtgggtactcggtgattttgcagctactgctgcagggacgaaggggaaactgcatgggaaggcatctcctaaacatgaccagttattggtgtcaccattccctttgcttcaccaacttgatcttcttcagatccttttcttctgcttcggcatcttttcattgtcatcattttatcttcatcactatcatcaccttcactgcttgtttatcatcatctttgtcattttcatctttttcttcctcattatctttccatcatctttagcaacaactttgtcaacatttttatcctcatcatcattttcatcatttccataatcacgaatttgccccatctttgctccctaggagacactcggggaacttgggctctcaatccccttgacgtctgggggcttggcctatgaagggaatgaagcccacatctaaagcaggttccggagcctctgctgagtctgatcgtgcctggagtgaagaggactcttgagaatggtgggggctgggcgcagtggctcattcccgcaatcccagaactttgggaagccgaggcaggagaatcgcttgagtccaggatcacttgctgtgttgcccaggctggtcaccagacctgggtgcccacaggcagataagaggaaggtgcctgagtcaccaactgcccacgggactgaggcacctccctcttatcttcctgctattttccagatcagcctgggcaacacagccagactccatctctacaaaaaatagaaatttaaaaacagctaggcatggtggtgcacacctgtgatctcagctacttgggaggctcaggagggagagaggatggcttgagcctaggagttagaggctgcagtgaactatgatggtgccattgcactccagcccgggcaacagattgagaccctgtcgttaaaaaaaaaaaaaaaaagaaaacaaaatggtgggaaggtgagtctgagccgggaccctgcagatcccacaggtccagctcaggttgccacccccgtgtgtggcctggttgggccggtgctgtcccagtactggccacccgtcaactgaggcacctggttgggccagtgctgtcccagtactggccacccgtcaactgaggcacctgattgggccggtgctgtcccggtactggccacccgtcagctgaggcacctggctgggccggtgctgtcccggtactggccacccatcaactgaggcacctggttgggccggtgctgtaccggtactggccacacgtcagctgaggcatgcagggctctgccatctatagccttctttggattccgagatcccaagaacagaagctgttggcatttagcaatttatgattttcttcctttttttgatgctgcagatttatccgactgactttcccagccctccagggggaccgttgctggggcttccggtctctctttgtttagaaatctcagggcaagtggagatcaggtctgttctgcacagatgcaccttcctgagctcttggcgtggcaccacctcctgcttcaccactgtggtgaggggtctgcctgtgaacactgcagagcctccaaggtcaagaagaccaccaagatttatgagggcactttcaaggatttgttgcaaaaatgcgaaggagctcacgaggcagtgctgtgagcaggctctgtgtggtattgtgggcagaaatcaacctcagccctaaagggaggggcctggtagtcctgcaaaggccggggcaggcaaggccagcacggatcaggcaaaatggtggctatcatgtatggatcttgtacgttctgcttttagatggaggtagctaagcaacagaacacacagcttccaaattgggacaagtttaaactggcaaatctcagccccagaggatataaatatgacgcttcatcgtcttgggtggaagtccccgtgtacagggagggaaagcccatctgtgtgtggcatgcagggtacagggagtgggtcccgagtcccatcctgtgcaggggagaggctcaggccccttctgtgcagtgtcaatatgaagtggccctgtccctgctgagggctccagggagggtcagctgctgtttgttttccttggttgcttgggaatctgtagaggatggtacagcatgttttgtaagaaaatgcaaaacaacatcaacccccattcagtgtcaataaaacatgattcccaaaccagggagcaggtggtttggtggacttggaggctgcctggctgagagccatgggctgagtgagcccagggaagtcacatggtgagtccaagccttgaaatgggtgtgtgatgtctgcctgctcagatgcttgcagggactaaataccacacagtcctgcttcacccaggatcggggcttagcgtgtgtgagtagtagtcatggtaataagagcacaaccatagctcactaacatgtatgaaacccatgttatgtatgaggggtggtgtttgcctgcattcatataaacataagacgtaaatgctattattggatgttcttagcagctaaggaaatggaggcccagagagattgggtaagatgctcaaagtcacacagctagtaagctagtggagctgagatgtgacccaggtgggccgactccagaccgcacgttagagccaccccactccctggaatagttgcacaggcggtcaggactggcatggttgttccaaaatcaacaaggacgcagactcctcttaccttcctgctatttacccttatgccggtgttgatcctccatggtccagggtggctgcaaaggcaccagacatcatattcaagtcccaaaggggcatacatctcagctgagtcagcttttccagagggctcctcccagaagctcctccacacacatctacctactgctccttggttggaccctcctcatgtggccgtggtcagctggaaaagagactgctctgaataggaccagcattcaggcataagaaggggagaagggagatggggtaggaaactcgcggcttctgctgctttaggtgttcaagttaattttgttacattaaaggaagaaaagaagcaacaaatgaagagatggatgagtgaatggaaagcattctgtctgttaggtagcaatgatttctaagtgatttctggagcagcctggtttgaggagtgcatgtggatccctatgggcttggagagcaccgccggggaatttaaaaatgccccattcctgaccctcccacactgggccagggaggtgagcagctggcaggaagttgaggaggaggagggaaagaggaaccctgagaggcgctgagagtgatgtggacaaacacagctaccccctccccagcaatcctaccctttctgcagcgatcccaccccttccccagcaatcccaccccttccccagcgatcccaccccttccccagcgatcccaccccttccccagcgatccgccccgcaacgatcccaccccttctccagcgatcccaccccctccgcagcgatcccaccccctccgcagcgatcccaccccctccgcagcgatcccaccccttccgcagcgatcccaccccctccgcagccatcccaccccctccgcagccatcccaccccctcccctgccatcccaccccctccccacagtgatcccaccccctccgcagtgatcccaccccctccccaatattttagttcagcaacagatgtttcctgaacagcctctgtgtgccactctccgcactgggcctaggatggggggaagaacaaagcagatgcgggggctgccttccgaagcttccattccaccagcaggcgtgggggaggggaggtcaggtgaacatgtgtgtggcacatgtggaatatgtggctatggctagacacgggaagggctgcagtgcagagtgaccgtgttccactcaggtggcttccagcatcccctcctgggctggtgggcgctggtgcacctcagtgccattgctgatgaaggtctgggtccggtggaaatggtgtggtctgcagatgaggtgcgcctgtcttttcttaaatcaaggacactttcagatggatttggtttctctctgactcggctcgttcagtcagcctgacgggcacctaccgtgtggctcgggccccgtgctgggcaagaccctgcctccagctcccagcctcactaggagtgggggatgggagtcacaggatgtgcccagtggaacagccgccagggcaggtgaatcctggagagcggcgggctgttcaggtctgggaccctgggaagccacagggaggagtgcatgggagtgaccctggaagcccagagatggagatggggaggggaagggctggcaggggccctgcccgagcaaaagatcagaggcagacaatgctcagcgtccaaggaggaaagcggaaggagctggagggcaaggcaggccctggtacctggcaggtgctccattggtgcctgtggaatggaccccaaaggatcttagccctgggagcaggcagtggggagcattacgtattctttccattttcaaaatttgaagaagggacttatatacatggtaaaaaataaaacggtacttctcactcccacctcatccatctgtccggagtcagccactgtccacggggccatttgtgatcattcagaagtgggtctttataggagtcctaacgcccagaacagtaatctgcagatattacctcccatgtgctgtgcccagctcggggtgagctggaacctgcggtagatccttcgctcggcatcagtctctggagggaggtaaagacctgtcctcagtgctcagccccaggtgactactcaaaaagccatttgaaagaagagatcataagcatgatttgttcatgctttaaacacaattttaaaccatacagatgtcacttgtttggccgtcactttgaggtagaatccaaggacatttctttgaggaaggatctaccaacttaagttatttttgctctaaacaaaggctggatgtgtctcctccaagttccactgacagtttctttggagaggagtgagtatttaaaggcacttggaagcaatctcagtgcagaatccttccagagttttaaggccccacctccccagatctcacttctctctcccacgcaaactgcacagtggtatttttagcaacttgcctctactgactccaaagcttagttttcatggaatttacattttcattttacacccatatgagatcatttaatcaatgtgcattaaaagcttaattacatttattacagagacaagtacacctggtacaaataggtttgggaacagaagcaaccagttcctgatccatgcacagctcagctggtgtggccaggcagttctgaaatcaacagggaggccacgaagtcagcacgggatgcccagcatggctggagccactgaaggatttctgcttcaagaagcctcaaccggtatctaaggccttcccactgatcagatcaggcccacccatttcagccaggacactctccttgacttaaagtcagctgatcacggcccttggtcacatctaccagacgccgtcacagcagcacctagaggagtgtttggttgagtaactggggactgggaccccaccccccataccattcaggttgacacatcaaattgaccctcacagattcaaggttggcagaaagctcatgagcagatgtaagattgcactcagtctctcactcacagcctctctcctcaggtgatttgtagagaagccactattcaagcaaagggcaagttcaaagcttagactcttaatgatgatgtggttttgcagtttctatattcacgtttattcccttttatcttccccagagtctggctgggagagccttccacataagggctaatggagcagcacccggttcctttctgtaatggcattgaattccactgcagggttgaacacaggtcctttaggcccaatgggcattaaggctctgccctgtgcttggctataatgaacatcctcatacgtgtgtctgtaagaggcccatgtggaaggatgttcacacacatcagaaatcttggaactggaactggcaggttagagaatatatgcatctgtcatttttgacctgagcattgaccaccagggaatgcccctgattgacagccccaccagtgggggggcggggggaggggctctgtctacactcctgtcaacattgtggattttccaactttctgccctctgctgatctggaggtggcacagtgacgtgctgtttggcacaaccacacactccatgtggttgttatttccatggaggtctgtgaatgacgatgaactttggacttgccccacaacagcagcccagttctactagtaaggcagagctgtgtcccacaagcccagaaccatgccccctgcagcggggcccctgtattgccagtggcttctctgttcattttgctgtgccagcttgagaggctgtgcaggggctggggattcagcagtgaccaggtagacaaagtctctgcccttggaggggtcctgagtccctaactggccagcttggtgccttgtcctgggttggcacacatactgccttttgtactctggtggcagctgtgcaagcgtgggactgtggtgtctctttcacaggcttggagggtggcttgcccaaggttgccttgttgctgtcaaaaccagcctttgggctcaagtttctcaatgtaaacctggcgttgccttgatgtcccattcatgtatccactcatgcattcagacactcattcattcattcagtcacttgttcattcattcactcgttcattcactcattcactcattcattcattcagtcactcattcattggtcacttatcacggaccaggcttggttccagggccctgagtacacagcattgggtactactgatgcagttcttaccattgaggtactcaaaacataaataatcaattctggccatgaaggccacaaaatacacaaatgcactggggagcaacctgtgcagaaaggagccagttacttcagctggaggagtcggggtgggctttctggaagaagaggtttaagctgaaccatggggagatctgggtaacaactttctcagcagagggaagggcccaggcagaggcgctgggtgggaatcagcttggcatgtgctgtggtctgaatgtttgtgtcctccccaaattcatgtgtcacccccagtatgatggtggttgtacatggggcctttgggaggtgattaggtcatgagggtgcagtgctcttgagcgggattagcgccctcaaaaaagggacccctgagggctgcattgctccctccaccatgtgaggacacagtgagaagatgctgtctctgggaaagtgggtcctccccggatgccgaatctgctggcacctcaaccttggacttcccagactccagaacagggagaaatggatttttgttgtttataagacactgagcttaggggactgtgttgtagcagccgcgctgggcaagggcagctcagcaggtcagcatgaccaaaggaggacaaggtatggggaggagggagatcagtggggtgggggaggggaggggtgctcaggggcttcgaggaggctggagctctgctcctcagcaggttgtctccctccaggaattccctgccacaggctcgggcctctgggtcctggtggctgagcacagatcttcgctgagtgtccctggtctgggccaatgtggggccagcatcttggttcttcccagctgactcaacctgggcttggctcacccttggctgggacccaaggaggccaggcagggtggtggggcccagtggggtgtggggcacattccttccagtgcgctcccctgccccagccttacacctggcattacagggcacatgctgtcctcaccctgcctctcacacctgctgtctctgcacacaccctcctggccctgcctctcacacctgctctctctgtacacactgtcctcactctgcctctcatacccactctcccacacactctgtccctgccctgtctctcatgcctgctctgcacacacagtcctggccctgcctgttacgcctgctgtctctgcttccctctctcacgtccttccctgcagggtgcgtctctccctcctctttgcacacatgttcttggcctttcttcctcactccactttcctcctttcaaaagtagcattggcagggctgggtgtcactgtgaatgacattctctgcgttaccttgactgtgagaacagaaagtgcctctctacaggtagatgcgagtttggtcctgaaagtcaagggcctggttttcctccggaggatttgaatccttccctctccctgctcccctcccttctctccttccctccctccttccctcccatagttctcaggcaccaggtgattcctcagtacctctgagagtccccagatggaaggtgacctggatgtcccttggtgtccatgttgctgtctttagcacctggaagaggaggtagaaggggcatgttcacggtggggttggggaagcctctcagggcagcccgggaaccatccggagagactggtgctggtgaccagctggccttcatgggcgggggtgcacgtgatcttggtgcctcacctgagcccttggaacacccggctccaggaggctgattggaggcgagacccctccccaccaccactggggctgttcctggtgcagagggtgaaggactcatctcatctgtatcccaggggcactaacccaaccctgggcagggcagtctagagtccctttttggcttagggtgggccacagagccaggctgacaaaacagaaatagcaacagtgatggagacagtgcggtgtgcagcttgcggagcccagggcacagcggcctggctagccccctcacatacggctctctcctttcagtctcaccaggtgagaccatggaggtgcagagaggagactggctgcacccaggaggtggaggacaagagacactggagagtctgggaggccaactccacgtacctggagttcttttctgtgctgccctgggagggagcccaggctccaggggacatatttctcctgcagggtggggttgggaggacagagtaggcaggagcctttggcctgaaggcttgtcactgtgggcacaagaggcatgggacaccttcccgacatcagaagccccccactgcaccaagcttggcggggcttcctggtggagttgaagttgccctgcctcctatgccctcaggacacaggaggcaggccagccgttctgttgccttttggaaactcagggcagctctgtggattgtcacagcaactggagctcctgctgtattttcaggatggtcccgggaggcaggtgttctgcagccatggggcactcccttagcaatgaagactggccccccattccacttgacttctgaatgtccctgggacactcatgagagtccgaagcctgtttatgatgacctgagcctcatcccaagtgcattgtggacacacacaggaggtattttggtggagctgtattacaggtggcgtctcctggaatgcaaaatgccagaaacctctcccacagattggggagggaaccttgctttgtccagagcttcaccaagaagcattcctccactagtgtctctcagggcatggagtgaccagtgtggcagctgtgggtctgtctgcattggtggctggcactgtgatggtgatttttctgtagcggcagcattggcattgtgtgctgtgtcacccaatccagccatgcctggcacttacttacctatcggaatatgtgttatttgattaaaacttaatttcctttttcctcctttatattgcagatagggtgttatgttgtttttttggttatgcgtgtcagggatttggaggaaaagggacaagacagaacaattgtaataatgggggtgtgtggggtacagtggggctgcggacccgtgtgaggagaaggacatctttgccggacagggacagtgtgaacagccacttattggtaaatgcagctcgacgtggggccatcacccggcatggagttttgggaggggtgggagtaggaggggctgctggaggggtcaccgtaaactgaaaggctttgctgagggccttggagtttgtcctgaggatggtgggaacccgggcttgagctcatcgtgggagtaggagttagagttatgctgctgtgggcagggaggtggacagtgtggaagtctccatcatccagggctgaggcttgtggcctggatcagggaagtggccttggggatggagagaggcagatggatggatggacggatggatggatgcaagcagaacccagcagacttggagcttcctggggtgttggacgtagggagtaagaggagccagttctcccaggggtctggtgtgtgcctgggtggtggctggagccagcccctgagcccaggatgctgggcacggagcaggtgtgaggaggtggggaacagggtgtgaaaaggtcggctttggactcagagtgcctggagtcacatcctccccggcatcccagaagtcaggactgctggctgctgagatggggcttgccccaggcatgtggaccagcagccagcacctctcagctgagccctcagtcggcagaacatccctgcttgctgtttcctagtgtggacacactccatcccctctgcctggatgcccatcccaggtctttccctgggcggtttctttcatcatccaggcctcatcttatggcctggagagtcctcttctcttcctgaacttctctccagacacacccacattgctctgacgctctgagacatagggtcaatgtgcctgtcatccgtgcacccagatggtgtgcgcctgggggcaagcagacgagacatctgccccattcaccatcagatgtctgaggatgcatcaatgcgtcgtgtgaatggtgtgtggagacgctgcctcgctggggaatcccatctccaggcgggggccgccagcttttctcagtgactcaaggcggctgtggggcaggattggcattcccagaaaggagcctcccaaaatagcccgggcgtcccctgtgggtgtcgagctgtctgttctctctaggaaggcattctgccttgtatggaaggaattgcttctcaatttctgctccacactgaggtgactttagatgttgattcaaaccttttctgtgacatctgtgctggggtgagatcaagatttgggggatgtgcgtttagtggggcagcctggctgggtggggcttcattggggaagcaaagcttggggagctggaactatgcttctcctgaccccgtgtccttccacttcctgaaattacctgcagcccctgctgctgtgctcatcatgcaggaaggcagtcagctgagcagtgtgtgcagaggacgattcagaaactggtacaaacttggcactgagacggcgtctgatgggagaagagggggtgtctgatgaaagaggctatgacagacaggagcatgtgcgtgtctggtggaagagggtgtgcgtgtctgatggaagagggtatgagtgtctgatagaagagggcgtgagtgtctgatggaagagggtatgagtgtctgatagaagagggtatgagtgtctgatggaagcaagtgagtgatggacagtgtgagtagatgatgaaagaaggtgtgagtatttgatggaggagggtgtgtctgatggagacggtgtgaatgtctgatggagagagcatgagtgatgaagagggtgtgagtgtctgatggaggaatgtgtgggcatctgatggaggaagatgtgaacatctgatggaggtgtgaatgagcagatgttgaaagagggtgtgagcatccgtctgatggaggaggctgtgagtgtctgaaggaggagtgattcttggggatccaggcctgcaaggaggcgctgggcaggatggagcctgcagctctgctggctgaaggtggaagagacctgggctcagcacgccaggtgaataatatcagtgctatagtagtaatgatgccacctatttgtgtgtcaacctcctcctgtatttagtgttctcgactctcccagcatccctgtgggttttgttggcaggtgttcacctggggaatcagaggctcaagtaagggagggcgtgacgccatcacccagctggcaggggtcagagctggaactggaatcctagctctgtgccagtgctggggcaccagtgctgactgtggaatagacagttgacagcctccacagacctggaaatgtgggtggcacagtggcatcatgactcctggagcctctccaggcgtcctgactgtccaggctgtcggcggtctcatcagctccacctctaggccccttcctccccattgtttgtcccctgctccctgtctcctctgtgctactcacagcacagggccaggtgtgtcgtaggtgactgctacagatctgtcgtgtgagaggcactcggaaccaggaagtgcctgtggggtcacctgtttggctggtgcccccttggcccccagaaatgactcacatccacacttgaacatacagacatccttttccagggtgtgttgtgctcgatacctttaattcctgtctgcattccagggcctgcccagcctcttcctggctccccagcccagcctggtccttccggcctccctgtcatccccacctctcgtgtgtgcacaagcagggaccaggtagggagaccggcagatgctgctctctgtccctggggtttcttttcttagtgttgctcccacacccacgcgatgctttaattaactgccacactcaggctttctcagtggggagagtcagaaatagactgtggcttccccagctccaggcggcaccaggacgtcaccagcagccccatttctgaatcaggagtctcaagcagctgcagagggtggggaggtttggggaatcccacaggggttctacacccccacctaccccgccccacccctctgcagggccttctgcagcttccaaagcccagctatgctccggccacgtctctagcggctcctcggagagcaacttgatactgaagctcaaagcccaggaagccctggcggcatccctgccccagccaggtccaagcaggctatgtagtgagggagaggaaccggcgcccattcctttgctcctcgacacaggctgctccccttgcctgcgccggctctgggggtctgctctcacagagcttcatgactcgttcaacctgactgcccttttcctggccatggttctgcctagaaaatttcctgggccaccctggcctgagtggcgactgtgtgtcagggcaggggtcagcacactgtggggcaggggtggtggcctgtgatgcatgcctctgcctgggcctgactctctgtgctgggagaatgcttcctgggcctcatcccagctgtgtccctgctggctagttcctgccagctggtgttgccggtgttcctccctgcctcagccctcccagcatctggaactggctgtgggttctgattccagctgtagtagctgctgatcacattcctctctctgagcctcaagggtctcgcctgtaatgttggcaaagtaattgtctgtccttggcatcaggctcgtcaccatttttccttttggaagccccaactctgcatgaagagttagcatagcttcaggtagcaggtggacaaaagggtatcttttatgtatacttagggtaacaagtattaatttggagtgtggggtgtttttgctctgtggccaacttcttccccaagtcttgaacacttcagggggccctcacaggcctgcagcacactttgtccttggtatctggtgggggtctgggcaggtccgtatctcttggtagtgggttcatctccatctctgttggacagaaatctggaagagtccggagagtgtttgcaaatgcaaatctagtcctggcacgcccacaccccatctcacccaggtctgctttaaatccttcagtgccgctctggggttccaggagtgaatccagactctctctccagcgatgccaggctgtgtgggtcctgcccctgctcagcctcggtgcacacacacctccatgcgatctaaacgaccccacctcaggacctttgcacatgtcctctcctcacctagcgatccccaatcatcctctggatcccaactaaagtgtcaccttctgggaagccattcatgtgcagattagagcctagtctgaacggtggcctggccttgttgggttggcagaaccaccctaagaccctgcttagcaccctcacctggcagtcaggggtcttcttgctcacctcaatcccctccactggtgagaaccacagggagggtcttggggcccacagcactgtctagggttctgcatccacccttccaggtgtggggtcctggcactctgtaagtagagaggcaggttggtgacaagccagtggggtcctggcctgagcacccttttgctctgtttacaaccctgtgcctccggggctgtgtctacccagaggactgcatattctagaccattcaggggtaccctgttgacattcagtgagaagcttggcagctagatgaagccctgcagtgagcgattggaccactaccagactgcctctgtgccttgggaccaattgcacagtttttgctggcttgatgtccacgctttcctgaggtgtaccagttggatgaaatgcttttctgggaacatggtccgcgatcagctggcaagtcacaggttgggttttcttgagaaattactatatcccaagcatgcattgtcacaaacatttttgtgcattatctcatttaatgctcattaagagggtctggtactaattctcattttggatgagaaagacaaggttccaacaaagggcggggggaagccttgttcgggggccatgccagtggacactagcctccagggacatttggggtacttctcagatttgaggaaatgcacagcctcactcctcaggtgtccctatgggtgttcctggctgggcagctggctcaagaattgtcttgagccacacacaaaatacaaatggctggggccagcatcgcggacagtgaaagagtttaccaaggcagttataggtaaagaaaggcaaatttattagagaaagtatgaagatccgttgcaagggtgcaatgggcagcacagtagagaaggggctgctggaaagaggcaggcgctggagggaagttttatagggttgtgccagaggggcttatgtgcagataagatagtactgctgggtcttcgagtggaacaaggtgtttggaaataggatgtcatgccagtgggttgtctgtgattagctggctctcagaacaattcttctcccccacctaggaccccttcctcattgttgcttacttattaggactccacgttttacttcccaagatcccattcctatacacagcctctccctcttagccagaggagctgtgcaaaggaagtaccttttcatgggtaaaagactcatggtgcgctcactcttgctgggcttcagggatttttcatttctattgctctaaaagtgcctgtgtgccttccccctccatcccatctccttcctgcttccgagcccttctgtgggcagcatgggggccaggaatctggcttgttcctgcttttcctatggtggtctgccccaccattattcacacacagaggctgttgggttctcttaccattccctgtttacagagactcagatacattcagaagcgagctaatgctgggtgcccagctctaaggggagaccccagacaactccaatttcctgatgatttctcttcctttacctaattccttctccaagacccttgcagacactgctgtaccaagtggattctgtgtaactctctcagaagtttcctcttccatgaagcctgccttgattacccacccccatcctcactccctcagtgtttaagcccagtgtgtgaacagttaagagacgctatggtcttcccacactggtttcttctcttcatttgggtctcagcgaaatgtatctctgccagattctgaatgtatctgcccctgcccaaccactcacccaccatatccgccatttcctccacggcattgaccactctctcagatgattttgttcatttgtctgcctttacctctagaccaggggcatccaatctttcagcttccctgggccacactggaagaattgtcttgagccgcatacataaaatacactaacgataggtgattagctaaaaataattgcaaaaaaaccctcataatttgtgttttcagaaagtttatgaatttgtgttgggcctccttcaaagctgtcctgagctgcatgcagcctgcaggccacgggttagacaagcttgctctagactatgagcttcccaagggcagggaagacttcccatactcagcactctgttctgggggcttggaacagtgcctggcacatagcaaatatgtcatagtcatctcctgagtgcttgaatgagtggcctttggggtgttttgactagactgcaaaagcaacacttaagtgagctaggctttgcatacattgtttgggactggggaggattccagccaggaattgtcagggggggaggttcaagtctcactgaacatcgagatatgatgtggaagcaaccacccacagagccagaagacaaagcccccaggggagcagaaccacaaagggttgtgttctagtggggagggaggagtggctgagccccgcaatgccctaggctttctgctgggacaaggattataaataggagataaataatttttaaatggaggcaacatcctcactggggcaaaatattatggccctaaattctaggcattcaaatactgggccctgttgtctccctgctgtggttagaggatctggaagtgggaaggtttctggctctggcccaaggacaatattattgtagtcataaaaataatcagagcttggcattaattttggatgatgatgcctccttctcctgacaagccctttatgttttttggtggtgactgttggctgcatcctccaacttcctcaatgagagaccacttgaaaaagaaataataatttgtcttcatatcgcacactccgtctgggctgatggtgggaggggaatgcgtgtgggtgggctcagctctgttagctgcgctggctggaagagattcccagtttttattcagcgctcgagctgggctgcatgcttgctgacaagaggcgggaggccccttagacgtctttagacactccccctgtgctgggctgggcacaggcggctctactcagcagttcagcaggcagaaagccggaaggagagatcagtgctcccaaggctggtgtctcccgtgctgacaacggaggcagtgctgggaagcatgaatctcccagcatctctggatccagaagcctgaaaacaggtggtgctacccacccctccctaagccaatgggcaggaaaaagaatttcctgaacagatctcctcgctgcttaaacacactgctccggtgaacagtccagaccaggcaaggtttgggcgacagatcagaaaaatgaagacctgcacatgtggagctggagcaaggactagtctagtattagctctgtgacgggagagctttgactgtcacctggaagtctgacttgattttgccagcaagaggcaacaaccaaaggttcactttctctccttccaattttgggaggcgatctataggggtttgccagccacctctcatccttgcagaccccaggtggaatttgcaggcagccactatggtgcaaaatgtaattttagtgtttttccgcagacggctgagccaaagacctgccgtggaagagctggagagaagaaatatcttgaaacgtgagtagctggtgattcctctagaggttttccttcacgtgtggtgaggctgttgcacaaatcctgagttcccataacccagcccttctctgcaagcggaatgctccatgctcccagtaaacctgagctgctgctgaattctgaaagcaagccccaaaggaaagctgatatacctagaaacattttttttaatttaaaaaaactcctttcctcttagcataaagatgtttttattttcagggttagtcccatatgtctaagtgcgttaggtttcaagcaggtcttcctggcagtttgggtcggggttcttcatggctatagaaatcacaaagcatgaaccgcatgaacacactagagaaggacacgccccttgcctgttacacttgggaggaataaagcagtcagctcagggaaacggtgaagccatgagaagctttcctgtggctcaggactttgaggttccaggaccctctgttgctcccagccttgcaaccccttgcatttcccgttaggtggacaattatagcatatgctgagcataggtgttcatgagtaacctccatgctctagggcactatattccattaaatattccataaagtcagtgatttaggggtggccaaacctcttgaaaaagtgtttctccaatagttctttatctagtcattttcagtttttaaaacattttccacagaaagtgtcttctaatggcttggatttttaaaggactttttttctctttatgtgatgaatactgcagactttctctgagtttgttttcttatttgtgaacatctttttatgaagttataatggtaccaagctgactttctgtcagaaaataccgcagagccccttgttggtctgggtactgaacttgaattgattcctccctcctttctttgcctcagtgccttcattaactgcctaaaacaatcccctcctttatagattgttgaaaataaccctcagataaagacttcttcattttactttttaaacttaagatatagtgactactgttctatgttaactataccatctctgaggatttaaagaaaagctcttcattgataacatgcttaattaagtaggcagacagaaaagtcaagctgtttcagttgccaaatatttgaatttttaaaaattaagtcacttatttataaagcttgtaagttgcagatgctactaaaagtagcagtccagacttgaaccaggcaagttcaagacacaggaagcaccacattccaagtagcctgctgtcagcaacaggaagagagtactacagcccagacctttaacccaggaaccatgtcttctttcagtagcagcctcttccttcctatcgtgggcaaccaggtcttcccatcagcaagtacttctaattgtgttaatctttggaaataaatatcagagccttagaaatagaactatctttggtgaatagggagctagcaaatgcataactgaaactgactgcccttaccttcagtgcatgaaagggaaaatgggtttcctctgcggtggccatggcaatcccgccataaacactgtgccttcatcagtgaatgtaggtttgtccttagctcggaagccctctctagtgtcctgagtggaaggacctgagaattttactgctaggtttgtggtgggtgtttggttttacttttgttctgtggagatgagaatagggtaactatatatagcctagtatgaaacatcatactcataggctctagatacacaggacttcaagcactcatactgtattgtattttcttcttgtaaccaattcttagaatatcacttttgtatttgcttcaagggggaactcatgactaactgcagtcatatctgaggagcactcaaaactccgcccatataacactataacgtggatagaaaagcagaagagcaggggtccctttatatggtgatggtaattctttattaggcccaatctgtgccagggactatattcagtacttggtatatattccctcatttaatcattgcaacatatttgtgaggtttgcactttttaataaatgaatattgggaaaaggatagcactagagttcaaccccaggtctgcctaactccattgcccatcttcttaactactgcatcagaagcagtaatacatttctggatattcatggaagtctcaggtataactgtccaagctgctggagctatttccagaaaatatgagtatagcagtcctgattatgggtcccttgctttgtataatgcagagggtgttctgggtctggaaataagaaatccataaacatatcactaaggggagctcagaaggggaggtctgtgggcttaggctaacagggaggacttcttggaggaggtctccaacagagcgcctggcacaaagcagcactctgacaggaactttcaaagatcagttctccaaagaccctgctggtgaccttcgtagtaattatggcatttttcaggattaaaaaaaaaaaaaagatctgactttgtttcaatcttttcacatggaagctgcacttgggagctgcccatggcctattttaaagaaatctgaaacattttacgtcacgtaaatccctcatggcttgccttgtctggacactttcacaatgtctctctaattgtatcagctttctgatgataccttaaaagtatggtttcttctggtttctcacttgtataaagaattaagcagaaagaggatttcattaccttttctaaaacaccctaatccaagatgactcacttaaaaaaaattactggaaagcacaatatattaaactctcatataaccaatcccacaaatgtataaatatttgaaacgcatcttttacataaaggcagataatgtgaaattgtgttaattgcaagtggcaggatttcccttaccaaaacctaccagtgtttctaggagtgctgattgttgaaatctctttcctaggaatggagctatgttcaggtcagggacataaggctttatttagcaacagagaacaccagaaataggacagccattatcttgtatcccagggggaagcttacgttttatactatatctcagcactttcgtctatttttggcttccaagggtaggtgcgagcacagcttgaatgttaatagtcacaacttaccaagcaaagctaattttgctgagggacttgggctcctttaaaaggcactgtcatataacagtgttcacgcttcagcaatggagagtcagcgaggttcatagatgtgttaagatttgaaatatagtctgaacatataaattccaggcaagcatatgctgcccaggagctgaagaaggtgttccatgttttatgttggttaaaaagtctgtacgcttattaaggaaaaaaattagtggcagtgctatttatattgaaatgtacatatacatttatttacttagtctactacagctttttttatgtggcatctaagtgctagatgtaaatataaagatatttggggagaaagacagacacagaggtgtctacttccttaaacaaacagcagccatatctgtggttgtttctaatgcacagaagggctgaggagaccaggttgggatgacagcaaagctttgcttagtacaagtatttctgtgtaatgagaccatgatctcctgagcagtgactgacaaagtgggaagaaaacaccatgagtgatgtggaattaacttcagctcccagaaatatggatatcttgggaacacttccctgctgaagagaagaacgtttcaacctgtttctctttgttattttttttttcctattttaatctttcacagaaaggaatgatcagacagagcaggaagaaagaagagaaatcaagcaaagattgacaagaaaggtagtataagcattttattgcctgaataataaaaggtggtctagagaacagctgcttcggtagcaggtgggatgggtaatgctaggtatcactctgtgatcatgaataatgttctcctggacatcatggcatcagttaaatcaggatatttgctcagcaacaatgaattaactccctctgacgttccctatggacgaagtccttccctagcacggtagcacttggagaggtgcacaatgcacatgacattttttacttatgttcaggtggaagccagaagttgattggcattttcttaatttacagtgtctaggaaaagcatacctgggtatcagtgttttagtcacattttacactcatcgcttttgttcacctccaatatgtctagaagttcctcagttgcagaaagctttattagactcaaaggtttgttctctgtgactcaaacagttaacatttactatggccaatacaggtagcaactctataaatcttaatctacttttaaagccttgaccatttctaaattcaagtgttctggattccccttcttcgttgtgctgctccataataattctcttgaaattaacagaatatccttcctaagctggacatataataactttattagtacttttaaaaagcttatctaattgtatctgaagccagtgatgccataaaatctaagttaattcactaaccattccttgagctggtgctatgtactactgggggtgtgactccttctgataaaatatgttggaggaagggggattgtgatttaagagtacagtatataatttcagcccttcacattagagattgcttgtatttgggttatattttccagtttcaggttttttttgttttgttttgttttttaagagaagtgctgtttgttcagagtacttcaaaaaagctagtttggcatgtgatacttaactatgatgatctttaattttagcttaatcagagacccactgttgatgaattaagagacagaaaaattctgatacgattcagtgattacgtggaagtagcaaaagcgcaggactatgacaggagggcagacaaaccctggacgagactgtcagcagcagataaggtacctaactgcctgtgctggtggggggtgttggatgatataataaaggcaaaatatgtcatgccagggagtttattcatagacaatgggagccctcaactatttaagggtatactgcagtaaatattggtttctcaaagataattcagggtcagattgagaagtggttctcagctaggtgacagttttgccccgagggacatttggcaatgtctagagacatttttgattgtcacaactcgggatgctactggcatctcctggtagaggccagggacactgctcagcatctcacaatgcacataacagcccccacaacaaaggattatctagtaccaaatgtcaagactgtggaaattgagaaaccttggtataagggataaatcaaaggtgggcaaggctgccataagagatcaactgacaagtttaaacaaaaagagctacagtggggacaaagaggcattcaagaaagcctctacagtatagaaaaggttctagattctccccctggacttgtgcagtttgaggtatctctgagaacctcctaagaagtctgaactgaacagctagagaggcaggaagaacacaaggaggtagtaggtcatagagtctctgcatgacatttggtgagcacagagagggtcagttcttgtctgtgatcaaacacttgactggcaagatttaagcccaagagtgtccatagagttttgtcaccttcttgcttctattaattttcagaagacttaaagcctttaggaagagaaaaattatacattcaggcaaggaatttgctaattgttcttcattcttcatatgctgagtatgagtatgtacacagatattgcatcaacttggagaaatgtgaacgtgttggactaacttgcctggttctttgtgactgatgtgcccagaggatcacagtgatgcgaggagaagtatctttggtggtctgcagatgtgtttgagtatgagaataatatacccctaaagttcttaaagactttccttgtcccagaggctgtgtttgatgttttcagtctcatcaggtccctcgagtgtttatctgagaaagaagtacatgatgcaagtgggcctggggaagccaaaatattaatgtatgctgaagttagaaaggcttatttctagattatctctgattataaaattccaagttcaccaaaagctgaagtttactcattatcttggtgttcctgtttcattagtgccctaagcatgtgcttggtccgtttaggtatggagtgaacggagtttggggaagggttgtcttcccactacagttcagcaaattaatgaatggaacacttacataatactagtcctagccagagcaatcgagcaacagaaagaaagggcatccaaactggaaaagagaaagtcaagttatccctctttacagacaatatgatcttatacctagagaaacctaaagactccaccaaaaacttagatctgataaattcactaaagccataggatacacaaaatcacacaaaaattagtagcatttctataaactaataatggactagctaagaaagaaatcaagaaggcaatcttatttaaaataggtaccaaaaatacctgaaaatgaattgaaccaaggaggtgaaagacctctacaaggaaaactacaaaacaatgatgaaagaaattgaagaggccacacacaaatggaaagatatctcatgctcatggatagaaaggactaatactgctaaaatgaccataaaatgaccaatgcaatccctatcaaaataccaatgtcatttttcacaaaaatagtaaaagccatcctaaaattcatgtgaaacccaaaaagaacctgaatagccaaagtaatccttagcaaaaagaacaaagctggaggcatcacactaacttcaaaatgtattataaggttatactaccagcataatattggtataaaagacacatagaccaatggaaaagaatagaaaacccagaaaaaattcacttatttacagccaactgatttttgacaaaggtgccaagaacataaactggggaaaggacactcttcaataaatggtgctgggaaaattggatatccatatggcaaaagaatgaaactgtacccctatttcttactatatacaaaaatcaacttgaagaataaagacttaaatgtaagaccccaaactataaaaccactaaaagaaaacacagaagaaacagtccaggacattggtctaggcaaacattttatggctaagacctcaaaagcacagatagcaaccaaaataaacaaatgagactatattaaactacaaagcttctacacaacaaatcaacagagtaaagagacaacagggaatatgagaaaatattaatatctgcaaactattcatccaaaaagggactaatatccagaatatacaaggaactcaacagtcaaaaaacaaaacaaataatcccattagaaagtagacaaaagacatgagtagacatttctcaaaagatgacatacaaatcgccaacaggtatatggaaaaaatgctcaacatcattaatcaacagggaaatgcaaatcaaaaccacgatgagatatcatcttattccagttagaatagttattaaaaaaataaaaacatgctggaaaggattaggagaaaagtgaacttttatatactgttgatgggaatgtaaattaatgcagccattatggaaaacagtatggagactcctcaaaatattgtttaaaaactatatgatccagaaatgccacttctaggtatacacgcaaaggaaatcaaatcagtacattgaagagatatctgtactcccctgttcactgcagcattattaacaatagccaagatacaaaatcatccaagtgtccatcaatagattaatggataaagaaaatgtagtgcgtgtatatatgtatatgtgaatacagtgtgtatacacagccacacaaaatggaatattccaccttaagaaaatccagtcatttttgacaacatgtatggaactggatgttattatgttaaataagccaggcacagaaaaacaaatatcgcatgttctcactcatgtgggatcaaaaaagttgatgtcatggaggtagacagtagaatgatagataccaaaggctgggaagggtggcagggtttggggagagaaagagaggttggttaaccagtagtaacatacaattagaaggaataagttctaatgttctatagcagagtagggtcactacagttaacaactatgttgtgtatatttcaaaacagctagaagagaggacttaaaatgttcccaacacatagaaatgataaatactggaggtagacatcctaaatacttgatcatcacacagtctatgcatataacaaaatatcacatgtaccctgtatatatgtacaaatattatgtatcaataaaatttttacaaagacttccagaatattagctacatactagcttggtaggactataataatgagtatggcagttttaatgatgaaccaaaaaattgtttgtttttttctgtatattacataatagagtcaacaaggattaggaatggttaatttataaacacgatgctaatttcctgatttttttaatatcctgtaaaacaatgtcttgtttttaaatttcaggcagcaattcgtaaagaattaaatgagtacaaaagtaatgaaatggaggtacatgcatcaagcaagcacttgacaaggtcagatttgtttctgtgaatttcatggtacttatttttgaaacacacaccgccttcccccgtcccccgccacaaaccatgtatccagctatacaaattcagcatttttccagagaactctattgaacaaatagaatgtacctcaagtaagaatgctgcctgctcccattatttcctttaggacttggtgaaaggtgatatgtatggtaacaatatcggtttatttaagtagttaatgcatatttaacaaaaataagcctcaaggcaatgaaagtaatttttctgtgtatttaattcccctctaatattcagaattcctccaatttatagaactcacctgtttatacttacagatttttgtgaaattagtcactccccaccttcacatttactttttcctatcgtaaattattagtcacatctttaacacagccagcgttctcctaaagctgagtatttgtttcctcagtaaatatttgagtaagtgctgagaatgcaatagtgaatatgataaaggaggctcccatcttcatggagtttatgtcccattgggaatatattggctgattctcccataatcaagacttttcccattaagatgaatatattctctgtctatgctatgatatgcaagggatgacactgggcttcttagtgatgacgaagttgggaaaagatttaactctctttacttattgaactgcatattttttcagtatttccccccacttcttttccatggccatgaccggtagtaattatgtgaagttctcaaacatctctgattctaaagcagatgactgtgatgcaacaagccttcaactgtatcagttgctttgtcttctcctttatctgaagatgctcaaggcccacatacaaagagaaaggaaatcctgcatatagatactgccttaaactaaaataatagctttagttttctgtttgttccaaagtggccactgcaattgttatctgaaagatttactctgtaagattaatgtggctatagaacagaaactaagtacaatggaattccaccttaaccaatggttttagggtgaatatatcaaggggaagggaaagttggatgaataggaaaaaattatgcaaagagtttgttttttaaggttccctcccatgactaacatacttttggggaggaataggtcatatggaggaataggtcatatgaatgtttaggaaaaacagtttcagtaaatcatgcacaattacatttaatgttcattctgtcttaaatagaatgaatacatattctatatattgcaatctcaattttgtacattttccgattatacattattaaatgtttagtaaagatgtttattgtcctaagttgatagctttctaaaataatgactctaatacttaaaatgtggtataaagaccctaaaattatttcaacaattcaagagtcagaacggtatttttggttatgagattttaagagttttaaaattactatgaacatattactctacaaaaagtcataactctactataattttcaataatttattaacaaattcatcatttctactgatttagcaaagccctggcctttctgtgtacttcaagggcttttaactcacaggtttaaaactaagttctagatagtcctaagaattcagcatataacaggggcctgagagtggggagccctctgagactctaccctattttaaccagagtagctccatcctcatgttttacatatgggacttctgagaatctttttaatagcagcaaatttatttgtataaggtttttggctattttaactgctagaaatgaataaccttaaattctttgtcttttttataatctctagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 96 - DNA, 56614 bp, Homo sapiens
gctgaatgaagttttctgggtaatggcatgaaatgttttccttatgagaagtggtgttgagttacagcgtgcagacggagaacggggaggagagaaacggcagtctcaatctggcccccaccttttcttgggcttgtaggaaggtggacatgggctcccggagacaagacaagtgatatgttgaactgttcggtggctggaatcaactgctcctggagtgacctaaggccagtgtttatcagaacttagccagggccagccaagcaggcacagatgctctgctatgaaatgccacgcaggcagagactgacaagcggtaggaactgagctttccccttggactgctgcttcctgctgtgttcaggggagggggtcactttctggcaactctgctgctgctgctgctgctgctgctacttcagcttcctctccactcaaggtaagcaggctaagggagggcaggctgctagggaaagctttgtaccatgaacaggatccgaaagtttttccgaggaagtgggcgagtcttggcatttatctttgtagcttctgtcatctggctcctctttgacatggcagctctccgcctctcattcagtgagatcaacactcgggtcatcaaggaagacattgtgaggagggagcggataggattcagagttcagccagaccaaggaaaaattttttacagcagcataaaagagatgaaacctcccctaaggggacatgggaaaggggcatggggcaaagagaatgttagaaaaactgaggagagtgtgctcaaggttgaggtggacttggaccaaacccagagggaaagaaaaatgcagaatgccctgggaaggggcaaggttgtgccgttgtggcatcctgcacatctgcagaccctccctgtgactcctaacaagcagaagacagacgggagaggcaccaaacctgaagcctcctctcaccaggggacaccaaagcaaacgacagctcagggggctccaaagacctcattcatagcagcaaaaggaactcaggtagtcaaaatatcagtacacatgggacgtgtcagtttaaaacaggagccccggaagagtcatagtcccagcagtgacacatcaaaactagcagctgaaagggacttgaatgtgaccatcagtcttagtactgatagaccaaagcagcgatcacaggcagtagcaaacgagagggcacaccctgccagcacagcagtgccgaagtctggggaagccatggccttaaacaaaactaagactcagagcaaagaagtcaatgcaaataaacacaaagccaatacgagtcttccttttcctaagttcactgtcaattcaaatcgcttaaggaagcaatctattaatgagacacctttgggaagtttgtcaaaggatgatggagctagaggggctcatgggaagaaactcaatttctctgaaagccatcttgtgattataaccaaagaggaagagcaaaaggcagaccccaaagaggtctctaattctaaaaccaaaacaatatttcctaaagtattgggtaaaagccaaagtaaacacatttccaggaatagaagtgagatgtcttcctcttcacttgctccacatagagtgccactgtcccaaactaaccatgctttaactggagggctagagccagcaaaaatcaacataactgccaaagccccctctacagaatacaaccagagtcatataaaagcccttttacctgaagacagtggaacgcaccaggtgttaagaattgatgtgacactttctccaagggaccccaaagctccagggcagtttgggcgtcctgtagttgtcccccatggaaaggagaaggaggcagaaagaagatggaaagaaggaaacttcaatgtctaccttagcgatttgatcccagtggatagagccattgaagacaccagacctgctgggtaagacctatttctcttctctttcctcaaccccaagtgctttggctgttatgtaaagaggatttattgctagataattctgtgtgatttttggtcacctagagaattaaagaaacattaatcattggatatcattcaaatatttcaccagctacagagacaaaaattctcttattagcagttgcagagttcttgttctctgagactttggtccctaccattagctcatgttcaattttcttccctctgttgaaaacctattaaaatgattagatgaactcagttcataataacgtgtatataaatggtagagcttaaagtgtaattccattagaatagtgacaatgaagtgaattcccaattttggaacttttcattattagcaagtttgtcaggaatatatttgggaaagaagcacacagaaggactcttctaggcctccctggaatcatatcttaaccagcagaattctgcctaatcataagtaatgataagcaggatagcaagagaagtgactttactccctaaaatttaatctcctttataggtggagatggtagatatttcaggagatcagttacataggaatcataatgttggaaaaagtcaatcagtccatgaccagcaaacacctacaggaggtataaaaagcataataataatcacttatatttgtagacattcactatttacaaagagcctgcatacacatagatgaactccatatgagccctgcaaaggaggaggcagtcattatggttcaaattaacaagctggcgagggcgctcagaagttacaacactttctcaaggtaatgcagttctaaagctgcccaatgggccttcagtaaccagtccttcaaaaagttaaattcctataactatatcaccagatgtggatcaaaacatagatatttaatctgattcaaatataattgggttcctggcattttttttcttggcccactgataagtgaaggtactcaacagccgtatgttcaatatctgttaactcagttccctaagtcaaacaatatttgccaggaagttggattggggaatgtcaagattgagacttagcacatgtggcatgtaaacaatggccttgtttggcttctgtagaaaattcttctttgtgatctaggtagtcagcattacattttagtcagtgttactaggaggaaggcagatacaggagaagctttatccacattagaaagaagagtctcttcattgtgatgtcggctacaaccaggtcgttttccatctcttagccatcagcaaacagctatcagccatgcactgcttataccaagcactgtgccattcacgcttctcaccctggtgataatcacagtcttgaggagaatgcagacatactcaaagatgaggaaactgaggccctgggatgctagattgcctgtggtcacaaagctagtcattgtagagaaatgattaaaattcatgctcaaaattattctgcactctcttccatctcttgccaatctcccctcaaaaaggatcctaaaaattgtgttggcccagctctaatctaaagtcctgtgtatcacaggattacacatgccagctttgaacacaaagtgcaaggaaatgaagtagccgttaaagcagtttcattttaacatgcccttattgacctggcaggctgctagggagtctggggaggaattagacactgcacagaagcacaagctccagttccaaaccagagaaaaggcacatgcgtggcgggggtgggggtgctcaaagcaagtaataacgatgttatcactagtgtggctcattgaaagctcggggactcccagtgcttcttagtttctatactttgttctgtagaagttaagcattgcagcccaggaaagttacagtcaggctctgtcttctgaaggaggttgtcccaactgtaggaaaaattgacacatgtgcttgagaggatgagtcagagagcatgtggccaggcctcctccctcttatcacataacccaccttggctaaatataggtgtgtctcaagctgcctggcggatgctacgctccactcaggggtctaccaccagggatcctggacctggggcctcccaaagtatttttcagtccttttgtagtcctcttctttgaaagaggataaatcattttttgttcttttacccaaacaccttgactataaatatgtgtaaattatgtattcatatagataaaggttaaagaaaatacaatcaaaaaacatttgattcatcagtttggcaagatttggagtgttttttgtttttgtttttttaaatttggctttatttattttcagcctggctcaaaaagcgtttgaggtagctgcttacaggaatgcatgcaataagattttttaagataataagttttcgaagtcagcataaggggaaattgttataaaatagaataagaaaatgagtacatgtgtgtgaaagaaagagagagagaaataactgtaagaatacaggagggctagcttaaaattagctggagtagcatcctactgcaacctttaaattttaagagttttggagaatatcttcctttttggcctattcatttccccaaaatccactgttatagatgaattcacacataactgtcatatcacaactgctcattgatacagaatgaaccaaaaaatgtaaaaaaaaaaaaaaaaaagcgcacagatttggtataatcatttaaattcaacttcacccagtgaagataataactagtcggtagttaacatcatcttaaagatgaatgagctgatgtgctagggtgaggttaccattaagaagtagaggacaggcatggtagctcaagcctgtaatctcagcactttgggaggacatggttagaggatcccttgagcccaggagtttgagatcagcctgggcaatatagtgagacctcatcattacaaaaaaatttaaaaattacccaagggtggtggtgcatgcctgtagtctcagccactcaggaagctgaggtgggaggatcacttgagcctgagcggtcgaggttgcagtgaaccaagattgtgccactagcctgggtgacagaataagaccttgtctcagaaaacaacaacaacaacaacaacaacaacaataaaaaggtagaggagacaggcagggatttccaggacaacttctcttactctagttctaaaatcagattctcttttccaaacctgctttttcactccgttttctctggagtcccaaaggaccattgctaaaatgttaagattcaatttcacaactctttttttttttttttttttttttttttgagatggagtctcgctctgtcacccaggctgagcgcagtggtgcgatctcggctcactgcaaactccgcctccggggttcacaccattctcctgcctcagcctcccgagtagctgggactacaggcacccgccaccatgcccagctaattttttgtatttttagtagagacggggtttcaccgtgttagccaggatggtctcgatctcctgacctcatgatctgcccgccttggcctcccaaaatgctgggattgcaggcgtgagccaccgcatccggcccacacctcttttctaaagcacaagaactcctttctgttctcagggttactcacactgtccttttctgtctgcccatgtttctcccctttgtggtatagcaatagcaccctgcacatgacattttctccaagctgggcccttagcataagaaaagctaatctctttgctcttctccaccctttacagttgtaaccatccactgaggttttcattcactggtcccttcccacagcctccctccatcctcaccattctcttgcacacattctaattcaatgttgctcagaatccaactgtggcttccttccacctggaccatgaggtagctgtgacctctaaattgcaattactcttagtgtacacaggcatcctagttactgaaacactgtttattctgtgttcttcattaactgaatccttgaacgtctgtttttccttcctagtgaaattataagcttctgaaggaaactttgtctttagctttattttgtactcctttagcactgatcacagtgctgtacattcagaagcaacaggtttacacagtatgaatttacaatttgtttctctgaaatgatttttgaaaattgatactactttaaaaataatcaaaaggtagcaattcaaatgaaacctgcagcaagtctgtttataaattaataatgacttcttaatttttcattatgaatatatagaagatattaaaatctgatttaaggcaaatacattctgtttaacactataatctattcattaatttgtgtttatcccttattttatatttttgttattgttttggttcttaattttaatgttttggctttcaagagaggaaagcctattttatttacaagaatgttttacgtcagtatgtaaaatacaacttcattgttgcctagaaattttgcctataaaatttgcttgaaataaaatgcttttttgacagttaaagttccatatttaatctttttttaattaaaagctaatcctttcagttcttgctcctaatgattgaagtttgtttctgtcagcaacaatcaacacacatacacacacacacacacacacacacacacacgtacacacaggttttgctaaaatgtgatcctatgcagggcagttctacttggagaagtctgtcttttggcctgaagctatagttaagatggaactccaaaaatgaacttattttaagagtgcacttcctgaatctgaatttagagaaaaatgactcaaaggaatttttgctgccagcatttagtttttaaagtacaataagaattctggcgtgcttgtctaccactgctgtgtcctcataacgttactcaactgcttaatttaatgctttgctttccctacaaaactctggcaagcccctcaataaagcaattaaaatggtctttattctcttagcccagagccaggactgtcaaccaataatttgattccttcctacacagctaaagaaaggtttttttttggcacatttgaaaagcaaaagatagcaccatgcatttgccacaaaccaatctaaattactgaggggaaagaaaaactttctggaaccttaattttgatcctagtagggtcaaaaactataacgaatgagttactggaggaggaagaggaggagggggaggagacagaagagagaaaataaagtgatcaggtatcctcccaaactttgagcttctaaaagtttatcaggctgagagaaaaaaagaaactttaaagttaaattaaatttaaatttttaatttttacatgggacacaaatcttaattgatgaaatgaacgtgattttgtgactaatagtgattggagaacattaattaaaattgattggagaagctatgagatctccttgagaaaccaattggaggcagggaaaaaaaaacctcatgagatgaattcaaaaggatttacttcctgctttcacctctatgggtaagcaatgcagtggtgccttttgaatagtgtgtatgtgttcatttgtgtgtgcacgtgcatgcatttgtgagcatttgtgtttgtgtgttagagcacagtactctttttcactcaaaagtcatgtaggagagcaggacataaaaaggaaaacttgttaaaagggttcagactaggctgtaacataatgaaggtgaaatatggccaaaggacaatgaactgggcctttgaatacttttatttatcccactctccttataacaaagggaataacaaagacaacaaagattagaggagaagaatggaaagcacaattctgctactagttcaaattctgctactagtttctttctaaaaagaaaacagctaaacagtgcctaattaatagaaaacagaaatgttaaagtgaattcctgacttttcctcctaaatactgtgaaagccctagaaacactcctgggagagagtagttagtatatgcaggaatttgaaagaagtatactttttcatatacggaacacaaggcccagtttaaccatcagcataatatatcaaacttttgctgtaatattgccctggtactcttggccctgaaaataacttcctattgggcttttctggctgatccaatcagaacagagcctctcaagagagaaacaacttttttgctcaaggttcagaaaattcagggaaaatagcaatgtttagaagctgtattttgctgtttgctttcgaaatgaaaggagctttttagagtctcctggaaaaacagctatattataccaaactcaagtacctcctcaactggcgttgcttctaaaatgttgataatatggacatgtgtgagaagcagcaatatgaggaaacagtgtttacaaaggcttcacaacttgccttctcatttaatccttaaaacaattcctcaaggtagatactatcatcatcccagctttacctatagaaaaactgagacagaggaagctgaggtttcagataatagcagatatttcagacagtggcagttcatttcattgcacgtgatatttgctcattgcctatcaatcaggagcggtgcgccatgccaggcagttgaggcctttcatccttcaggcatattatttcatctgatccttgtggccatgccagattagcaaagtgttacctctctttattaacagatgaggggggaaaaaagagcaaatggtaaagtaatttgcccaaggcctcacagctcacaagtgccaatgttgggacccaacctctagttttctgactcttcctcactcagtaataattccactgcaccagtctggttccctctccacctccagcaactctccccacgtagtgaccatcatcacctgcaagtctccttagcttgccaaggccctgtgctaaaggggaatccctccattgctcagcttcacacacaaagaaaatgcttagttttgtttcagtcagtgatgtgtgtgtatgcatatatgtatgcatgtagacttatgtgtgtgtgtttgtgtgtgtgtttgtatctaagcaatcctcacagcaaccctatgagatattaactttcatatgttttacagttgagaagagtgagactgtaaaagaataaatgatttatccattgtcccagcaaactaatagcaaatttgggattcaaaagaaaatttcccaatttttaattctagtgttctttccacaggtgacagcttttccttcctttgtttccttatagtcatatgacattggcagaaattaaaacacctctcttccttatacatgggtaagagatgcatgatgggaattaagtttgcatgacatgtacctcatcagagaaaaaaattataggaaagcatttcctatatagcactaagcaaaggtgattctttaaaacttggccataaccacagccctgcagtgaacaaatctctctgggctgctactgcaaagtatggcatcagagcatggtcattgacttcaaggcgtatacagcaaaatgtgatgccgaaacacaggggactgttgggaaaaaggagataaaaagctaaacctgtcctgggagagaacaaaaatgtttgagctgcaacctgaaagagtagagagtcagagaaatggagaaagcagtaaaaaggatgatccattgagaaatcgagggaaatctgacatgggttgcaggagagcaatgaggacgtaaatgaggccacagaagtaagtagagtccagatcactcaggaccttcaggttcttccaagggccagtgggaaaccgttaaatgatttaagaccatagaaataacaatttaatttgccttttctcaggggacttatgacccaaaggaaagcacttacaggtaaatgctaaagttgcatagaaaaccacagaatgttaatactaggtgaagatttgaaagttttctaatctagtcctttatgttacagacaatgttccaggagaaaaatgacttgcccaaggtcatacacagcaggaaagacagaacatccccacctagtactatttctgccacatcacaccacctcctcctcttctccctgccgtcccaatttcactgtgacagcttcctgctcaaaacagactattgttgaagtggtgaatgtttatgctggtggcttatatttctaagcctgagtcctgtcactttgatgactttacatttaccatggcaaccacagccgcagctggctaagaactttggagtagaagtgatgagtgtgacttaaattttctgaatcagtagccaggtgattttgactgaatgtcatggatagtctaccctagaaagaacaaaacatgaaaatacagtttttatatcactgtaccttcttatcagtgagagggaaagcagccccaacaattctaaggtctgggagaaaagaataaaatcccaggcagagctcttcagctgtgtgctcaattctcctcctgatgttcctgagacatcagtgcttggggagtgaaggcccctgaaggctcacatgaaggcagtagttgaattgcaaatagaagttaagaaaatattctccttgaccttctgttcaaacctgtgaaggctgagacttgacccacatagtacatcttgactgtctcggaataaaatgaaaaattcatagaaatgagagaatgttatcattccctcaatcttatgatttaaaaccttctctatttgataggctacattcaaatcaggttagtggctcagcattcagcacacagaagccaggagggtgggacgcatcactttctgggtctctcgataaatggttgagcacttgatagattcagattaaaggactgcttcagaaaaaggcagtgtgctccctcaaaatgtgtgtatttgcattatgggtaatcgtaggttctcacatgagtttttcagcatgaagctcacaaaatatttttacatccattatctcatcaaatcttcaccactgttctgtgatgaaggcattgtaatcttcatcctaaaagtgaggaaactaaggttctaggggcctaactgacttgcccatggccatagggccaataaatgctagaatgaactaaaaacttagtctcttgtcatctttctcaagtccagagtctttctgtccaccacagtagtatgtcagctaagtgcaggatagtgaaactccccacattagaggccccatttgtttttagaacttggattggctgcagtaatctaagcctagattcccccccaagacaaagagattggattaattttttaagtatagcatgggaccagtagactctaaatacctaatttgtataataaataggcatatagaatataaatgtgatttcttagcctcaaaaaagttacaaacctagaaatatctggcattcaaattagactttagcagcaatttctcctcccatgatataggcagaaattaaggaaaaactgaaataaaggaaacttgcttgaattaggttggtgtaggataacttgaaatggtttttacaacctatgccaactagatgacatagtgtctgcccagaatattctccattctcctcaagcccctaccctattacattagcaagtaacctttcttccagtatgaaagactagagtaagagtttaaaatgctgaaagctttgcgggggtttcccactgttcctttgaacaaaacaagcacactagttttgctagatacccggaaacatgtttaatctgtttagtaatgcaggagaacaggtctctgtaaatgtcagagtgccttgacatgtcagtcaccccaaatcaaggcacaccctgaaactttgtattggaaatctcaggcatctcttttgggtccctctttcccatcctgtaatattgcttttaccaggcactaatatgatctgtaccatataatcttccacagaatttcttcattgtaattctttaaacacatctaagatatatatttgtcaacaattggcagaggtactacttatttgctgggatattagcatctagtggaatctctcatgatctgcccatgtagggtactaatagtgaaattaaggcaccatgacataatcgggggaatagaggattagatatttggtgattagaggtgtcttccccaaatctctcaaatttctgagaatttttcttacctccaattttagactgtctagcactttttagaacttccttctaaaaaggacaaaaactctactaatttaaaatataggaagagtcatttgcatgagcctgcttagttaactcctcctgatacaattccttttgtcactggatgtttctcagaccaaccaaattttaaccataaagcaactctcaggacttcacagccgggcttgttggtttatgccgaatttgtgtaattgatcctttcttttcagaactgatttgatttttttttcagcaccaaataccattaaaaaaaatgtaactgtgaaatgtgaatttctcattaatttatattataaagttagagatgaggaagtcataggctgtagctgttttcttctgtaccctccctttcactcaggctattaaactccccttagctttacttcctctttccctgacccagagcccatgccggaacattcaaccaccttacaccagtcccctcaaacctcactacccattctctttctacctcatgtgctctgatatcccttagactcatattaatccagcaatttgctttatctcttcttacacgcaggctggcaggcactggtggagcaaatcatatattgaaatttcataaaattttggcatctccagtttcaggaaagtgctcactgcccctctgaaatcctagctagctggccagcattctctcccattgcccatagtatctgtccaaaatattctccattctcctcaagcccctagcctattacattaacagataacccttcctccagtatgagctatgaatattttcaacttctcatcccatgtgcataaatatatttgtatacgttaccacctttttgtactttctatctcaaagggaaatatttcttccactatttaagctttaagttccatctcatctccatccattcattcatgcattcaatacatatttatcaaatatttattgtgtaactgtgctggaagcttgtggtactgtagtaagcaaggcagatttgtcctaccctcagaaaattttggatgcagaagataaggaaataagattgatagatgaatgctgtgacagaaacacaataatagagaataataaaagaatagttaattttgagagggtaggccaggtgcagtggctcacgcctgtaaacccagcactttgggaggctgaggcgggtggatcacaaggtcaggagatcgagaccatcctggctaatatggtgaaaccccgtctctactaaaaatacacaaaaattagccaggcgtggtggcaggtgcctgtagtcccagctactcaggaggctgaagtaggagaatggcgtgaacccgggaggcggagcctgcagtgagcagtgatcacgccactccactccagcccagactctgtctcaaaaaaaaaaaaaatgtgaaagcgttgtcagagacggcatctctatgaagggaatatttaagataggaactaaaggaatagaagcagccagctgcgaagacatgggaagggtagcaaaaatgctagaagttaagcaaataacaaaagctggagtgttcttcagggaactgaaagaaggccaaggtggagtgtgtgaggggagagtggaatgacaggcagttggaaagttgagcaggggtcctatacactaaagaatttggatttttttccttttcactttgtcccatagaaattgactgaggattttaaacagaagagtggtgttgatctgacaaactgtggaagtagtgtccctttaggagactccagcaataatcctggagaaagagagtggatgctcaagagctaggggaggcaactgtggaggtataaagatgttatagctgagatatctgttggcaacacacagaatagaagttgatggattgattgtatttatggtcaggaagagggtgaagtctagatgagaatccatatttctgcagcaaggtgggtggcgatgccattatgagggaaatgcagaggagctggttgggttgagtggggtgaagtcaaggtttctgtttcagacacattatgagtgagatgcctgtgagacatgcagagaagatgttcagaaattgtttggatataagttaagtctgcaattcagatgggaaatctgacctgtatataaactatgaagatattatcacacttaaaactgtgagcatgatgggctcatacaatcatatcacacatagaagaaaacaaagccccagacccagctctgagaatcttgtgtttcttaagaggaaaggaaagctaagaaggaaactgaaggtgaaaagccagtgaatgatgggtgaaaactaggagggtgtagtgtctcatgggacaaaaaattaaaaaatagagagtggccaaaggaaactagacttgttaattgcatcaactgccattgtaaggtgggttaatataaagagaccttgcttcattgataatcctatcaattactgatttttttttcaactctcagctctatctgtacctactctgatgctcataaatatgattctgtccatgtctactcaacagaggaagggagaacagggatgacaaattttcctggtatcccacctatctaccctcctatttctttcttttctaggttttctcccaaaattgtccacaaaatactatcctttccctcatttaccttttactccttttttaaataatttcaacattttagattcaggaagtacatgtacaggtttgttacagggtatattgcatgctgctgaggtttaggacacaaatgattctgtcacccaggtactgagcatagtactcaacagttagtttttcaactgttacccctccttccttaccctctctagtagtccccagtgtctatcattgccatctttatgtctatgagtacccaatgcttagctcccacctataagtgagaacacgtgatatttggttttctggtcctgtgttaatttgctaaggataatgtcctccagctgcattcatgttgctgctaaggaaatgattttgttattttttatggcttcataggattccatgatatatatgtatcacattttctttatccaatccaccattgaggggcacctaggttgattacatgtctttgctattgtgaatagtgctgaattgttttggtagaatgacttattttcatttggatatatacctagtaattggattgcttgctcaaatggtagttctgtgttaagttctttgagatacctccaaactgccttctacagtggctaaactaattggtaggaactacattcctaccgacagtatggaagtgtataagcattctcttttctccacagccttgacagcatctgttgtttttttactttttaataactgccattctaactggtatgagatggtgtctcattgttcatttaccttttactttgcagttcattgtgctctagccccaccaattctctcgttgggaaactttagtctcatcactctggtctttaatggtcatcacaagagattctgagaattagaatcttattttggagatgttcccttttttgccttatgaaaaacatttcagagtctaaagtttgtccagttccaaaattgtcctctaattgttggaattgttggtaattatgcaaccaaatagaccaattttttagtacttcttggaaatccctcaatttatattctttcttctttttttctaattatctttattttctaaaatagagtttcaatatgatagttcataatttggtatcaccaattaacactttcgtggacttcaatgtgcaaattcctcaaacttaaaagaagcttcaaatttagggaaaaaaaaacagcatgactaacaattctgtaaattcaaaataaacctacattttgttgagggatagggaagccattttaaattttttatttgaaaacagcatatttcttgctttttttttttttttttttttttttttttgagacagatttttgctcttgttgcccaggctggagtgcaatggcacaatctcagctcaccgcaacctccgcctctggggttcaagcaattctcctacctcagccttccaggtagctgggattacaagtacccgccaccatgccagggtaattttttgtattttttttattatactttaataaatgttaataatatactttaaacctgcccaatgtgcaggtttgatacataggtatacatgtgccatgttggtttgctgcacccatcaactcgtcatttacattaggtatttctcctaatgctatccctcctccagccccccaccccctaaaaggccccagtgtgtgatgttccccaccttgtgtccaagtgttctcattgttcaattcccacctatgagtgaaaacatgtggtgtttggttttctgtccttgtgatagtttgctgagaatgatggttttcagcttcatccatgtacctacaaaggacatgaactcatcatttagggctgcatagtattccatggtgtatatgtgccatgttttcttaatccattctatcattgatggacatttaggttggttccaagtctttacaatcattaatagtgccgcaataaacaaacgtgtacatgtgtctttatagtagcaggatttataatcctttgggtatatacccagtaatgggatcactggtatttctatgggaatggtatttctagttctagatccctgaggaatcgccagactgtcttccacaatggttgaactagtttacagtcccaccaacagtgtaaaagccttcctatttctccacatcctctccagcatctgttgtttcctgactttttaatgatcaccattctaactggtgtgagatggtatctcttgtggttttgatttgcatttctctgatgaccagtgatgatgagtatttcttcatgtgtctgttggctgcataaatgtcttcttttgagaagcgtctgttgatattctttgcccactttttgatggggttgtttgttttttttcttgtacatttgtttgagttctttgtagattctggatattagccctttgtcagatgggtagattgcaaaaattttctcccattctgtaggctgcctgttcactctgatggtagtttcttttgccatgcagaagctctttagtttaattagatcccatttgtctgttttggcttttgttgccattgcttttggtgttttagtcattaagtccttgcccatgcctatgtcctgaatggtattgcctagatttacttctagggtttttacggttttaggtctaacgtttaagtctttaatccatcttgaattaatttttgtataaagtgtaaggaagggatccagtttcagctttctacatatggctagccagttttcccagcaccatttattaaatagggtcctttctccatttcttgtttttgtcaggtttgtcgaagatcagatggttgtagatgtgtggtgttatttctgaggcctctgttctgttccattcgtccatatatctgttttggtaccagtaccatgctgttttggttactgcggccttgtagtatagtttgaagtcaggtagcgtgatgccgccagctttgttcttttcgcttgggattgtcttggcaatgcaggctctttttttggttccatatgaactttaaaggagttttttccaattctgtgaagaaagtcattggtagcttgatagggatggcactgaatctataaattactatgggcagtatggccattttcactatattgattcttcctatccatgagcatggaatattcttcgatttgtttgtgtcctatttcattgagcagtggtttgtatttctccttgaagaggtcctccacatcccttgtaagttggattcctaggtattttattctcattgtggcaattgtgaatcggagttcactaatgatttggctttctgtttgtctgctattcgtgtataggaatgcttgtgatttctgcacattgattttgtatcctgagactttgctgaatttgctggtcagcttaaggagattttgggctgaaacaatggagttttttaaatatacaatcatgtcatctgcaaacagggacaatttgacttcttcttttcctaattgaataccctttatttctttctcttgccagattgccctggccatttcaacactatgttgaataggagtggtgagaggggcaacttgtcttgtgccagttttcaaagggaatgattccagtttttgcccattcagtatgatattaagctgtgggtttgtcataaatagctcttattattttgagatatgttccatcaaagcctagtttattgagagtttttagcatgaagggctgttgaattttgtcaaaggccttttctgcatctattcagataatcatgtggtttttgtcattggttctgtttatgtgacggattacatttattgatttgtgtatgttgaactagcctttcatcccagggatgaaaccaacttgatcatggtggataagctttttgatgtgcctctggattcaatttgccagtattttattgaggattttcacattgatgttcatcagggatattggtctaaaattctctttttttgttgttgtgtttctgccaggttttggtatcaggatgatgctggcctcataaaatgagttagggaggattcctgctttttgtattgattggaatagtttcagaaggaatggtaccagcttctctttgtacctctggtagaattcggctgtgaatccatctggtcctggactttttttgactggtaggttattaattattgcctcaatttcagagcctgttattggtctattcagggatttaacttcttcctggtttagtcttgggagggtatatgtgtccaggaatttatccatttcttctagattttctagtttatttgcatagaggtgtttatagtattctctgatggtagtttgtatttctgtgggatcagtgatgatatcccctttatcattttttattgcatctatttgattcttctctcttttcttattagtcttgttagcggtctatcaattttgttgatcttttcaaaaaactagctcctggattcactgattttttgaagggttttttgtgtctctatctccttcagttctgctctgatcttagttatttcttgccttctgctagcttttgaatgtgtaagctcttgcttgtctagttcttttaatttgtgatgttagggtgtcaattttagatctttcctgctttcttttgtgggcatttagtgctataaatttccctctacacactgctttaaatgtgtcccagagattctggtatgttgtgtctttgttctcgttggtttcaaagaacatctttatttctgccttcatttcgttatttactcagtggtcattcaggagcaggttgttcagtctccatgtagttgtgcagttttgagtaaatttcttaatcctgagttctaatttgattgcactgtgttctgagagacagtttgttgtgatttctgttattttacatttgctgaggaatgctttacttccaattatgtgatcaattttagaataagtgcgatgtggtgctaagaagaatatatattgttgatttggggtggagagttctgtagatgtctattaggtctgcttggtgcagagctgagttcaagtcctggatatccctgttaaccttctgtctcattgatctgtctaatattgacagtggggcattaaagtctcccattattattgtgtgggagtctaagtctctttgtagatctctaaggatttgctttatgaatctgggtgctcctgtattgggtgcatatatatttaggatagttagctcttcttgttcaactgatccctttaccattatgtaatggccttctttgtctcttttgatctttgttggtttgaagtctgttttatcagagactaagattgcaacccctgttctttttttgctttccatttgcctggtagatcctcctccatccctttattttgagcctatgtgtgtctctgcacatgagatgggtctcctgaatacagcacactgatgcgtcttgactgtttatccaatttgccagactgtgtcttttaattagggcatttagcccatttacatttaagattgatattgttatgtttgaatttgatcctttcattatgatgttagctggttagtttgcccattaattgatgcagtttcttcatagcatcgatggtctttacaatttggtctgtttttgcagtggctggtaccagttgtttctttccatgtttagtgcttccttcaggagctcttgtaaggcaggcctggtggtgacaaaatctctcagcatttgcttgtctataaaggattttatttttccttcactcatgaagcttagtttggctggatatgaaattctgggttgaaagttcttttctttaagaatgttgaattttggccctcactctcgtctggcttgtagagtttctgccgagagatccaccattagtctgatcggcttccctttgtgggtaagccaacctttctatctggctgtccttaacatttttcccttcatttcaactttggtgaatctgaaaattatgtgtcttggagttgctcttctcatggagtatctttgtggtgttctctgtatttcctgaatttgaatgttggctaggttggggacattctcctggataatatcctgaagtgtgttttccaacttggttccattctccccatcactttcaggtacactaatcaaacatagatttggtcttttcacatagtcccatatttcttggaggctttgttcatttctttttcctctttttcctctaaacttgtcttctcaccccatttcattaatttgatcttcaatcactgataccctttcttccacttgattaaatcggctattgaagcttgtgcatgcatcacgaagttctcttgccatggttttcagctccatcaggccatttcaggtcttctctacactgtttattctagttagccattcgtctagtgttttttcaaggtttttagcttccttttgatgggtttaaacatgctcctttagctcagagaagtttgttattaccgaccttctgaagcctacttctatcaatttgtcaaagtcattctccatccagctttgttccatcgctggctaggagctgcaatcctttggaggagaagaggtgctctggtttttaggattttcagcttttctgccctggtttctccccatctttgtggttttatctacctttggtctttgatgctggtgacctacagatggggttttgatgtagatgtcctttttgttgatgttgatgctattcctttctgtttgttagttttccttctaacagtcaggaccctcagctgcagatctgttggagtttgctggaggtccactccagaccctgtttacctgggtatcaccagtggaggctgcagaacagcaaatattgctgcctgatccttcctctgcctgaagcttcgtcccagaggggcacccgcctatatgaggtgtctgtcagcccctactgggaggtgtctcccagttaggctacacaggggtcagggacccacttgaggaggcagtctgtccattctcagagctcaaacgccgtgctgggagaaccactgctcttttcagagcggtcagacagggacatttaaatctgcagaagttgtctgctgccttttgttcagctatgccctactcacagaggtggagtctacagaggcagtaggccttgctgagctgcggtgggctccacccagtttgagctgctttgtttacctactcaagcctcagcaatggtggacgtccctccccgagccaggctgccgcctcccagtttgatctcagactgctgtgctagcagtgagcaaggttccatgggtgtgggacctgccaagccaggcacaggaaagaatctctgggtctgccagttgctgagactgtgggaaaagcacagtatttgggcagaagtgtcccattttttcaggtgcaatctgtcacagcttcccttggctaagaaagggaaatccccagaccttttgcgcttcctgggtgaggtgatgccccaacctgctttggctcaccctctgtgggctgcacccactgtccaaccactctcaatgagatgaaccaggtacctcagttggaaatgcagaaataacccgtcttctgtgtcaatcacgctgggagctgcagatcggagctgttcctatttggccatcttggaacagacctcaattttttgtattttttagtagagatggggtttctccatgttcgtcaggctggtctcgaactcctgacctcagatgatccacccaccttggcctcccaaagcactggcattacaggcatgagctacctcacccagcctatttcttgccttaactcattaagcccttgtgtcaggctaaaagacatggttctccaaaaatatatttacttcctaattctcagaacctgtgattattacctcacctggaaaaacagtgaatattaccttctgaagcaagagatgtgatgaaggatcttgagaggagacatttaccctgaattacccagataagccccaaatgccctaaatcacatgtatccttataaaagagagccaggcagaggtttcacccagagagacacagaggagaaagtgatgtgaagacagagagagagatttgagtgattcaacaagtcaaagactgccagcagaagctgaaagaggcaaggaacagaatgtcccctacaacatatggagggactgaggtcctactgacatcttggttttagaattctggaccccagaaatgtgacagaatatgttaccaagtttgtggtaatttgtcatggcagtcagaagaaactaatataaattttggtatcaaggagtgaggtgctgctataacaagtacccaaaaatacagaagtatcatccaaggaatagccaagtgatatggtttggatgtttgtccccttcaaatctcatgttgaaatgtgacctccaatgttggaggtgagacttggtgggaggtactggatcacggaggcagatctataatggatgacttagtgccatccccttggtgatatgtgtgttctccctcagttcatataagatttggttggttaaaagtgtcagagacctcaccttactgtctcttgcttgctctgtcatgtaacatgcctgctcccacttcgtcttctgccatgggtaaaagctccctgaggcctcaccaagagctgagcagatggcagagccatgcttcctgtacagcctgcagaaccgtgagccaattaaacctcttttctttacaaattagctagtctcaggtatttctttctttctttctttcttttagatgaagtctcactctgtcacccaggctggagtacagcagtgcgatctcagctcactgcacactacaacctccacctccagggttcaagcgattctccctgcctcagcctcccaagtagctgggattacaggcacccgcaacgatgcccagctaatttttgtattttcagtacagactggatttcaccatgttggccaggctggtcttgaactcctgacctcaagtgatccacccaccccggcctcccagagtgctgggattacaggtgcccagccaggtggatttctttgtagcaacacaaaaatggcctaatacaccaaggaattcgctaataggtagaggccggaagaattctgtgaagcatcatagaaaaagcctagaatgccctgaagtcactgttggtagcaatatgaatatcaaggatgctgttggtgagggctcagaaggaagtgagcggcacagtagagaaagctcctatcaaattgcgccatggcattcccgcctgggtgacagagcaagactctatttcagaaaaaaagaaagaaagaaagaaagcttctatcaatcatctttgaaaatatgtatgctatcttgagcagaatgttggcaaaaatatgagcattgtaagtacttctggtgcaggcttagaaggaaatatagagcacatgattgagaaatggaagaaaatgatccgtgttacatagtggcagtgagcttggcttaactgtgtcctatagtcatgtgaaaattagcagaacttgccaatgatgaaatcggatatttagctgaggagagtaccaagcaaaatgttgaaggtgcatactgatatcttctttctgttcagagtacaaatgtgagagaaaatagatacattcaggaaggaactgttaagcagaattttcagtaatttgttatggtggccaaagtaaactgataaagctcttaagtgaagagaggaatatcttctcatattattcagaagtgctaatgcatggatccttagtgtagactaatattagtttagacagtctgatattttaagttagcattagatacctgatcactacatgaagatagtgaatcaaaatgtgttattttaattctctgtcacttgaacatttaggacatgctcctatcagctgtcaatttattttttttaatattagcctcaaataataagaataaattaactttatcttgagctcaagttcttaaactcaccaatcaatgatttgtgagtcattcttttgtttgttggtgggttggtttctttgtgttttcttttatttgtttgtattttaagacatggattcttgggccctcagcaaaccttgtaaattgattttctggggctgaggattggatatttatgtttttctaaggctttgtcaattattatgataaacaaccatctaggaaaccattgaaattatgaagcacagctggatttgtctaccatttcttaagtaccccctatgtgtcagatatatattagatgagttttacataatgtttatatgtaatcttataggtacatgtttaatttcagctttgtagttggcaaattgaggttcaaagaagtagtaaagctgttccaaatcagtaattagaaaaactgatatttgagcacatatctatttccaaagcccattctacaaaaaaaaccagcagtaaagtaaaaacattatttgttcatatttccttatatatcctatctaggtggatgatgtgggtaagtcatttaacttcccaagatttgaagaagtgtataataatatgtatctcaagcagttgttatgaagactgaattcaattatgtacagaatagcactttggcaacactagagtgtcatgcaaatgtgatttgctttactatcgtttttgctcttacctatttcttatttatggaataagtaaagtataaccatgttatttggcagaagtgccagctctcacaaaatgtcgcatctactgccagctgcttctattcttgtggatctaaggcttcctcaatggttacttttggagccagactggatcagtgttcgagtcccagctctgccatttactaactgcagaatcatggactagtctttccatgattttgattattcaccaataaaaagggaaagagatgctggtaatttgaggtcgacattgaaataatatagaatgcttataatatttatgatcatcattaattatcacattactgacagtagctgtgttagtaagatggcaaatacattttgtgaggttccactgggcactgcttatgaagagtggcacaggcagggggtgaaagaatgccagcagtgaggcagtgtattctgcagggcatgggaaaaaacccaggccagttgcaacccacctgaatactaactcccactgtagcctggattgcattcctatgccagcaaaatggtttttcaactgtggctattctgtagcagagtatcagcaaggaagccccggatacggaagctaaaaagagtttaattatttggcacatatatattatgccataagtacatacacaagcagaatgggagaaaagaataaatcccatggcagttggcagacagccagttggaaaggcaatcataaaccacttgggaacattaaataagtcagaatgctatcttctagcatataatctagtaatgatagcaataactaccatttcataaattcctgtgccaggaaccctgctaggctttgtatgtacattatcactaggctacaaaactctattgaataagaaccatttattacctcattctgcagatgaggaaactgaggcacagagaagttaaagaaggcattaatggttaaagacctgagaaatattggccatgagatttgaaatagagtctaactacctgtaaaccctgtcctttccactgcagtgtgatgtctgcatgggacattctcatgtcttgcatttctagtccttttataacaaccacggttacgggtaattcttctgcttttttattttgcatgtacccctccccaaaaaaaggcacatgataaataataaaatcatcattggtatatataaatagatgatagatagaccagacagatcgatgacagattaagtgtgtgtgtatatgcacaccatcgcactctgtgacttttaaaactatcttgtggatctccttagcacatctcttgtgctctgcttatattctggcccagatgtgcagagcagctagttcacaataacctcccaaccaccagtgtcatcatgtgctttgtggatgaagtgtggtccactctcctgagatctgttcacagtgtcatcaatcgctctcctccacacctcatcaaggagattctgctggtagatgacttcagcaccaaaggtaagaaaaccactcaggctatctcttgaaatttcaaagtttggcagaagcaaagtttagtagcagtttggatggcaaaattataggataatttgatgaagcataaacatcgtacaaatgctttgttttacgtggagcctcagagacataagtctaagcatctatggacgttaaaagtcatctggagctctgttcagttagttgtctcagttgtaactctgctaccatgttggaatgatctaactatggctccttggagatgggcacttagaagtagtggagtttagatgtcctctacaattgcacaaatcccttttaatggaatcacaattaacgggaggccttgcctactggtaataactagagttacagttagactctatggaaggcaaagaaattaagatcttatggcttcttccttgagagcaaggcatatgatgtgttcagttaagtgttaagaagacaaattgccaataggacaagagagatgaggtgattccaacaaagttcaaaaccagaatccaccatagcctttatgttcatttttgcttattacagtgaagaatctcactctttgggttgtcaaataacctgtgtatgtaggtggtctgacagccacattacaaattcccaaatggaacccatttttcagaaaagtttagaaaatagcaaagacttggcaatgctaatggaacagcttacccttgagctgtgaccacagcaacatgggaagtttctttagcttcagagtttctgccataatcacactgagctcaagaagctgtgggatgatagagaaaaactggctgaaaaacataaaatgtggccttggaagcataaacaggaatagtacccaattagtaagtagataggagtccctttatgaggggcaggtccagattctgtgggacctgaagcttattcagttttcagggtcctgtctaagaaaaactttcttagaaagttttctggaagccattccaacctaggatagctgtcaatagcttgattacacacagaaatgactgtaagtcacataaacatagctcataaagcccccggaaaactgttcctttagctggatccctccatggccatctaataagagagaaaaggtgtaatggaaggggatgtcagagtagagaatgaaagggtcttatttgcacacattgtttagcctcttccttgggtcatggaaggggcttttgcaagaggtggggctgagagtagaggcagaattgtgcagaagcctgagctacatatattttaaggcaaatctgcccccaccttgacaaatactcagaaaggtgtgccctccactacatcaccttacaacactgaaaacaaacatttggggtttgaaaaatcagacagctttgaatactgaaaccagatagaatccttccaagaaaatgacatcagaaaataaaattatgacccaaggaataaaattcagtgatgatggtaatgtcatagtttttggcatttgactttggggagcacttctgatactatccggacttacttaattcaagtatttcctggtttatctttactctgatgtagactatctaaaagataatttggataaatacatgtcccagtttccaaaagttcggattcttcgcctcaaagagagacatggcttaataagggccaggctggcaggagcacagaatgcaacaggtaagaagttactcatttttttgtttgttacatttttattttaatttaaaatgtttctcaaacatacagcaaatgtgaaagaccagcacaatgatgcctatatatgcatcacttagttccatcaattttaaacagtttttataatatgtgctttatcataaacacacatagacacctattgtatatacttttttcctgaacctttgaaaaagaagttacagacatcatcatactgcacccctaagtacttcagtgggcagctctgaagaacagaagcattctcttaaataagcacagctttcataactaaatataatacctactatatgctcttttcaagttttctcattgttcccaaaatgtttttgtttttgtttttgtttttttgagacagagtctcgctctgtcacccaggctggagtgcactggtgccatctcagctcaccacaacctccgcctccctcgttcacaccgttctcctgcctcagcctcccaagtagctgggattacaggcacccaccaccatgcccggctaattttttgtatttttaatagagacggggtttcactgtgttagccaggatggtctcgactcctgaactcgtgatccgcccgcctcggcctcccaaagtgctgggattacaggcctcaaaatgtttttttaaattcgggaactaattaagtttcatactctgcatttgatactttggtcttcttagtctgaaaagtcaactcctcacacactttgtttaaataccagtgtgtgtgtgtgtgtgtgtgtgtgtgtgtgtgtgtgtgtgtgtattttaagttcatgccatttgtttggtaccagtgaccatgttctgaaatttttgatttcctcttgttacctgcaggataaatgtttttggagtgaaaatattatatagaatgctactacataggtgatagaaatggtatacatctcatcaagaggcatataatataacataatatcaccagtattgttgatactaactttgttagttaagatgttgacagctaaacctttactttgggattaagaagtaatttgtggaatgacacattgatccatgaaaatattctgtttttcttacaatgttttacccaatggtttttagtatccattgatcatccttgcttaaatcaattattacactgaggactgaaaatttgcttttctataattcattcttttttatttagctggcattcatgtgtaaggagaaaatctctatctctccctctcctgctttctaactcttcctccctttcccctcaatctccctctcccctccctctcatcccctcatcgatatggatttatggctcagaaattaaatgtgtattatatcaccattattcttgttggtgttcaaattgtcccaaatttgaccactaggagcttcttcaagcctgtgcccttttgacctgacccatcaatatttcaagatttcgtaatgttttaattctataatcctcacccctctcttctctgacccatgtctattcttcctatggttctttctgccttccccaaaggccgtatgccttcttttcctctcccctttttagtgtgcaggtgttggtgagtgaatgagaagtgaatctattttatgagtattctaaaaacaacatcaaacatttgggttcatgttcatacatttctatggaaggatctgtgccctgtaatactagctgatttatatgctaggtgccattctgaatactttgtgtattaactgattgaatcctcacaataactctatgagatgagtacaatcacatcctcattctacatatgagaatatagaggcacagtgaggctgtgccttatgcaagctcccccatctagccagtggtaaatccaaagctggcacctgaatgccctgaccccagagtccgtcctcttatcaactacaccttgaggcctctagacatttagccaccactctggccctgtaagccctgcttttacaggtctccaccagcttaaattcaagcatgttctgatgggaagttttctgcttacctgagtttaattttctcataactggaccccatatttgaagctcttctcatttcattggtttgctaacaaatgtcttctctttgtagaggaaattttaagtaagcaacaaatacatcacaccaaaattggcattgcagtgacagttaagattcttgatgagagactgcattcagaaaaatttaatggcattccatgcttaatttcctttggaaagtaattatctataaatgacgtaaaaataggatactcaagaactagtttaaataggtaatttttgagctgaggtctgggtgaagaatattcccaagcaaatggaacaagaagtacaaatgtcctaatgaagaaatgagcttggcatattcaaggtaaagaaataagttcattttgactcatgggtgctgaccatggggagagtcataaaagattcatttggggagaaagaaaaaagcaaatttttctaaagttttgtgcatcacttaaagattgtaggcattattctcagtataaggtgaagccaatgaagaatattaaataggaacgaaactgtctgatgtacattttgaaagctcattctggccactgtgtagagaatggatattaggaagatgaaaaaggaagtagggaggccagttaggaggctactatagttgtccaagtaccagggaggtgccagggtaaatgggagaaatggtcagcttcatcatagattgtgcacatggaacgtataggacttgccgtcagataagatgtgaagagaataagaatgacaccaatcagaaacaaaccctaggactggtatctgaacaacttggtgggtggtaggctcaaaactggaggagcaggtttggaattgcagttgagttttgattttgtccatataaatttgagatgaaaatgagatattcatgcacagaaagtagaatacagaaccaaatatgggttacttatttaaaaattttctctctgcctgcacggagcacagagtatgctagtaacggcctccaacacagtccaaactattagacaacatgggtggagtgtcttagaaggggtgttatgagcttgattaaagcagttgcaactgcttgctcaagtgcttgcagttaacatccataatgtaatttatttgaatttagcaaatctgaatgtaaattcagattcattaacagccttgagaatattagctcagtaactgtcaaaccattttgacaatggcttgtgtagaaataaatgtttcatcacaactcagtacatgtgtaatcacacatataactacagtagacattttatcaaataacatgtggaatagattctaataccttcttttctatgttatttatgttttagatcctagccaatctcaataaattgatttagtgattgattcactaagggaatctacagctctcagtttgaaaaaccccagctaggtgtatcttaattgcttgccactgcctagtagagtgatgcttcccaaactatctgaaaaggaatttttttcccctaatttccaattttttattgacctacccctttgtaaattataatcaatattaattacccaaaaaggaaagtagatatataaaacacaaacccatttttattacatacaaaatatatatggctgggtggtggctcactcctgtaatcccaacactttgggaggccaaggcaggcagatcacctgaagtcaggagttcgagaccagcctgcccaacatggcaaaaccctgtctctactaaaaatacaaaaaaattagctgggagtggtggcaggtgcctgtaatcccagctactcaggaggctgaggcagagaatctcttgaacccgggaggcggaggttgcagtgagccaagatcacaccactgcactccagcctgggcaacaagagcaaaattctgtctcaaaaaaaaaaaatgtatatatatatatatatatatatatacatacacaaacacatatatacatatatatgcatatgtatctacatgtatataaaaacagtaaataaataataaatttataaatttgacaaattgctataaagtttcaaaatatttgttctcaatttctattgctatcaccctgtagacagcagggtctgtggcctacacttggagcagcattagtggagcttgggtgcctgagagtttggaaagaagaaaggtttgtctcgatgtatccttgcccaaggatacatccaatgctgggaagtacacctgtcccctgtggggaattcaaggcaatgcaggatcagttttagcagagaatgtaattcagagactggcattgagcagagatggcaggcgtggtgggtcctctcaaactcccctgggtgtgccacagctctcaagagtagagataagtaagagactaagggcctcctgaagagttcctgtaaattagagatcagcaaagacagcagacaaaaattttctctaggatgcctcgccaaacaaggagtttaaagataagaatctgagtccagaatctgacaggccttgatgctactgttccctaaaatttgccctttaggactcaaagaaaagggaagtaacaggcaagggtgagatccagagatccaaagacatgcagaaatagaagtcagatggcctattttggtcccagggtattaggaggctctctgaagttctgcaagaggctctctgaaagtctgcaatcatctacaaaataataaggggccaagcagtgatcggccttaccattagcaatgtctactatgcattcagtttccagggcatgttagttcttcatctgaatctaattcaggcaaaaagattaggtccaatcagttgcttgctgtgaatgaggaggttgagaggcccaagtaggattttaaaattgacaggtaggccggggcaatggatctctaagaattgcccactatatgaagccaacagaattaaaaagatagagtaaatgagatatcagggaagaagtagatcacccatatcccttcctagtatggaacagaccaagtgatttactgccctgccaagaggagttacagtcaggcagtagagagtcaaagtaaatattaggttttcatttccttcatgacatggcatttggcaaaattcctgacatttctatgagcattctaaataatcacttggctaactttaagtaactggacaagtgacatctaactcctagcaaactccaaggtctcctaaaaagcaacagtagacatctgtctgcaaacttttataacttgtatctgctgcaggtaaaaattttttccttagcattacttaggaggcattatgtaaaattaaacggcacgccaagccaacatccctcaaggaatcctagacataaccatctagcattaactggtacagcagcaatattccaggctggtacactggatataagtgggggtccatgctcaacaaggacccaaaatttttggcacattgaacagttttatgttaccacccacccccccccagatttttaagttacaaatgaaacccatctgtaaacaatccagtattattgggacctatccttagaaaacagaaaatcctaacaggtagcaatcaaggttggactaaaattttatattctttaacccgcctctccctatatcccctctctcctaccctttccaaatctagtgctctgtagcactatagggtcactatagttaacaatagtttattatatattttcaagtagctatcagagaggattttgaatgttcccaatacagataaatgataaatgtttgaggtgattgatatgctaattaccctgatttgatcactacacactttatgtatcaaatatcactatgtaccccataaatatatacaattattatgtgtcatttaaaaattttaagtgattgggttgattattctgacagtaaattatactagcaatttttaaagaatttagatatcaggtagctcttagaaatatcttcatagggcaaagctcaaaaaagttaagtaacttatctaacctggctaggaaaagcagagctcggattgaaggctgttgtatgtaactttaatgctatgcttatttcactgtgcctctcccctctctgaatcaggaacagtgcgtacaatgtccatagacaataaccacgccaatcagaaatcccaccaagagtcagctacgcagagagctccctgttttctcacctaacatagtcctaggatcttattttaaaacaaagtgtctgaaagtagagcaatagcatgcatgcacaggaggattctcctcttccccaaaataaaacaatataaaattccagactatgttttgagcagatgctgcttcccttaggtcctggcagcaaatgaatgagaattttcatagggatctgggccaggtgggaagtgaatgcaggtttggggacccatcctgctgccactggggactgagaaagataatccaggcccctttgacttcataaggctgctatggggatagggacaggtggcgtagtaaagaatgctctttaaactctaggtctgaatggaccacaagtagaaatcgtattattattttttttttttgagacacagtcttgctgtgtcaccaggctggagtgcagtgccgtgatctctgctcactgcaacctccgcctcctgggttcaagtgattctcctgcctaggcctcctgaatagctggggctacaggcacacacacacgcccgattgatttttgtatttttagtagagatggggtttcaccatgttggccaggatggccttgatctctcagcctcatgatcctaccacctcagcctcccaaagtgctgagattataggcgtgagccaccacacccggccaggaatctttttctactacattgtataccactagccaagtggactttagcaggccacgcttcatacacctacatgactctgtgagtcttcccatgacaggggagacagctgtcccaaaggtgccatccccaaaggacacccttaggagatggcttagtccttttgggctgctataacaaaatgccttagactagatcatttataaatagcatatatttattgatcacagttttggaggctgggaagtccaagatcaaggcactagcagattcggtgtctagtgacagctcactgtctgcttcaaaggcggcaccttgttactgtgaccttacatggtggaagggcaaaaggagctcacaaacactctccagcctctttcatatgagcactaatcctacttaagaagactccaccctcatgatcttatcacaaaggccccacctcctaatactgtcatcttagggttaggtttcaaaatatgaattttggattgacacgtacattcagaccatgcaggggacaataccctgtcattgtcaaacaagcattaatgccctgaaaataggacccttccagcctggtcaggagatgaaactgctatctccaagaacagaagactacatggagcgggtttgcttctcacagatggtttcactaaacagaatcctcaagaacactccacaccaataccttgccctcatgcaaaaatgccattgttaaccaagtaattaatacgatgctaaattctattaattgagaggtagtttgcagatttcagtgataatgatctgtcatctagataactatcctcatcttgttctctaagccttctcatacccaaagctctgcctccttctagcattttttaaagaatgtaatctatggaatgagctacttattttctaatatcacattgctgtttgttagctgtgcaaccatagaaaagttacctagggtctttgttctttagtttccttgtctcttaagtgggaataaaaattagttctatactgcagggttgttgtaaagactacataaaacatgcatgaagaatgtttagaacagagactggcatagaacaagcacttagatgatggttgctcttacaggtatgtcaagagctgagctgagcacccaggtatcaaagtagtcaattaaaatgataaaccaaaatgaaagcagtagtcaagccttaatcccttactgcaacagtatcaacaggaggctgaacaggagaaggcactggctcctcctatgttccatttttccccctggaatgttgctgagtgatggatcagagcagaacagagcagacaagaggggcatctcactgcctgcccaaggaacccagcacaaaaggctccttctgttatgtggccctgggatccagagtaagaaagcgaaaggctaggagtgggaaagcactgaatagtgagtcagagtcgagcaaagtgtcttcaagacccattccatctccaataaagtggtcctggcagaggttttggcctgaatggaggcacctgagttaggaatgcagacaggcagaagagcaagtgctgcagccgagtggagggtctgagacctggaccgcaactccctttagagacttcaacacactggctgggcaccaagtctgagtgagaaagcaggtttcccccatgagccccagtaggtagagcctttgtattacctgtggttgggcctgaaagatcacacataggatgtggaccaggagcttatttcctgggttgttacactctctcacacacacatcacatcacaccacacacacacacacacacacacacacacacacacacacttcacttgtataagatcctctggagcaatgtagatgctactgaggtttcaatggagagagagagagagagtgttacttcacacaactaacagggaaataaaagagttcttaatactacttctggcctccaagtttcttttccttttttttttcctcctctaagtctttttaaaaattgtataaaatacatagaatataaaaatgtaccatcttaaccatttttaagtgtgcaggcccatagtgttacatacgttcacattggtgtgcagtctccacgactctttttaccttgcaaaaataaaactccatacccattaatcagtaacctcccattccccactcctgtctcctataactcttttcattacctcctagccttgctggtttgtccactttaatttctttcatccctattgtgtgaagtaatttttcctcttcatcattcctaaggccaaacttgtcatctcagtctgtctgcttcttaaaaacaaagtcccaaatcctgcacccccagagttaatgggcacactctctcagaggggacttcagcaactacatttaataccaagtattcttttcagattcttttgcccattctaaatggcttatcaattttttccaaacataaattatgtttgcaccacaggactcctaggagcaaagtttctctcatttcagtatgaaatgaaattatagtgaccacgaattcagaaaaaaaaaaaaaggtcactgcatttatagccacatttctggagcaatcatcaatacctttgaacatgaagtacacacattcaatatatcgtattttctaagttttttgtgtgtgtttggccctctaggtgatgtgttgacatttttagattctcatgtggaatgtaacgttggttggttggaacctcttctggaaagagtttatttaagtagaaagaaagtggcctgtccagtaatcgaagtcatcaatgataaggatatgaggtaatatttacacattccacaagatactttcaagcacatctttaatcacaagcagcagaaagtgctgagtatatgcctaatatgtgtgttttttcaaaatccaagacatatacagtttatctacttaaataaatggaaaaacatggtcgatatcttgggatcagagtctgctgatgcaataatctatctggtcactacaaattcttaactctaaataccaataaatcctaatactcatgacctagtttttcccctttatatttagctgaaccccaaatatttatttacctcaaatttagttcttatttctgtgggaagcgtatatgtgcttttaagttgctcttgtattttttttcttcaaaactggctagcatattgttattataaaagtataagttaagcacaaataagccaatcagttactaatgcaaattgtacttgtaaacattcttgaactattattaaaaggtggtgatctaaactcatcaaaagcacttgtttcattcatttgattacatcgtgaagccaaatcgataaagtatataaagatgtatataatcccagataacactttgtttttcatttcctggattagttacatgacagtggataactttcaaagaggcatctttgtgtggcccatgaactttggttggagaacaattcctccagatgtcattgcaaaaaacagaattaaagaaactgatacaataaggtaagtgtgggaaatttaagactagaaagcagtcatgtatctttttgtaaaagcattaaaaaattctacaaaacagctgtatcttgttattctatagaacattaagaatcacagttctagccaatagattaccaaagcaaacacagtgttcttgagaaattcgttcccaaaactcattcttcactggtcatttgtaccctactcaggcctgaacacagaaaaattcactaatgctatcctgtcccctaggatttgcaacctaagaaacacaaactagcaaaatgtgctgcatacatactatacaaacacatgtaatattaaagtaaacataagtgcaaattaaaagtaaataatggtaatagaaatatcattctaatgatagcaatggttaggattttcttttacagcctaatcctaccccctccatgagaaaagtgccaaattctatgaataaatttaaaaattgattcagaagctggatatgaattcaagtttgggcttttatttccaagaaactgcattgaagaacacagcttagacttgaagctgaagtggaggcttcctattacttcttcagaatataagcctgcagcacaagcattaagccagccacaggaagagctgcagggggcttaaactttccctgttgtagtgaccacttaaacagacacaagtaagccagccccaacagaaagccaagcccagaccgtgcaccgaagcgtgttttccccaaacttacccctcaatcagtcatacccgccttccttgccaggtgtgatgccttcagaattattccaccaagcaaagaagtgaaggttctaccatttattgagcactctgtgccaggcacctaactctcttcctaactctaggagggaggtggaagaattcaccttaaagagatggggaaatttagacttaaaagcattaagtaattttcccaggaatacgcagctaatcaaagaagaatttgagactcaaacccagaattacctggatttaacactcttattctgaacctacacctaaagaacctctgctctttccatactctcatgttgagggccaatgtagtggttgagttcagactatattcaacataatgttaggacgagaatgcgttctggatagtctagtaggaaaattggagagcagaaagaaaatgaacataaatggtggcggaggggagagaggtgtgggacaggaattatctcccccttgagatcactgtataccctaagcacaaagcaggctctccacagaaactactttagctggctgagtggtgaccaccataggaagtgattccagtcttggctaactgctgactaaaatgtagtttctatcctccatgatcaatattattagtgaaggttctggagacagtttgaatctcaactgtaccactgagaagtggtatgagcttgaaaaggttacttatcatcttgagcctctgtttttttatttttacataaagactcataaaagtagctgctacttcgattgttttaagaactgaatcagataacatataaagtgctttgaaaggtgcttgccatataacacgctgtcagtaaagtttgtgtgtggttgtgaggcaggagaatagggtctggaggcaagaagcttaaggccaattcatgccgacttcctaaagctgaatcaaggaaaaacaccaaggtctgggggcagggaatctaaggccaattcctgctgacttcccaaacctggatcaaaaggaaaacacctgggtctaggggcaggggatctaaggccgattaacacccacttcctaaagctaaaccagaaggaaaaccccatttccccacacccgagtaacaaaggatcaacggctactctccctacagccctccccttccaccacatctcagaaggaaagggagagtctctgccttggactggccaagcagggaccttcccttcatctgcacagggcgccaattcaccgcagcctttcattagccaaccaaatcctccatccagataaggggcagctggtagggacctcgaaaggagtacttgaaacccagaaaacttggtaacccggcccttgaaccgtttgctccggcccactcccaccctgtggagcgctttcccgctttaacgaatccctgcttgtgccgcttcgttcatgtgtttcgttcctttgttagtgtgttttgttcaactctttgttcaaaatacccagaacctggacaactcactctcacggccttccttccagtaacggctgagaggcagtacagtggagtgagtggcacagcgtcccctcagactgcccagagcaaacccaaggtgtctactgtccttgggaaagtttcttaccttctccgtgttgccaattcctgagcgcttgcttggaggttctagtagagagcgcagctactcatatacccttgacggaagaccggaagaccggaagaccggaagaccagaagaccggaagaccggccctcctctatcagggatggtcgtcctcttccacagagcgcgcagctttcgggagggacgcacatggagcggtgaggggggaaggagacagccgcctagccagctagatcagccgaatcaaccctggcaatcaatgggctgacagatgttgcagccagatcgccctcacatccagtgttgcagattcttaataattgcacacacaagattttttgtgaagtctgggctggaatatatatataatacttacaatagtgcctgatactcccttagccctgaataagtgttaaaaataacattcctggacagtttgtgtcacagtataaaggacaaataatactagttccaggatgcatctttgctgaacctaatctagctctgccaccatgatccagggatcgcatcacttaagccctatttgtgactccatcccagggcttccctgcatcaggtagctattctgaaaagcctcctacctcccgtacagatgtacagaggaacaactctaaaagtcgagctttcatgagatgcaagtttaaaaaacaaacttttctttttgtaggtgccctgtcatggctggtggattgttttctattgacaaaagttacttttttgaacttggaacatacgaccctggccttgatgtttggggtggggaaaatatggagctctcattcaaggtattaccaggtgtttcccaacttttctttacgataatgagttaatcaattttaaatggtttgattttactaccataatcaggtatgtgactgccactgagaggaaatttcacagaaattttagggtctctggattaattttttcatatctcagattgaatttggaagaatcaattgctgtcataaaatttattagcattccctaatatttcacaacaccatttctgcttataaatatgggggaaatgactttctgccactcagagtaaatgctgtgggagtcatacgtgctacaaaataactctcctggaacatctgtctagaatgttggaaggaatagactcaatctgtaatggatcatcttagagaacacaaatgacagaagtacattaaaatacctctaaagcaggtcaccaacaggtcaggtgtgccttatagtacagctcctttgggcactttatacaatctattatacaatcattgattaacttctgagaaagccttggcaacagcagtagtagagagtgtccaaaaagtaattgctttcctattgggtgggtgttctgtatgtatgtaaaagggtgtaattttggagctgctgatcatgaaggatggttttgagttgtgttccacaagccttttggttcttcccaaaaatgagagtagaggaacgtgaacaaatggacatctatacttctttccctgattcaatcaaaacaagaactcatgttttacaaaatgggattctgtgaagatttatttacaaattaaaaaaaacttacattgaaagttaggaaagaaaaaattacattttactaatcctaaaatgatccacagcaatacacaaaattaaataagcctgttgagtttgattttctattgcaaaagtgtttttgaagttgagtattacttcaggtagggggaaacaaggtggtttcttgtcattgttaagtgccgatgatttgtggataatcatttgataattgatgcttatcatcaaattcttccaggtgtggatgtgtggtggtgaaattgagatcattccctgctcccgagtgggccatatattcagaaatgacaatccatattccttccccaaagaccggatgaagacagtggagcggaacttggtgcgggttgccgaggtctggctggatgagtataaggagctgttctatggccacggagaccacctcatcgaccaagggctagatgttggcaacctcacccagcaaagggagctgcgaaagaaactgaagtgcaaaagtttcaaatggtacttggagaatgtctttcctgacttaagggctcccattgtgagagctagtggtgtggtaagttcaagtggcaatttaaaatcttactccataaaaacaaaacacaaaatctctttcaaaaatgtgtggaaagaatgagtaattacattataaataaacaccaagtatgagcaaagatgggacaaagcatggctgagaattaaatataggtaaacttgaggaaggctaccaagtggtcatgttcattgattaactcaacagatatctattgagtatccgtagatctgggagtatttcagacttggattacagggtgatgaatgaagtagacttggttccttccttgtggagcttaatttgggtagagaagaaagattataaacaaataagcaagtcaagtgtaaatacaaaatataatagctctcatttagggaacaggccacagttgatgactcctcagttagagtggctgagaaatcctctctgagaaggagactttgtaactcaggcctaaaacactaagtgtcagtcagccaagctctaaagaagagtgctaggcagagggtaaaggtcacgtaaagccctaagacaggtgagtgttctccatccaagcactggaaagaagacgaatgttgtcagggtgtgaaggagggaagaatggcaccagatgaaggtgaagaggaaggaaggagccagatcacacaggtccttgtaagcaaagtaaggattttatttctttccttccttctttcctgccttgcttccttctttcttctgaaagcagtgggaagttattgagcagagttaagcaagggggtgataagatttaattggggtttgtaaagatttcaaagaggaacttaaaataacagaaaatatcagagaatagcagataacattccagggcatgaaggatggtatccaaagggaagaagctaagccagataaggtagccagagtacaaggctgagaaaacatcaagaaagaggagaagctggggaaaagccatttcaaaccccttctaggagtgaagctgcatttgaagaggatggtaagacacgtgggtttagatatgattagtcaagccttcagctggggttcttagacagtcatgcttatttctaatcttttatttctaatttaatttgacttataactaaccccagtgtttttgttttatttcagcttcctttttcttcatccaagaaattctttaaaaatgtgaccattagttatcccgcccttttaggccaaattttttcagttcttcttgagagtggattataccatgctttctgtctggaaaatctcctgatagcaaaaacttactataatattcccccttgaaagtattcgggaaatccaggaaagctatgaaagacaagaaactagtcttaaaaaaatggttctgttttttacaaaattcaactgataaataagtttatgtgacctgtttttagataacgcactgtattataaaattgccatttttatgggtccaaatagaatggcagctactttaagtggctcaacctggtaacttatcagacattttggatttatatacactgttcaaataacaacatgtcaaatataactgtaaaataaatttacaatttttaatttcaaccgctgagcagaaaaaaaaaaaagaaaggaatttccactattctaatatttcccattccagcaacgcagaatctcagtcagagtaataataagctttaaccaccagagggcactagaaaactacctttgggctccgctgttgcgctaacctgagtgagttcctatgaaatttctggagagctctcctaatgaaacagccttctgctgatgcctccgctatactatatcaaaatgcaccaagtattttaaaaagtgattttaacaaattccttctattttcctttgttgtcttccttaaacaaatttcagtgaagatgtagtttgctcccttctgaagcaaaccagcagggagcgttattaacatttttaaaaaattaggacctttctccaggtaatttacaacaaattaagtagatcattattttagatagacaatcgtggaaagttccaagaaaataaactccacaacttctttttgttacttgcttcgtttcccttctttcaacctccactacggaatttagatccagtgaaagttttgtgttttgtaataagaacaaacattttcttatcgaaccaacaatatttgaagctaataatctcaccaataatgtatttttcactggattaaactgctggcaaacagtctatagctccgtttcccttttttcaacctccacaagcagaaatttaaatccagtgaaagttttggttttttgtaataagaagaaatattttcttattgaaacgacaacatttgaagctaatgaaagaatctcaccaataatgtatttttacactggattaaaccgctggcaaatagcctaatgtttaacaattctgtcataaattgtgcggaatgtctacttcctaaattggaaaatgaaataatacaacatggataatttaaaattcatacactgcctattttttttaaagattaaaatggtttacagtaaaaacatggatcaattatttttaaataaaaaggaaaattctgaaaacaactaataatgaaatgaagaataacaattccaaaacacttcagagatgatgtctatatgaagaaaagtattaggttggtgtaaaagtaccttccatggcaaaaacctcaattaaatagtttcctcagtaatttctaagaaaaaggaaaaaaaaatcttcaggtcaaatgagggagggacatgtaagggacagaaaagttttatctttccttccaatgcttttcggttcttggaaggattatacaaaatagacacaaatagttaaacagggggttcccaaacactgtcctgaccaatgttacttgtgctgtctcagggttccatggtcaagcacatttgagaaacatttgtacaacattctgacagcaagctgaacattaacaccctgaagattttgagaagttctggagtagaaccacctgttcggctctgtggaaaccagaattttccaaatttgtttgaagatagaatatttctgcatgatccacaaatacaggagcttacataatatttatctctgcttcagtacagagagcaattgcagcatgctttccttcctttaagccccgagattattctaccttcatgtctttctattcaccttcctctctgaagttcaggggtgggactgtgggggcattgaatccttctgtgccttgtgatgcccacatttactaacagtgagctgtctcctcccatatttgtcattttaaattgctaatagagctttctctgaggatttttgatagagattccatccttccatagttgctttgtttctgcctgtgccaggcacctcagaagtaattaacaacctggtactatttttaatgtttgtttctatgccttgaaagtctgtgatggttcctatccaaggcaggtggtgtaaatattcatctcaaatccaaatgaagcctggtgtaaagtttcagattctcagggacaatccagcttccttgttttctccctttgctaatgggcaaattgtttttcccagtgcagcattcaactgaagatctgtttttccgctgttatgtggaagacctgaattccagatttttggtttacacatacctctgtttttcttccatccatatgagggaacaagtctttcttgccaacctttgcaagtttccctgtagcctttaattttttccgcatattctgatccctgaagatgtcccttactttcttgttcactaagctaagcatgtaaaattgaggaccaatgtactgagcccccttttatgaagtctggcaattctgtgagcatccagtctgcatcagtgcagcaccctgagttagagctctttgttaggcatcatagaacaggaaggacacaaatagtgtccctggcaacaaagacttcagctcctcccagctcaggaggctttcccaggacatgtcctatagattcggctctgcacagctgttcgagaaatctgaaaaccctaagttgcactgttaacccatcatcttgttagccctgcccaggatgtcaaagggggaaaggaaatcaacatttttctgcattaaatggtgacttaaagaaagctacctccatatttgaccctgtaaatccattaaaaacctgggggcctgccagaaagtgcctttatgcttggctctgtattagctttcgtgactttcctataatgaattgtagcttgcttgggtcattaagaagattctgacagggaatcagctggaatctgctgttctttgaaggactcaatttatctatgattcagtgcttaagcagtcaaaaggcttgaaggggtcagtcagggaacatagctcataactcttataggtgcattgacttttagtatatgcattagataaacttaagacaagaaaataattacttttcttgccacctttgctcatttgttatttagcattccaggcaagggttaattaaaagcttctgtgtgttggctctatggctgatcacaggccaaaattaacagattgaagctgtactattacaagattacattatgtctctgttagagatagcaaccaataaaactggatagtgctaagtaatgctaagctattaacttttaaccttattatagttttatattctgtattttctaaatgtgtctgaatgtcttgttttactttaaaatattttgtaattcctgtttcgtattttgctttttagcttattaatgtggctttgggtaaatgcatttccattgaaaacactacagtcattctggaagactgcgatgggagcaaagaggtatgctaaactgttttctatctcatggtagctgataggtgcagggtatgacacattcattgctcaactgagaaattcatctttgcccaacagaaaaataattttctaaatttctttgtaaaaagagagtccaccactaaacacaaagacagtgactaagggaataaaggtgtgggtcctgcagtcaactcactgggtccagaatgaatccagtcctggcaccatcatttgcaaaagcgtgttaacgtctgcagattccttaacctttgggtaaatggtagtgataatcatgcctacttttagaactggtgtgaggctggagttaggtaatacatatgaagcatgtagaacaatacctaatgcttactgctctgtaaatgtttgctgtaataataataaagataaaaatgtaaaaaatgcataacatagataaagatactaaagagacaacatatttctaaataatcattctaaggaagcagtcttattgtctgattccattcttctttcccctcattttcccgcattttaagggagtaatggaaataaccaaatccatgatccatggtagaaactcctataggaaaactccccaaactcagagcgcaatggttagtagagggagtcgggccaggaagcagggaatagagactccttccacagtgctggaggtgagctctgagtgattacacttccctctctaacatacattccttaacagttctgtgtttgtggaaacagttattggtttgagtggcaaataggactcagaggaaaatggattcatgaatagaaatcagttcccaaaattgcagattgttctttggtacagagattattttgcaatggtaatctaggcttgttaagtcttacatctttgctttgacttcaagatactgtttatattttttggtgcatcccatctctacctcttaactcagagctactactagaagaaaaggtatctctgttgctatatttagctgtgaattgtaaacctgaagccaaggccactcttttttaattaggaaagaaaggagtcaaagggaagtgaagaagtgttaaaactcattaaaagaaataaatttcacttactaacaaagaggaaataaagtcataaattgtaaaaacaaaaccacaattatttcacattatatgaaaggaaagtattaaataatgcatttttttttttttaggaatcatcatagcagggagtttttgtgccagagtaaccagcattttatctgaaaacccaaattctattcttgatgaccattgagtctttctcaattggatgctgagaggcaaaagtataaattatgcaggcttcgacttccacaaagccccagctcccttttagtctttgttgctcatttttagcttctgcctcttgtggtttgcttgggtaataaaaagtaaagaaatgtggaggaagttaactcattttcagcagaattaatgaggcttaataccaagccagtgactacaacattcatccaaaaaggctcagaaagaataagacccttagattgaatcatcaagctctatcccttaccttacctaaaaagtttccttagttattaacctttaaagcagttgaaacgtattttttcaaggtaatatctagcttctcttagtagcacataacttccttatattatgccatacttccatgcttcctacatgttaatgttcacgtgaatcacctggggagtttgttacactgcagattctgaatcagtaggtcggtgatgtggctgagactccgcacttctaagtagctcccagctgatgcggatgttggtccaaggaccacccttccaatggcaaggtccaacacaatgactttgatctaacctgataatcaaagttaaacttcacttacaatacaaatgattcattaggtaaaggcatttagatagattttaccagaagcctatttttttcaaatatgtttatattagtacaaaacgataaatttcccacagacccagagcattagagtaaattgaccgggtagacaatagtaggttgtaaacaactgaagaaaaatgtttcagaattaaaaacatggtttcattacctgaattggtacttattttagacactggcaatttctccaagagcagtttctatgaactgggggatgccaacctggtagcaacctgatgattcctcatgctagtagcaaagaaggacttccacctttcctacaatcggacaaagcctttatgatggttttatacaaggaagcataaaatctccacccaagaaatttagggctatgactggtatctccctgtagccacccgtggcttagaaccttaatcatgtggtagactgaacattccaattctttaagcaccaggcttgtcgggattcagaacactgaaatgacatccatatgcagacagaattaattgcactgaataatttttattattgtaactaacatttattgaaggcttattgtgtgctaaacacttgacagtcattaccccaaccctctgagatagatacaatcgctatccaacttaaaaataattagaaaaataagattagacagggtaaataatatgcccatactatcagaattacaaatgataataccaggacttgaatataaaatgtcagatcatagttcctatattcttaactgttgctaacaaaaatgtttgacaaagcccctgcctgtgtttgctgcctgaagtgacctctttattcatttcccccacagcttcaacaatttaattacacctggttaagacttattaaatgtggagaatggtgtatagcccccatccctgataaaggagccgtaaggctgcacccttgtgataacagaaacaaagggctaaaatggctgcataaatcaacatcagtctttcatccagaactggtaagcaaaagattggtacctcttctttaccacaaatttgacttttgatcaaataggacataaaattctcattgtcaccttcctcagtcagaagttttgtgtgtttgtgaccatgggattatgtaaaagttcattcacagagatgcatggatatctttcgaaagttgacaagtccttttttttttatttttcaaaatttatttcaaatgagttattttaaatagaaatcaccaagttcttctagttgcattgctatcatttgcttcagtcaatcaacaacaccgaaagtcaggcttaaaggctagaactggtccccactggtcatcagtaatgcttataaggagaggatatgggcaacacaggaagcagcatgtctcctacaagtcctgcactttagagtgaatctggttcctcattctgccccctttccataagagactcttcccatcccctgtggtacccagaaaccggggcttctaagggtctgctggagccaactctcaccagctcgctggagccacttgtgcacacccttgccagctttgcatttaatcataccacattggtagctggaaactggccatattgggagtatttataccacagaaattggaagatgttactggatcagggatacttttctgaaggtccagttgttccatttaccagaacattcctggtctactgtattcattctcaaagtcctctccatttgtcccaattacattttaacagaatacggagtcataagccttggtgtaggagcttgggattggcgagaatagtctcagaattgccttcttaaattttctacaatctctccagcaggtagccaccaaatctactgtctacagtaaatatttgggtatttggagactctcagtttgtcctgggctatccccaaagtaagcacctttgcttcctttaggtgcctccgttccttttaacaacacaatgactattcttttctcaacatttttcttcctgctcagagccaaaactggggcctgagtaatgtattctccaacatttctcccattagatcttctctgttgtatttcaattctttctgaacagttttttctctttagtaataatggttattattgagttattcagaaagattaggaattattagcatatatgccactaattttattttgcatagtgttaggaaatccataaacatgcagtgtagtgaataacttacatcttaccttctccctgtgccaaagtcaggagggagggaaggagaaagggggggatgtggtaaggagagagagagagagtgagagagagagaatatgaataagaacgagaactaaaacacattcttcatctccagaattgaatcttgggaaagagttcaagcatagcagtttctcttaagcggtaagctgatttggtaaaggaggtaatttagttaagatagcaaaaattagaaagccttttccctaccttgtttgtacctatgactttggaacattttacacagctgccttctgtcttgggtttcccttttgatgttaccaaatgtcctggagatgaatagcttggtgatcagctttcttcttttttcagtttttcagtagttttcatgctattgctactaggtctcccattatatgtaagtcttaaacaacaagagaagtataaaatgagacttccttacaaatccttgacaatactcaagcatcgtatttccaaaatcctgcaagggtgacaatacttttgtagcagcaatctttaaaataaattattatgaaagtcacccctgtttgataactttttaaagtttaaaaacaacatgtgtaattaagattgtctttgtcatagtcatacgtaattaagaaaatttatagatgaaaaaatatataagccattagtaaggtctatctaatttatctaccatttctaggatattcactaaatattaagcaataatataactttctttaatgctgttgactttttcctaatctggattttggacatcagttattatgaattgtcagagattatggtaaggagctcataaataaaatacatcacttccagaattttgtaatccaaactcacaaagacacctactttaaaaattaattaactttttgttacggtatgtattctttctttaccatcaatgaagtagttatcatctatcaaatccaataaatgtcatctgtaatgttttctctttaaagagtatagttctcagccatatcatcaagaaatttttcttttgcctcctgaggacttaaaagtcttatagcttggtggaggatgattacttagtctgagacagagacaaatttaatacttttcaaagtctgtgtttatgttaataatttagttcagaagaattcttaaaaatcaaaaatataactgcctgtccatttttttaattgattttcatttcttcatattgcagttatcaaattcagcctgtggctcattcccagctcttctttctctccaggtgaatcacattgtttttgaaaacaatcagcaattattatgcttggaaggaaatttttctcaaaagatcctgaaagtagctgcctgtgacccagtgaagccatatcaaaagtggaaatttgaaaaatattatgaagcctgaagtgtaactgatgtttttatatagtaaacccattaaatactgtgaaaataacactgaacttggaaactatatttctcagcggtagtttaaattttcaattttaataacatttgaatggaagattttttataaatcacaatatttggaataccaaaagatgactcaggaaaacagtccaacattggactgaagtccttcttcggaactgggtggcctttgaattgcctgctttccaccctatgctagacctcatcatgcaaatttccctgtgaaagctaacaggtaactggaaatgaagacagaaggacttgagaaagcatgaggatattcccaatgactatgtttggtaataatcagctcttctggcccacaagtaggaatgatcaatgagaacttaacttagtcctttatttggggattttttcatcaaacaaaaatttcttgagttcttatggctagaagacctcagatgcccacagctgtcacgtttgtgaaatccctccagactacatgcatgcttacctaacagtttgaaatagtattgatctactgctggtaaccctgcttgatggcagcattttgatctaaattacataatggtttttcccaatctgaatcagtggaaaaaaatttaagtgaggaagaagaggccttcaaatgcttatttaattctaggtatgaacactatttcagttcattttgtgcttttaaaactacagttttaaagatttatgataccaataacttcctagattcatgtggattttttttaaggcaatgaaaaaaggctggattataacacactgtagtaatcaaaaatgcatttaagcattgaatgcactctagtgcagggccaagtaagaggagttgaaatgagtaaagcagaaatagagctgctgaaagtttcttttatataaaaataataaaatactactttagatatagtagcattcacagggatgaaatatgcgaaaaatgggttctaaaatatttcaaagggaaaatgaagtgaaggaaacatcatgaaaggggaaaggaatgaggtaaacaagtcttaggaagagagttaagaaaaaattccgctggacttggccaaagaaagaaggggatctagtatctctatgaaggaaaaaagagtaaagccctcagtgtgaacccagtgagaacactgacaaatttgggaaaagttaaatactgatttcatccaaataaagcctctaatcttaagcataccaatactttggcataccagaagacaccttagaaatcaggatagcctttgcattcattttggtaagaaaactgatgctgagaggataaattacctaaaaatcttaaaacccaggcaagttagtcaaagaatcaagattagaattcaggtttccagagacagggctcattctaatgcctcaggtcactggcccgaacaaatctgcttcacagaattccttagaaagagatacacaattctttgctgggattgggtccctggaggacaaccatactatattcttgttaatatgttttttctttttttaaatttaaacttttgttcagttgagatgattgtgaaactaggtatctttcattctgactcctagtttaacatttaattttgactcccaatgagttacgtaaaagcaaaactataactaagaatgggaaaaagaactatttctgcacatttgtaacatatttaagatgttttcttcatataattgaaaactgcagatgagtaagagaatgactaggaaatgagatacagttatatgacacataatgatgttttagtcaacaatgaaccacatatttgacattggtcccaaaagattatattaataatatggtatctttagtgtgcttttctatgtttagacacacaaatactcaccatgatgttacaatagcctacagtgttcaatacagtaacatgcacaagtttgtaacctaggagcaacagggattccatatagcctaggtgtgtagtaggctacctacaccatctaggtttgtgtaagtacactctgatattcacacaatgatgaaattgcctaatgacacatttctcagaatgtatttgtgttattaaatgatgcatgactctaattcttttcaaaacagagccatatggggcaagggggatggggggacgcaagtcagttgtcaaaagactaattgagttactgacaaactgaacatgctaggtgcctcatgtaattcttcatgtaactaaaaaatgttgagaggtttttttcccccgggtatataggctctctttttatccgaaaatagtttccacaaagaagtcaactctgttctgaaaaaaaatgaattgcattttgaatacacttatctttgggtatatcaactaaaggaagttggatttttttccttaacagaaacttctgcagtcctctcagttcacatcctttctgactttaccctgacaaacttattatataaagctatatttaaatctatattgtcaatataacaaaggattgtttttgaacatcacaaatttgttcttggatagaattttatacattgcttttcatcatatatttgctcagttactctaagaagcaaggaactgatcactagttgggaatctatatgggcctaaacttgagtgtattgatttattattacatctactaccaacattttcttaagcatagccttctaaattttttcaggagattagaataaaggtatacatgctactcggtcttctggtaattctagtgataaacctttggatgagacaggtcctaatcagcactgaattcttcaataggaggctgtgttacaggagctacagatttttccctggattagcttaggtcattgcctttacttt
